United States Patent 7,892,730 (COMPOSITIONS AND METHODS FOR CANCER) - sequence listing, part 7

SEQ ID NO: 565 - DNA, 157044 bp, Mus musculus
  misc_feature (1)...(157044): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggctcctgaatgacgtcagtgggaataccttgtcttgaaacctgtggtgctggtgttgaaaggcacacgcagcaggttgtggtggcgcatgtctttaaccccagcacttgggaggcagaggcaggtggatttctgagtttgaggccagcctgagctataaagtgagttccaggacagccagggctatacagagaaaccctgtctggaaaaaaaaaacaacaacaaaaagaaaggcacaagcagcactgctgagagggagctagtcaggggccacacccacgtgtgaacttgtccaaagagacggagcaagaacggggaggagccggctttaacagactgtgttaaccagtctgtgtgtgttataatcatatgtaatacatatattatatatgtgtatatatgatgtgatatatattcacatatagtatatgtgaatatatatgaatatgtatggagtatatatgtacacacacacataaacacacacacacagacatacacatacacaagtatacgtggtcttaatacataactcagcctcgcctggcttctctgccatcttggtggccttggatttaggatcctcatgcttcagcctcctgggtgctggggtcaccaccatgtgacaccacactgtttcttattctataaatcttcctcctgctgaacccctcagcttaggcctggcatgtgatgtgggagcagagtggaggagctcagcctctagtgctgttattacaaaaggaacatgtcaggaagcccttgagtggggatacgtgtggggtacacagaagttggacctcgattgcgagctgtagagctggttggcagaccactgagtgagaagtatggcttttatgataagccagtaggatgcggagactgttgcttaatcctgtgtcatcagcggtgtgactaatagcaatttaaatggggaccaaagaaaaagaatcctttaaggtaaccggaaggacagagggaagagggggaaaccaggagaggtggtgggtgtggcatcagggtgaagggcaagttccggagttttggaaccttgagctcagatacagagaggcactagatctgcacacacagaagcagagggtggtggtttgtgtctgtaatcccagcattcagaggctgaggcactaccctgagttccaggccagtctgggcaacagagtgaagacaagagtctttagcgattccaaatgccgggctcgcttacctgttccccagagcttgatctacattccagataccggtgactctctagacctcttcctgggcctccagactcatcttctgccttcttctgcctgcctccatttcccctggatctttaatgaactttctaaactcagctcccccccccccgccccccaggattgatcttgcagcctgcctctgagactgtgcccttccaggattccctgaacagtaggtgctatgggcacccacaccagagccggaatccttggtgttccttctcagaccgacaggctcaggaaatgctccccatctctaaccctagccccagggcctcttctatcctgtgggtgcaccagggctccctaactgcctgagtactcttctctttcctctggcccctggctctttccctgcaaaggatcctgggtaaaacctccacaggacaaaaccaaacttcttagaatggcacccaaggtcctaaatgtccagtgggtgcatgctcaaattcacagagtcctttctgtcccactctatcccactcttcccctacgcctaccaggggcctctctgtgcctctcctggcccactcctgattactttagccatgattccagatcttgcatcttaggtagcccctatgagcctcatgatgtcccctagcaagaaattcttgtagcccttgcctcagctcaggttttaatttccctgaattaaaaaaaaaaaaaaaaagttatctgagtgtggtggtgtatacctttaatcccagtactcaggaggcagaggcagggggatctctgtgagttcaaggtcagcatggtctgtagaatgagtttcaggacagccagggccacacagagaaagcctgtctcaacaacaacaacaataacaaccacaaccaccaccactaccaccaccaccaccaccaactccccacccccaaaccaaaccaaccaaccaaaaatatggtaaggtctagagatatggctcagagtttaagggctctggctgctcttccagagttcccaggttcaattcccatcacctacatggcagctcacaactgtccgtaattttagttccaggggaaagaatactctcacacagacatgcatgcaggcaaaacaccaatgtacataaactaaaataaataaaccattaaaataaaggtaaaaaaaaaaaaagtaaaagccacattccatgcaaggaactgagttaactattctaagtccagagtgggtagcatggagttcacatggttgggcagcctcacatgtctgactccagagtctctccatctttgcagttgtacctactgtccctgttccctatatccctcctgagtgtgactccttacaccagtggactcacaaagcgattgttccttagcattttgttagttagcagacctaaatcacccacattgaaatatgcataagaatctctctctctctctctctctctctctctctctctctctctctctctctcgacgggatctcaactatcccaggctggccttgaacttggtatgtagccagggctgattttgaactcgtactccttccaccccagtgttgggattatcagttttttgcctctatactcagctctttttgaaaatgtttaattttcttccttttttccttttgaatacagcgtcccctcctgtagctcatgatcttcctgctttagcctggcttctgattacagggctatgtcaccatgcctcctcaaaatcgccttccctttccccttctgctatgatccctcctcctctcccttcctttataaggctgaatactactccatgaggtgtaccattgtatttacccattcataggtggacatgggggtcattttcttctctctctctcttttaaaaaaagatttattcattttatgtacatgagtacactgttgcacccttcagacacaccagaagagggcactggatcccattacagatggttatgagccaccatgtggttaccatgtggttgctgggaattgaactcaggacccctagaagagcagtcagtgctcttaaccgctgagccatctctccagccccatgtgggtcattttcgttctctggcccttgtggcagtgttgttgtggacactgatgtgcagctggactcctgctttttgttctcagaaatagaaatgatggctcttgaggtaactttccgcaatgttcttcgcagaggtcattacattgcccaccagcagtacagatggattcctatgtccaccaacagtacagatggattcctacatctctacatcctcaactctcctcacttcctgtttgctgtgtgtggccttgcttttcggtaaccgccaccctgctgggtatgaccccagtctttgctcatttgcctgcttcctgcactgttacctggcagtgcccccttaggcaactcctgttttgtgtcatgcgcaatctctgacatgatagcaagcaagacgcgcagaacataggagccttctgcggctaccgtgaggtaagggccagctatcaataattctccctggcagagctcttcctgccaccaactcccctctcaaccctctcacccatgcccccatagtttcttcctttcatcctttagaacacagagttatggtcacctctctggagaagccctccttccccaccggccttcatccacccgatcagtctgctgctgtttgctcttgtctgggctgtctggccctctcttttttgattgctcctagcacttggcacagtctgtagtgacttaagtacctgcgtgcctgcggaattaaccttgtcttttctgctggcctcttagctccacacagaagggtccttgagacatcagcttgctctcactattgtacacccatcgctgaccagtgcaccaccaaggccaggagttcagaatccccttgctaaatgaatcattcagctttaagataaagcccccccccccccccgagtgccccaaccctaatgaggaaggcaggtgagaaaataaataaataaataaataaataaataaacaaacatatactctggcaagtggtgatggttgctatggagaaaagcagactggaagtgaccaggtgtctttctctgggctccttagggagggagtggggctactgacctagaggaagtaaggggctgccagggagtgtgtgtgtatatgtgtgtgtgtgtgtgtgtgtgtgtgtgtgtatgtgtgtgtatgtgtatgtatgtgtatgagggcacaactattaagagagcagaagtgagaacagagaccccacagaaggccaagtggaatgaggaaccactgtagtcagtggccacttctagaagccatttggacatggccttctgatagttacctatactcacggagcacatagtaggtgctttctagctcaaactagacccatcctatacatttcctaaaacgtgttttactacaacatcgaattatgacgtctactgagaggcattccaaagcatgtttgactttaaactccaatccactttctttcttctttagcaaaacctgtttgctgttcagcaaaacctgtaagcatcctgcctctgcctgcgagtgctgggaatgaaaggcctgtgctacttccttttggcttggaattattattattttttcttttctttttttaaaatctcatttaaaaaaaaagatttatttattatttatatgtaagtacactgtagctgtcttcagacacaccagtagagggcgttagatgtcattacggatggttgtaagccaccatgtggtttctgggatttgaactcaggaccttcggaagaacagtcagtgctcttaaccgctgagccatctctccagccccctatttttttttttttttctttttaaacagggttttatgtagcacagtgaacctgaaacctagccaaggttggcttttaactcctgaacctttctgcctttacttcctggagtgctggtgttatgatcgtcaaccaggaccacaccaggtcaaacagttctacagaggggcaaggtggtggcagaaagagaatgggaggaagagggggtgagggggagagggggagagagagatagatatggggccttttttaatatatgggtgatgacgtgacaggtaaaagtgggaggtgagccaagtggattctgggaatatggtggctgttgccttggcaacaggtgtttggtcccccctatgtgatgtcatgggtttcagaggtcctgataccaacagctggaattacaggcatgcaccacaatgcctagctagtgaccatctctttaaaaaagtttttttttttttttttcctgagacatggtttctttgtgtagctctggctgtcctagaactcactctgtaggtcaggctggcctcaaacttagatctgcttggctcttcttccagactactgggatcaaaggcatgcaccagtactacctgaccaaaagtatgaatttttgttatttaaaaattatatgtatatgtctgtgtgctgttggaccccctggagctgggattccaggtggctgagagctgtcctaacggggcaccaggagctgaatgccaactttcttcagccatagcaactactctttcttacttgccccctctccagccccaatggccatctttttttttttttttttcagtttgcagaaactttctccagtcctgacctcttctttgctccccatccatccagatgccagatagcctggaatgtgactccctatctttcccctagttctgccttcaagcccttgccctggacagtaagaccctcactacccagacaggacacgctcctcttgggctacctcttgcccaaaggcttccagcaaagcaatggggacttggaaaccaggtcttcagacgctggaatttgcacccttcccagggagcccctaatgcccgggggtgggggggaattccagcccaaacccgggctgactaggggctggccaaggcttcctgcagagctggtggcgattttgatggaagaatctccgtaggattccctggactgtgctgggggcaggaggggggaagggctggatgctaactaagcttctgtcccaacaggctcagaggggaggagggcttagcctccagcagctgtgaggaacaccaccacaccaccaagagagctgagaaccagccagaggaaaccagataccctggcgtccttggcaagcacggcttccttgggttgagctcactggcttcaggtctctttcgactgctacctttccaaggcctgacccgctccaaccctccccagtcttgggagaggaagaggcgggctagtttttcatctgtcctgatccttgtttcttttagcatcgtcgctggatgtggcagtccccagtggaatggcaagctccctcaccccaaggagtggagtcatgtttctatgggggtggaggggggtgtgcttagtggatcgcactcaagtaaggtgtagcctggtgcctggcactcggatctggtctgctggaggagtaacttactgcagcctggaagcttcggggtggggggtggggtgggtgcacaggaagtccctcagtaggggattcgaccgtccagctggagtaaggaagtcgtgtgtcacaggaagaggctcccagcagagagttttacaacagtggaagcctcacaggataagtggttgtgtttatgtctgggttactactctgtgctcggggtagcgtatgctacatagtaggtgtttaataaacaggttctgaaacaaaaggattgggagaggagaagttgaaagaaatggcttggtcactctgggatgtgacagtatagtacttccaggtggaagaggctgtggtgggtggggcttagcagagggcgtggtctgatctaatcctattgtgggtggtgtcagtttcttatctcttcacccagcccagagctacttcaggcctggggtgttgtttttttttcctcccctgggtcccctggtgtcccgttaggtccgaatacacacaggtatggaacctgtgctgggttcaggagatacccagatgattaaaatgtaggtcttccctttctgtctggtggggcagacagacagtaaacaagtggcttacacaatgggctggatagagggaggacttctttgtaggttcagttgaacaaatgagatccaagctgacgggatcggagcaggcagttttggaaggcgctatctgtggaggagtgttaggttttgaagatagttgagagaaagggcttggggtgaggggcattccaagtagaggtgtcagcccaaaaatgtgctctaagggaggcaggagaacctagtgggaaaagataagttaggggcagaaaggccacctatgggtgtttgggcctgcttatgatctgactaagactctggataactgccagctgcagcatgctagctggggctggagaaaggtctgtcttctagggaaccctttagctgcctctccactgccaagagctaagacacctccctctggtctctctgcctaggttctctcactgtttcctttagccaaccaacccactgggagcctcactctgtcaagcctccacaaagggcagaccacagagattccgaacaaacagccccccccttcctctcacacatgcccaggaaggaggggccagtccgtttgcaaaggagaaaaggcaagaggaatagtagcctgttggaacatcagactatccagagattttaaaagacccctcctcccccagacctttgccagctgacaggcgaggatgagcaaggggctccgaggtggctcagctcttgggctgctaggcatggccaacccggagagggggcttcggcagtgggcccccggagggcagtgccttccctcccccaagacccaactggtcctcctcatctgcgggacctgcagacaccaatgagtcactgtgttgacaaaccatctctgaccattcctagcccatcaaaaatggaagtccagaggaagggtatgagcagaccgatttaattagcgcgggctctaaaggtaccttaagttggccctattaaattaaactgcctagggggaaaataactgtaattatttccttttctctcctaccattgtatttcaactcccaacctccacgcttctccctttcttgacaagacaacctttaaactaggggctggcattggcatccccaaactaggtctcagtgtttctcttttctgcccttcttctgtctgagctctggtttctagcagagagcagagtccagaggggtccacggtgcttggctgtattctaatttagggaggctgttacaagtgtagaacattattccaaaaatgcacccggagtctccttcctgaaccagtgcagatccgtttgccgtggggcatttcttttaaaaaccccttttctctcttcggcagggcaaaaaaagcaaactttaatggtagggaattattgtttattttgttgaaatctagttctgagttttcctacttaaaacgtgttttccccaggacactgacctatcctttaattgtttggtgtgaggcatgttagggggaggggcgttacttgtttattggaacagcgcagttaaaaaaaaaaaaaatcaacctaggctaacagtttcaaggctcccctaaagatgtatccaaacaggcagccaatcagcgcttacacagcttttctgcttgactcttttaaagagacagtgccgacaatgttttatcacatttaaagagaaccgcgctctaaaaacagtatgaaaatggggagccatcccttatctcaccagtttttgatttggagactccaatgagaatacactgcaggtttttgggttcctcgagtggacagaaaggagtcgtgagcaaaaagcttggtcactctgccaaccccccatttcccattgtacacctgggtcattgacaatggaagcttcccctccccccacgcccgactctggtcccctactctccaatttagctccatttatttgaagtttgagatttctgcggcgcgcattccgagtcgcgaggcgtccaggtgacgtccctcatccaaacggaaccctttcccgtggaaaggcgagaggctaacttgccagggctagcaaacctcagaaatttgagagaaatcaactctctttccctctagtccaagacctcttttccctcctacagcttgcctggagcacgccaagggccattttcgcgcggctccactttggggtttcccaaagtattttaacgatctagtaaagaagcagccgcgcgctttggcgccagcttcggccgcccagctccgcgtgcagccctggccggggctcgggaggcagggctgggcacaggcagcccggggtggggcggagaggggagcagggccggccggggtcctggcccgctgagggtacgctcagcacggggaggcgggggcgctgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgttcggttgagctccaagtagaccaggcggcggcggcggcggcagcggcagcggtgctgaaggcgcagagggcggcgcaggcggagccgggcggcgggcgcgcgggccgcgagcaagcgagctgcaggcttcgggcgggcggcggcgcagctcaggccgagccggcgcgggaggagttccagggcgatggggccgcggccggggctgacgctttgacagctggaaagagcgcggagcctgcgcctgggagggagggagcgcggcgagcggagtgtgagcgagcgggcgagcgccgggagggggccgggagcagggcagctcgggagaccggacggtagcggcggcggcggcggcgggctcggcgccctcttctctgcaagccatgtttgccaaaggcaaaggctcggcggtgccctcggacgggcaggctcgggaaaagtaagcctctcgcgagtggggccgcgccgcgggtggcgggaggcaggtgggcgcgggggtcgcgccgcctggtgcccctggggcccgggtctctgccccgcggcggcggcggtggcgtggagagcccattgttgggcgccggcggaggctggggcaccctgaaggggcggcagggcagcggtgggcgagggtagttggtaggcgcggggcagagcgggcgcgggggtccgcgacgagggtgggcgaggtcccactcggagccggtgcgctcggcccgctgggcgcggggcccttactttgcccaccgagtgcgggcagggggcgcgtggctttctgcagccccgaaggctccttttgtccgcccgcggcgtgaggagtgcgtgccgggggctttgttcgcccgggagcgctctccctacccagccagcggcctccccgtcagcccggtgcgctccggggcgtccgggctgggctgggctggcggcgccggcccggccccaggcttgggggacagttgtttgagggggagatgctgagggcggcgctttgctgccctctccagagcgcgccaagtacccggactgggaccgagtccgttcggaccccaaagctgggctaaagcagggagctgaagtgggctgggaaaaggagggtggctcaggcagggctcttgtaaggggcttgcgagtttgcgagacctaggtgggtttagtcccagtgccacttggaagttcaagtttggggaccgttctccggctcccgcggcttggtgcagcttgtctgtggtacccacccactagctgttctgtctggggtgataggtactcacctcttgtcgtggccacaatgggatggcacagaccgggctcacagtcactggcagggtccagagcgagccttaatgtgatctgacctctctctctctctctctctctctctctctctctctctctctcctctcactcctcactttccaggttagctttatacgtctacgaatatttactgcacgtaggagcacagaaatctgcacagaccttcttatcagaggtgagtgggactccttctctttccctagcatccagtttcttgacaccccctcctccccactattcttagagcctttgttttcaggagcagccactgtggccaccattttgaatttttatcaccttttggcatttattgttagttggtcttcacagccttttggctggggaaggccctgcgtccccctcctttctgcccctctaagctgcctccgctccctcttttctagattcgatgggaaaaaaacatcacactgggtgaaccgcctgggttcctgcactcgtggtggtggtaagtttgtgtgatagttttgtgtgtgtgttttgttttgaggtccgggtccaagtgaacaaagacgggggtccagagcaggccctctacctttagcctctgcctcctacggacaagcacccctgggtgatctgaccaggcttggcaagggagagtgggcagaagaggctgcgtgctgcctcaagtttttgctggcatttctccgcctgtggggactgactgaattttgttatgcttttccatctcactctggggcaccaagcagggggcttagaaagagctggaagggtttttttttgtcaatcctgcatgctgctttaattagaggagtgggggcagggcgggtggaggggacaccaggtccgttctgcaactggcctgtcccttatgtttgcgtccagaaacgccaaaccttaagaggtctccactgggccttttccagggaccatgagaaaagcaagaagggccgcacttcctgtagagacactgattcagactgactggaccttccttttctccgtctccccacccccccagcatccctgcaaccacaaagccttattttactgagaaccttaaccagccagaggtggcctggcaggatgcctgtagcttgttcaggaccggctctccttatctttgaccctctctccaggcctgagcagcctgtggtcttttttgcaggcaggagggaagctcagggtcagagccttaagctagttgtcttgagtgtgtgacctggatgtcttgtggggctgataggtggactctttcacatccttttgaaaaggagaaaggaggaggggtggcttttgatacgttggtggagttgagtcaagtgtagtgtcgttgggatgttagcactacctgactgccagctcagggtactgtttcaaggctctttgaacagcgggaggatgaagtgtctgttctaacttgtgcagacaaaatgagtttttaatggcctttgccaaccacccaactgcctggtcggaggaggcgggtggtgtggcgcaaggattccacctgcgggagtgggtgataggttggctgttagaggtgagcgagcgtgttgatgggattgatggatctgagtgctgtgggtcttaaagaaacttgggcttgtgggtagacgttattttgagggtgctgggaatgagggtgtcttgaagtctttgcagtgtgggctttccaggaagcagttttggaggaggagagtagtccctgcctccatctgcagttgtgcagagacctggttgtcctgtggctcctggagtcaagtcctgtggcttttcaatccttgttccaggagtggaaggttggctgtacaggctcaggttgtggtggctgttaggggttgtggtggctgtcaggggttgttgtggctgtcaggggttgtggtctctggcttgttaggatgtttactctgcggctgtttttgggggtgggtgggtgctgaggatgggtttttgttctaggcactccttgaagggggtgctttctaatgacagtggagcttgctgtgatggggccagcggcattggaccacaagtcagattagacctcagtttcagtgttcactgtgcccttcaagctgggtttggctaggccttggttctggtatagggcgtttctaaggtcctgtgtttgtgtagcactctcatagtggagacggcacttgttctgttcttgtgactgtggagtgttggagtgatcacagagaattacagagggtcttgagtgctgtgccctgggctgcgctcaccctgcccactttctctgtactggatgggtgctgtctgaggaggcccttttgcttagtgacaggggtaaggttcttggttgtcacagctccttctttttgcctcatagacaggtggggatgcaggctaaaggattaagaacccataaggcctccttcattactggagtcacccagattgcgctgcagatgaatcatggtcgtgttctgacttttgacaatgtaacctttttacattacgctgcagccattttggtttggggtggtgagagggacagagccccgagatgggcagaatgtcatccaagtccctctgtggacaaaccaggggcgggccgtgctgacctttgtgagctctagtgactgctaaccacaaacagtgtcactgatgggagatacccagcatagaggagctgcttacatggcagctgttacagacgtctggcttgccaggagtggttgcgtccagttatcttatgtgctgagtttgtccagtgctgtaaggtaggatggagcctttgggagagctggtgctgtaccatgcgtcctgtactccctgttgtgtacacaagtaataattagtaacctgatcttactttgttttttctatttgcagtgtattttgggacctttactgtgcagctcctgaaaggagagacacttgtgaacattcaagtgaagcaaaagcctttcatgattatgtgagtaacaaatttttaatcctggcaataattacagggttggatggctctaacttctttagtatcaaaagcgagtgcacagccaactggcagtggtctttatttcctcctcgctttccttcccgctctcctgcccacctgcctctgctgcctgcctcctgagaccctccttcctgggtgttttaagttgagggacaacagtatttcatcactttgcagttacatgaaagaggcagataacctgtctgcagggggtttgaagattcagaatcatgtgtctgtctgttaagagctagctgcgagggggttggttggtgttggctgaagaaaaaagtgaccacaaccaaaaagaaagtaaaggtgaaacctgtgttttagactagaggggcagctgagcagcagtgcggagtggacttagctctgttttccagagcgcagcctttcatgtgtacatgtcacacacagtgtggggtgtatgtgtgcatacagtgtggggtgcttatgtgcacacacagtgtggggtgtatggggtcacagtgtagggtgtatatgtcacacacagtatagggtgtttatgtgtacatacagcgtggggtttatggggtcacaagtcggggggactcatacagctcttctcaggtgaggtgaagctcactcactgtgaggtgaagctcacttactgtcctttgcctgaatactctatgtttaactatatttatttatattgtgtgtgtgtgcacatttgagttgggtgtatgtgtgatgtgtagcatgagagtacaagttaaaggacaacttgggactcagttctgccttcctcctatgtgcgtcctggggctcaaagccaggttagggttaggtttggtggcaggcattgttactggctcaccaatctcaccagcctagtaggggttgaaggggacaagggtgggacacagataactgccgtagctcaggttggcctagaactcagtatgtggatcaggttgaccttgaatttttagccatcctacctcaaccacctaagtgctgagtttgtagccaccatggccagctcaaaaatttcctttgagcgtagctaaattttaccaggcagtagagctttctatcctattgctgactactcacctggatacgttgaaggtccatgaagtcattacaaggaaagtatctgtgtggcaatgctgttgtaaaattttaagtgcacactgaacctgcctgggttcgggtggccagactttatgatttgatgaaacaggaggttgggatctgtcagggaagtggtgtgaggaaagggaagtatctagatgtcttccactacttctgggttttgctttcagtaggcactgcaggtgattgtgttcagacgtctgtggctccagtgtctacagacacacagtaggtttggacttgtgtggtaggaacagtcctcccattctatatgtaggagctgatgaccagcatcaggtcccatcttcttggtcagctcctctgcatgctgagtctgaaccttgcctaggagaccgaatcccacctttgagtttcataggtggtcagtttcagtgagatgggtgttgccatggtgacaatggctgctgtaacaggagttacagtgagactgagcgtcccaggtggttagtgtgatgggatttcgttatccttggtgtagatgctcagggtggtgtcagtgcttgtgtcctctccaggcttgagaaaaagaagctgggagtggtacttctaacctggtggacttgagttgtaaaaggtcctaaaagggactgttaactgctgtccttctcgggatggggctctgggaaggtaagtggtggtggtggtgactgaggggccggacttcctgaactggagctcgccagaagctgagtgtgtggtggccaggtaaagaagtccgagaacttccttccccgcctccttactacctagtgaggtattgtcccccacctgtcaccccttttaaaataactacaaatagccaagcctaccttgctagcctctgactccattgcagatggtttcattttagagaggaaggtaggatgggagtgtctgtttcaaaatcccttgcccccgtgctaggaatcgaactcagggcccgatgagtgccaggcaagcgccctgccactgagctagctataccttctaattgcttagaccagtctctgatagacatttatgttctttcacaggaaatcacatatgctaatgattttttaaaaagttatcgtgtttatttattcatttatttacttgcttagagaaaagagtctcactgtgtatctctgactatcctggaattcactagaccaggctggcccctgcctcctgagtgctgggattaaaggcatgtactacaacactcggctatttatttgttatatgtatgcgtgccgtgtgagggaatgtacgctatgcccctaaagatgccataaggatcagagggcatacagatggttgtgcacttcctgaggtgggtgcttggaactgaactcgagtcttctacaaagcagtcagtgctcttaactgctgagctggccttcctgcctgcaggtggtgacttgtagcttggtgctctctctggccatttgtggtttggtcttgcatctagaagcaagatggcagtggtagaaatgcaagttagtttgcagcctgtgacttgctaaggaatggcagttgaaccttgcagattgctgaggttggcatggcatttagaagatgctgctaagagatgaggtcatactagctgggggcccatgattcataggtttgcagctcaaggcctttttcccttaaattgggagcaatctgatgtgtcttatgacctaagtcaggtcacaagggaaaaggaatgatgtgatcgagtggagactttcttctcccctcccctcctctctttttttttcccctcccctctcttccccttccctctcttccctcccttcccctctcctcccctctcctctcctttcttctcctctcctactcccattctttcccctctcttctcttttctctctctttttctgttctttttgagacagggtctcactatgtgggagtggctactctagaatttgttatattgaccaggctggccttgaactcagagatctgcctgcctctgcctcctgagtgctgggattaaaagtgtgctattgcaaggccctgagattttccctacactgtaaagaggggaaagagcagagagagagagagagagagagagagagagagagagagagagagcgagcgcgagcgagcgcaagcgaagaaagttgtgttgttctgtttttccttttcatttcttcatctagtttctctattcccatgtgtctcactgagttagacttcttcctgggaagattccagtgccttatatattttgtgtgtgtatgatgtgtgagtgtgggtggttgtatcacagtgtttgtggggggtttcagagggtggctttcagggaccagttctcattccctgagttctggggattgaatctattgagccatcttgctgactcccaagtaggttctcccctaagatagaatgtatttttctctgtctactctaatcctttctgtctaaggcctccttggaagattctttgtatatgggagagactggctcagtataattctcaattcttctgcttcggcttcctgtgatatgggcctcagccgtcgtgcccaggtctcaaggacacctatgattggtttctgcgtttggtgatttcaatgtctgtacatgccacctgtgcattgtgtcaacattccccaggtatctggctgtgtgctattattgcacttgctcagccaccctgccactgaccctgctagaggaagcaggcatgctgctggctctgtcctgtagatgaggaaactgaggcacagagaggttaatcacagcaggagagctagaatgtacacacagctcctggctgacacctgagtccaagcttctaacatcctggcataggcacgcgccagccatcacttgctggtgtgatcctggctaactttttagatttgccctcttggctgtagcgcactttttaccgtggcataggctgggagctgtttatctctgtagcttacttaagaccttctacatacatagtaagtacacactgatgggagaaagaagagaaatgaggggaggaacggggtgatgtgtggggagagggtaacctggaccaggacagctcataagttattgggatgttcttcagatgctaagtcctgtgggtcatcttgggcaagtggcatctttaatgtctttagtgtcagttagacatagatgctgtgaagtgttcactggccctggctgcttagccaagaagaatcaacagttctgacaatatgggaagtatctggtgtacctcttggcagggaggaggctctccagttcaaatagaaggtgtgggtctctggttcttggcaggtcatctctcctcccaggtcagggccagatgtctggatcctggaatgagccaggtgactgagcagggagggggttaaactgtccttgatttgctgggtttttatttgagtcattgtctattttccacctcacacctggcggcttgggttttcctggctcatttagaagcctgaaagccctgatgtttccacgtgtccacggaccggtagtggttttgtgtgtagggtggacttttctgagaatgggtttgttctgagtacctgaggccacaggaggagtgactgggtccctgtgtgatttctttgctgttctcctcaggcttagcagtgcctcttaagagagatgaggaaagcccataagacccactggggctccctctgggttttctcagacagagtgatctgttattgacctttgtagatggacactcctaggtgtttgtgtgtgtctccttccctgtgtagggctgtaggatgggtctgtggatagagagaagtgtttttggtgcctttgcctctggtggtcctcttcctcctgtggtagctgcttttgtattttctgtttggtagcaagaacagagaaaagtaggttatccccatagtggcccttaggtgctggagaatggcacaccttcaggcgtgcaggtgtggttaggcttcgtggctgccttcttggttgggttttattagtaaggttcactttggttgctagtctaggaggtggtagagctgaggccaaaacttgagttctacctgacagtgtttactgtgctccctgaaaagggggacatgttgcacttgagcagtctgtggccatatgtattccctgaagaaataacagaatcaaactgaatcccctgtaagaagtgcctatcacaggctgggtgagacctgacctatggaaggggagtctcttgtggtgacgtggctctttgcttttgccgtaagtgaagtgataaaagccaccgactttcctttctagaaaatttcaagtccttgtgaaggagactttgtttatgattttaggaggttcatggattattgctccaaaaaagtctagattcctaattcccatagtgaagaatttgggcaatatagtagccttgtgttcctgcgaccgtggccagattttcttgcttgtctcagtttctcagttctgaagacctgggcccctttcagtgcatgccccagctctcctccttgtggagaggtaaggttagcagaagggaaaagtgcctgagttgtgggtgtggacagcagctggggtatttgtggccgtgtggcaggggtccagtgtccttggtgggtttgaaatagcaaagtgatatttgagagggctctccttggatatgctgagctgaggttcctgctgggcagggagtgtctgtgcctgccagagccccctaggaagaggggatgagagggtggcagtgggcgctgcagctgggctttaaggagtgggaggagtgctggcctctgtgataagccaacctggctatctggccagaggtcctggcaagttcaaggcttgtctttggctctgacccttggcacccttgtgtggcagattaaaaacaacagaatatacacagttgtaccccccctccccccgcttatactttgtattgagtcccttccttgggctcccaccctgtcttctggagttcctcttgcctccagaggctgccagactcctctgttagtagttaattaaacagtaaatgaggagctgggattgcattttgccagaacccaggcaatgtggccaccgtaatgggtttcaagtggctgcaagaccccaaattgcaaatccttgccctttatttaagtcaggaggtggaacgggggagggggacgacgacagtggggacccaaacaaagtttttggcagtggtcacttcatttgaactcccagaccagcagtgtgcagcagccttttgcataatgccatctttgttagctaagcatttgcaaacttggactgagagttagctctgtgccagccaacacttggagggagctgggagacacccagttctgtgtcccttaggtcagctctgttttgtaagggaggaggactctctagtgagtgctgtgtcactggacccttgtctcccgagtgtgcatttaatccttaagaggagtcgtgtgtgggtgtgggtgtgggtaggtggtgtgtatgtgtgtttgtgtgcttgaggcttgtcaggtaagagagcagaaatgttgcactagctgtagcctttgcagtagtgtgtgagggtttagcaaaattaatctcttttagcttggtagtaattctgaccgtgacaaagtgcactaggcgcctcacataaacttctttaatatgcgttgttgggagcttacagcaaatagacaatcatggtggtttgtttttgatttgtcggggtttgggttttccacggccttgacgagatgagtcggagggatggattgttccacagtatatgcgcctttcttctcctgggctcatagcctctgggtttggatgagtttgagctctggcttagactggcccctgacttcaggtgcacggttgctgtttcctgtctagatgtcctttgggttcatctgttaccccaaatgtaggcaagggaagggtaattcctgcagggctgtgagggtgaaggtatataacacatatggataaggtgggatgtctccagccagtgcttggtgagctttttgttccggtgtttgctcagaaaactcttactgtactgtctccagggagaacaggttgacccttatggaagaatcctgtgtactggacctatctcagtaatgcccttcctgccagggctcctctgggtgtcccaggttcctttcctcccagctgtcttgtctcactccctgcactctcatgagggggcagagctggtggtccttccgtacacaactggcagtgataaagactcccctgagatgtccctgcctcttatctgtgtgggacagtgtcctggaccacgcctgcttcatcggctacagagaccaatggggagacccaggggcttgtgggtaccactggcaaggatcttgatctgaattttagtctcatgcctatgttagctttgtggttctcctcacagtaaaacatggacaaggcctgttctcctgttctccgctgtcagaagaaaggtaggaaagctgtccctggaggtgttggtgctgtgtgactgtgcatagggatgaatagattggaggtcctaggtcctgtgccgttctctgggctaaggcctcatctggttttctgcttctgcgaggagtctcagaggggccgcaagctgggaagggaggcactgaggaagctggtttggtcactttgtacttctggggtaaacccctgtgtgaccatgaaccaggagctagctacagtgtgatcagtgtttacaaagggttgtgtgcaatctcctgtcatgtcagtaggcacatcagggctgcagatggtgggactgggtgtcactagtcagaagcaagtaaaacagacaaaggaaggccagagaacaaagatatacaggctcatcatatcatctccagcgggtctcagatctgcacaggcaagcaggagccaaggcttgctggccgcatggaccacgaacacctacgttagcctgtgtgcttcagtttcttccattggtaaagaagagatgaagccacatacctctcagggttgtcatatggagtaaatgactgtgagtgcatgagtgcgcatgagattgagtgcgctcaagcgtgcgtgcgtacacacacacacacacacacacacacacacacacacacacacacacacagagtgtacacacagtaagtgcatcctcatgccaggcacattgtaagttctgcatatatgtctgctcttgatgttcctgactctggaaagtcctgctttctggcagattgtgttcagtgatggctatgggaagcagaaaggtcttagtgggggggaggggggatggattccatcgaggcttgccctttgttgccttgctcacctgttgattgctatagagtccctggggtccaggaacctgcaagagatgggggtgaaggcctcctatgcataggttccatatcagtgtgttgcttgcctggtggcagcccacatttgtacccacttcctctgctgctctaggagcctggaacatgctcttccccagcctgcctctggctttccctgtggtcctactccgtgccacagcattgggaagtcttgtgtactaagtcttttgatagccagtgctgctttagagtgtggccgcctcccaccgcctgccgggaccatccatttcttctccttcttccaggaagttggagatactctgactcatttgtcacttgaggcctagaaggagaattaatctgagtcaaggtggagtgtctttccttccttctctagacccttgagggacgaaacttcatctttgcctcctctgccaccctgatcctggggctgagtgtagcatcttgaataaacctgtggtcagtgagcaagactttgtgccctgagagaggaggaggatttgatttttgcccaggactaagtgtgttaaagacgttttaatgaagactgacaagtggcaggaagttgcagagcattgtttcgtagatggagctgtgacctgttagtggatcttgaatcaacttagtggatcatggctggcaattacaaaaaaaaaagaagcaactgttggatcacagagtaaacataagaccctctgtcagtgacttatgagtgcacacaagtgtgtgtgtgtgtgtgtgtgtgtgtgtgtgtgtgtgtgtgcgtgcgcgtgcgcgctgtcttaactgtgtagcactgtctcactgcaggtttcagcctgaagttctacaactactggcccagcgagagccattccttcaggttgggtgattgggtgattcgggtcaagtgataggcagtgactaagcctgtttccagacttgtgataaggaaaccgagccaactccagagtgctgaggggagtcgctcccatcaggtctggggtgcttgttaactcccgggtgcttggatcctttgattctgcagcttgctgttgtagtctaaggatgttaaatgcacaagcagcactctgcatgcttactgcatgctgagtaagcatgtctcccacttggagggatagggtgtgggcaggtctgggagggaggaggcagtggtctcacttctcagaggcagagtgcaaatggctgtttcttctttttttttttttaaaagaattatttatttagtttatgcgtgagtacagtgttgttgtcttcagacacatcagaagtggacatcagatcccattacagatggctgtgagccaccatgtggttgctgggaattgaactcaggacctctggaagagctgttggtgctcttaaccactgagccatctctccagccccacatacagcttcttgagcaagcctcatgagagtggcctgtggccggctacagacagctccccctgctcgtcttaggtattaggttaggggtgtccgtctctcacagagaggattggctgagcagtgtcagggttgtggctgttggaagactcagagtgcctcctatgacctaggttggtccagcctcccaacttccccatccccaccggtgactgcaggctttgtgtctccctctttgtgttttaggggaaaaactgacagttcgtttgtttcccagttctctgcttctgagtccctggagcctgagttttcctctcatcttttttctcagtcacagaaggctacttgagatgggggctctgtggtacaacggactgcagagtggttgcttggtgggcaggctgtcctgggcgttggaaacttaatgcgctgttgtgagcagtgcatgggcttggacatgacctgggggactcatgtgcgacttctgagctgcgtgctcttcagtaggaggctgacagggagggaagtcagggcaggcttttctttatccctagctttttgagttactgtaatggcctactcctctcctcttttgtatatattttttgggacaaggtcttgaggctggcattacacttactatgtagcagaggctggccttggactcgtttttgctcaggttagtaccccaagtcccacctctgctggcttagggggtctctttgagaattctgtttcacatttgaatcaaccgtcagaggatggaatactgtttaagaaggaactgctgatttttcagaaggggaaactgaggctcagagccgggcagtaaccctgctgttttgtgactacccagtcccagatgcctgtggtagtggacactggctctagacacggtacctacaagactggctggtgtgccatccttcaggaatctggcagctttcttcctgtaatgcctgtggctttggctacccagcctgtgctgagggggcagatgcccagtgggcaggcctggtgtcaggcgtgtgcgggtggctggtcttttctcactgtcttttagaaggcgtccagtagaaaatgttatcctctctctggaggccttctttttggcagtgccgcctgccagctcccgctctgcttgcctgcctgcctgccgcttgggttacgtgaggtggtgctggccggctctgggcacaggttctgctgagggtctgcaagccatgagctgctttgaaagggatttttacaacataacagggaatttcagccaccatgttatctccgaattggccaattgatggcttcagcagagcgtttcggcaactgagaagccaatacaatttgagttagttgtgatggctgccactttaaataccacggtgaatttctgtcagtgagctaatgtgtggaatagggaattgcagaaaacttgatcaccagtgtgctcaggtcgattctgaccccaagctacagaaaatgaacttaaatctagttgactgtcgccacatactttctttggcattattttgctggcagcatgttcgtcaaagggaactaggtggaaatcacagtgtttgcctctggcacccctgattttagagagaggcagtcctctgtgggggctgaagccctaggcaggccagatggcggttttgtggtgagggacaaattactaaatgatggcattatggcttgctaataatcccctgtttaatgaaggatgtgagtgtttactgagcacttgctatggttacggaccatatggtggtggtggtggcggtggcggtggtggtggtggtggtggtggtggtggtgtttttcagtatcaggtagtccttgttggcctgtaacttactatgtagactgggctggccttgaactcaagagtttagtctgcctgtgcctcttcatgcaccaccacacccagcttaaaaagtattcgcattccattcccttctgagaatgtaggacattggttcttattttatgaacagagagctaataatagcaagcaattattgagtgctaactgtatgccttatactattttcaggtaggtttgtctcctgtctttcagtgatcctgtgggtggattattttgtttttgttcttattttgtacgtgaggaaatggaagtatttggagtgactcagtaatgtcaaaaatagcctcaaacttaagttctctctctctgtctctctgtctctctgagagagtttcatgtatccttggttggtcttgaccttggcagtgtatttgaaggtgaccttgaactgatcctcctgcctgcacctcctgagtactagggttcctggcatgctctgtgcctggattctgaagtgtagaggatcaaacctagggctttgtgcaggagaggcaaacactccatcgatggaaccattaccggttccgagtttctgtttttcctaatgcactctctgttaaccgtaaaatgctgccttcctaagatttagtacaagtgtgtctgatggcatactcctatgctcctagcattcttggtgctcagataggtagatttcagtatgagactggttggcctaatagtaagttctaggccatcctggctacaaagtgagaccctatctcaaaggaccaaaacaactcccacaagcaagcaaacaaacaaccaactaatcccccccccccaccggcccccctacccccaacaacaaaaccctacccaaaccacactgggcttagggatagtcctgagagccttggacaggcccaggtccttcctgagggcctaggtttcctgactaggtttgggactccctgtgggaagagggactggctggtttttaatagcctcatctaagaagaaaatgcctgactcacttgcaggaagggttttcttaatgtttcagttgagcctagccattaatggctgaagcatctctctagcccacagaagatcctgtctcgccctgcagggcccccttccttgttccttgccgcttgtggactacatgcttgaacatattttattcatgaggacattgctcatatcaagtcatcattaattaattgttaatgtggtgtcagggcttgaactcagggccttgaataaactaagcaagttctatgactgttctcaacccagaggcactattaatttgacttgtcttagttttttgagacagaatctttctatgtagcccaggatggcctgcttgcacatcctggagtacaggcgtgtacctcccacttatagctacagtcaccattggttttaatgaagcagtatgaaataaaatgtagacgctggttgggccttctttgtaggtccagggagccagccagtttgagtacataggtgagcacggttgtagtgagcagaaaacactcccagtaaaaggcagacctgagtcttgttgagcttagatgagtagagacacctcaagcgttcccagtgagtgtcctggaggcctgttggaatcattaggctgaggaccttgcctctgctatgttccccactgaccaacagtgttggcggcactgtcaacttagtcctgactcgggcaagtcagaatgcagaattgtctctgacaggatcacctgactgatcctctgagccaagagagctccgggtgctgaatgaaggccatgcaggcattgtgcgggggctggctgtgtgcacacggagagctagagggaccatgctccttgtagatccgagctgtttcctcccagagcaactggcttgagacagcagagtccccagagctgctttcctagcagacccttctccatagaggttgtcagtgggtcgtagtcttcttcctggctgtggtttccagagctgaggctagtgagggatatagggcagtctctgaaataatggcgaccggtgtttactgaactgacacttaaacaggactagtttgtgtgtttgtgtgtgtttgtgtgtttgtgtgtttgtgtgtgtggggggtaatatttaattcccttaacactctccacggtggggctgttgtgatcccatttcttggatgagggaaatcaaggttcaaagaagagaagcccatggctatggtcttactgagtgaaggagtcaggacttgctctcagggctccagcctttgagccactgctgtattgacaagctacgggatggcttgggagatgagtcccttggggagaaccattcttggaaaaaactgggacatttcattacacaaacgtgtaaatgagtgtcttgaaaaaatgtcagtgacagtttgtatcccagtgagatgaatgcagagaaacctattttgactgttagcttattttgttgcttaaaagccagtgacacgtagcattggatttattttgcttcatgatgttaagtgtttgccactttttgaatgacgcgtgtgaatttggaaattgtcttttttggaagtggaggctgcttcgtgcacttagggttggcctttctttgaagaggcttgagttaggttggttggatgcaggtgtagctggcccggggctgagaagcagcgtaggtacctgtgcctgaagacagagccaggacttgtcactctgaagttggggtcatgatggagagcccatcgcaggagtctttgtgatggaaagcctaaatatttattctgttctgtccctaatgaaaacaaattgtcaacagttgttcagtaactgactaaattaaaatctgtaattagtcaattagattaaggagttggcacaacctgattgtatcatgctgcttaggttattaagagaaagggtgtgatttttaattactgaatgctaattttgacagtttcaaatagaaacagacgtggtttcccccctttccctaattctcaatggtttggaaagtgaaggcactcaatgtttaaattatgtttttttgaaggcaaataatccaaggtggccttctgtagggtggcagggatttgggtggagagcccatgttggatctcttcaagggttgcttggaaatccatcctttcttgaaggagctttctgctgtgagagtctgggtcttagttggaagtgattggtctgtaagttcccttttggggtttctccagtattgtacttgtgcacacatcggggagggagcagtttttcattcattcctctctccacagggtcttactgtataacagtctggcctcaactcagacttgatatgtagatcaggctgtcatcaaacccactgagatttgcctttctctgcctcaagggctgggactaaaggtgttgtgccccagtgcctgaccagctctctcaggttttagaagaagatttatttttattttatgtgtaatgtattttatgtataaatgattgacctgtatacatgtccatgtacctaccatgtgcatgcctggtgtccaggaaggccaagagagaatgtcagcttctctggaactggagttacaaacagttgggagcctccatgtttgtgctgggaattcagtctggatcctctggaagagcagccattgctcttgacctctgagcaatctctttagcctggagctctcttatttttgagacaggttcttgctaagtagcctaggctttcatcaaatgcacgattctcctgtcatagcccccaagttctgggatgcaagatgtgcacacaaccatactgtgctgtttggagggtttttctgtcctatagtttaacagacggagtcagcagggaagctacgtgagcgaattactcgggagaggggcatggtggagatgtcagtttgtacttacaagggtgaaggtttgtatagtgttcctgtctgctggtactgagtgttaaacgactctctgcttttctctttgggaagttctgggtggaacatgagttttgctttttggctttgggagttgagagctgaggagttgaggtgccaggtattggggcccaggatgaggtagggcaggggctatcacagcaggaaggaacagcctcttgcttgggaggaaggtggatcagtaagcaggtgcagattatgggattagaatctagaaaatcaagccagagaatatagggagaatgtagtaggttgacttgcaaatggagtgagactctgttctcagtgttgggggttgctgagccagtccctaagctataaggcgatctgagctcctggaccctagcaaacctccctgtccccctggctctgctcctgtggattcacgattgggggctgagctcctgtggagtacttcaagccttcaaagagagggtcaagtgggatggcacctcacttatgctgctgccttaaggtctggtgggagtggggggctgagacctgtgtcatcctgcagcttgttggttttgtttttgtttttgtttttcgagacagggtttctctgaatagtcctgtctgtcctggaactcactctgtagactaggctgatcttgaactcagaaatctggctgcctctgcctcccaagggctgggattgaaggtgtgtgccaccactacttggtgggccttttggtcttgaaggctctattggcctcctgtgcctctggtaccatactgatacaaaccacaccaagggccagagtcacagactctgcttggagtggttttcttgtggccatgtcttcattatacttttatttattagtgtgtgtggaagtcagagcgcacgtttgggaaataggttctctccatccacattcacttttcctgcaggtcgtacttagggctccaggtgtacggagctggcacctttacccgctgagccattttgccagctgtcacgatgtgctttgaagtgccagtcagaacactcctcggcttttaggagttcacgtttacagttcttggtgatctagaaggtattcgtggctgatggacaaggggtgcttgggaactaaggtgggagcagaggaggcttctgaagggacacagcctggttccgtccccaccagggtctctgctcactgttagccctggtttctagtcctcatctctaacgtggggtcagtgtttgcagtggctacttgggagaaggagtgagagaaccagagatgggccgggcctatttctagagtcagactaagagctgagggaggcatcgttcctaggaagagttcctttctgctgggtagagctgttgtagagcagttaggagcgggagtgagaggagtgtgttctgaacttggggttcctctttcaagcccaggcttcacaggtgaggttaaacctccataataggcggtttgtgtgtgtgtgtgtgcgcgcgttgggagggggtggccagaagaagagaggaagtgacagtgttggggtgacagtgttggggacagttgactttaaaagcctcatgttgggtggatttgtggccctgtgtaaacagctaagctgggaccctggatgccttttctcctcaagtctgtgtttggtagggagagtggggccagccacaggagccaagtcccttcaggtgatgagaagcagctgtatgtccctagaacatctgtgtagtgtacttaaggggtgaggatctcacgttgcctccatggtgcctggaaggatgggacagcctgtgggccagggctctggttggtcagttacatggatggttaagcaaggtttctgcactgggatgacttcctccttccttcctggctggagttggctcttttctttcattcaggagacaagggctcccctgttcttgcccaacctgctctggagacacgaacaggcagctgagcagtggccaggggagagctaggaggagctgcactggaggtctgtgggaacggctcaggaagcagcactcgctctggaagataccgtggaaacaaagggagacagcaggctgaggggcagtgcatttacctgttggaaaaataaaattgaggagcagagatgtttgtttgtgttgttggctggatggacttgaactctggagacttagaactgccaggctgtaggtatgccaggctgtaggtaagcataaggcaggccagcccctcaccttacaacctttgcacatgctgtccagcttggatcgctttctttcattatttctctgtctggaggagtgtgattttctttacatgtctcagtttagatgtcactaaatttacagaacttattaaaatcccctctgagttgctggggacagagactgctggtagatttagtagtgtccctgaaaactggatctgacggacagtggatacccaactcacttttgctgaggctgcctgccttccaggtgcagccatgtgtagtctgtgttgtatttgtaggcttcctgaggtcctgtagctttcagagacagtccaggtttgtcacaacctctgagccctcgccgtggtgtttgcctttcttctctgaagtaggcctttgacatatcgacagaactttacgcgtgaagtgccctcagagctgtgtagtaaaaggctcattcttcacttgacccagctatctcctgagccggctgcatggcagcccctgcccagcttttgcttgttttaggtggactgtggagtggttgggacaagggtgtggtctgaaatccagcacacttctcccttggcctgagccttagtgggagctaacctggcataacggaaggtgctttggttctgatcatccaacgtccccaaaggtctgtgtggaaatactgtattatttggctctgtaagtcagggttgtgggtgatttttatcaggcctttgagtctacagttgacctttgctttatctgtaaagactcctgtttgcttagtcaaggataagccagaagattccagagtggttggccccaacctgggccctgggtcttcgcatgcagctgggtgcttctaattgtaactatcttatctgtttttctgggagggggtttagccacaccctgtcatagaaagaagcttatttctgagcttccattcaggccttttcatccttgaaataaatgttctttaaacaaccacttcttattaaaaccgtctcagttaagaattttttatccagagtcacacctgcgggccatcccagatgtctgtgtcctttgtgtatttagtttgtctagtctttcattcttcaagtacctgacacctccctgtatgaccacacactggagagatgttgctgtgttctttgccgtcacgcggcttctagaccctccttccagtgctcagggcttatgtgccatccctctgggtcatttgggcgtgtctcccagacaagcacaggattgatcccttcctgctttcctgacggctgcacatcctaggagagcatttctccctctgcctgtcctgacacccagctgtgttgtgggtcagcactgtgatggggggctagttgctctctgactcctgagtgctcacctcttccttggtaatggagcagtccatgagtccttgtggttccagtccaggtgtgagctgagctgagctgagctgatgagcggttggagagcccagagaaagtgggggctgctctcagacccatgtggggtgtggttagaacagcagtgctgtgttattctagaactgatgaaaacaacaaaacccacaaaaaaccaaaaaactcaaaaccggcttgtggaaactgatatcccagagaggctaagttgaaaggatgcaggaggccctaaagggctcatcacattctctcacactttagataaacgttttttaggttttactaaaaaacacaaagtcttctgtgccctgtcagttccccattcaggctgagcatcgttatcaggccctgggagccgcccgcctctgaggcacaggtgcaccccctttcctgtgagtcagcaagctgtcctggaatatccctccccgtgagtgaggtgggcaggtgggtggcactgggccaccgctccccaggaagctggtgggccatccagtgctgccctgaacacttgagatgcacagatggctccttccccttctgaatgttctttgaaagtgttttcaatgcagagcatgtgtcttcgtggcactcttctcgtgcggacagaagctgtcaccgcatgccttggagagaggctggttgggatccagggcccactgtggcctgagcctcagtgtctggtggaccctgtccaggtggcatcaagactcaagcattgcaggctggggtgaagaggagtcctgtggaggggaggaacaatctaggtgtggctctgtcagcaccacagacatcatccttcccttctgaaaccaacctatctgctgctcgaggggaggggctcttctgatctgaagtggaccctgtgggagtggaggagggtagaggcaacccccctctgaccagagaatcccctcctgggttttcaggctctttgtgctagtgagcccctccccttcgagcttccactgtcccctctgtggcaccaagagtgctgctttcttattcctcctgtgaggagagctagtgtgtggcactcactaagtctcttgtgttaacacagcttgggagggtcgctggcccagtcagtatctgggctgtgctgtgtgtgacacagcggaggggctcaggtattggggtgaatgaggcagggtttttacataggtgggtggaaaacaggagggggtgtggccttctgtaggggtctctgggcttctatttctcttgcttgtgaggacagcctgtctccctttccgcattgtcttgggtgctgatgccagatttttgttaatgcaggatgtgatgtcttgcctttattaagtaaaaaccaaaccagaaccaagaccaaaaacttgagagctaccacgaagacatccatggaggtcttttgccctagatctagccagactggctgtgctcacccacactcagattttgtggcaaaggcccattgggaactgttgtatctttatcacagccttgtgctgaagcaggcagcaggtttcagggcagaaagacaaaacagtgggcaggttagagttcagagnnnnnnnnnnnnnnnnnnnnacctctctctgtgcagcaactaacaggtctgtcactgactgactctgaggggtttcctttcaaataaataattctttgtctctcttctgggtggcagattgggcctagagaggcagctatcaaagacagctgtctgatcaagcaaaaaaggtctaagagatagtttctggcctagactgggagggccagtgggacgcatggagccacctctgaccatgtgtggggtgttttcttgtccagggatgtgctagtgaagtgctaggctgagggacgagtgtgtgaggagttccttcctcaggagagaaagcaggctcctttcctgtccctttgtctcttgtcccctttgtcccagccttccagctctgtggcctgtctcccctcccccagcggttcctccctttgtgcccagcaggccactcaccagtgaaacttagctgaggcctgactccagagaagcagcgaggccgctttcagcacgatgggcttgaagtgagccctgttttctccctaagcctccagaaggtggtaaaggtcggctctgaccagtgcagctccttcagagggagcagcatggttgggggttgtgccagccccactcctggagctggcttcccaacccttccttgcttacagcgtggcttggtctttagaggggttctggggcctttccggtcctgaggcctttgtgaaacaccacagagtatggacatgctgaactcttgtaaaagagtctagcttacatctgtcacatgaagggttttttttttttttaacctttatgttcgtggtattttgcctgcatgtatgtgtgagggtgtcagatcttgtagttacagatagttgtgagctgccatgtgagtgctgggatttgaacttgggttctttggaagagcagtcagtgctcccaattgctgagatatctttccagcccctatttttaaaaatttaagacaggctttcaagggctagcttgaaactcactatgcaatagagaaggacttgaacttctgatcctcctgcctctacctcccaagtgctgggattacagcccccacccccacccccaatgccagtttgtatactgtaggcagtggaacccagggctccagcatgctgatgctggtatgcatgggcacttggaccacatcgccccaagatagtgccttagtcataagcaagggccaatcacacccacagaagtaaaaaccttcaaggaggaaaacagaggtttgggaaaatgtatcagagtgaagttgctgaaaacataggggagttggccttggctccggtgcctcatttctaaagatggagggaccttagcttctgggtgtcccatgacctggcccagtgttgccctgacagcctgggcctgcgaaggaccacaggggtagagcagggctgtgcagcggccagacaggcacaaccatgccagttagtttagcttccctgtcgtctgcttaccatgcttaatctatgaattcagttgtacattttcaggtaataaacaagagggggtgatacacatgtttagagacactgtaatccaccctcatgtgttctatcagttcctacacacactgtcagaagccactcttcttcaccatcagcgccctgcctggcttgttggggctttcttttcacttttacgtgtgatttagtctctagaaattgtctgcagccgtagaggcccgttactaacaggaaagctggctttgtaacaggtgtccatgactgctacctccgtcccttatcccttgttctgatgttggggaatgggcagcaatgagtggcggctccttgctttctgagtgaccttgataattctctgagcattgacgtcttcagccattagaagcaagcggcaggcagggctgagcagggcctcggggctaggtatgaagaattcagcatggtgctctgcatccttaaaagtgccccctgcatgtacccttgcagaccgggcttggcagcaccgctgcccttctggtgtgcagaattacggtgtgggcttgtcacgccaggggaaagccaggaggacgatagtgggtcctgtttgggttttcccagagaaaggcctgtgctctcagtaggcaagtatcagtaatgggttgaggtgaggcccttggcctcgggccatttattgattgcttgcctgtgacctctctgctggccatccctcccagagtactttttaaaatgcccttggtttggggacctgcacccaggagacaagagaagatttactaatctgtggaaaggactcaggcaacattgaggctttgtcttttgacagttttatttcagagctagcacatacattgctaggttgtcatggtcatcaagtgttggctgcagggtgacaggttctcacactccagtccttggttgtggtagactatggttgaggtgtgtgtcagtgcctaggtttgtgggacaatttgcattgcccttttaaataagtgctgctttgaatacccacctttgatatgcccgtagtgagggagctaggattcccaatttagatgtttgacataacccgaaagtgaaagggttaaaagtgtatctcaggagactagcagagcccagtgtttttacctggctgagacttccatgtggtttgcaggaatcccaggctgagcagatacctatcatgtggccctcagctactgaggcgccagactgtgagctgaggtggttctgggtgctggagctcacagtccactgccttgccttcccattgctgtctgctcatcgtgatctcctagtcttctctactgctgaccagtgtgggggtcctagagtgggcgagggaaaccaggatcaggagctgaggaaggggctgcggtgcagggcagatttctttttgcagggctgctgtgtctgggtgggggtggggagaggagggatgtagagggtccaggagagcaggtgggaggagggtctatttgcattattgggggtggagcttggttggcaggagggttctttcattccctgtcccctttctgcccctccttcctactgtcttctgtctaccactctgcctgcttccctccctctcaccctccttccctccctctgactcccccctccccctctctccctccttccctccctctgtttcttccctccccctccttcccttccctcttggccttgctttgcctccctgcagtcccctgcatgctgcttggctctttgccactggtactgcctgttgtactagagtgcagaggccagagcttttcttgcagagctggtacagttttgtgtgcaaccgtctcttctgtctggaaactggaggctccgggagagagactggcagatgctcactcctgagatgattttctggagcttgtctccagcttaacacttccttcaaagcttctagccacgggtagctgctggaagtgaagtgaccaaggcagtatgagttcatctcagaatgagagtgtggcagagggggccagtggactggcatgggcaagaacagatcttaaatagcgccgaccagttggcctgccgtatgtcttctgggtagctgtgtgtgctgcactccaggcaggagacagctcccccaaagggttctcttcttcttctgggctgttttgggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctccctccctccctctttctttctttctttctttctttctttctttctttctttctttctttctttctttctttctttctttctttctttctttctgtttttcgagacagggtttctctgtgtagccctggctgtcctgggctttgtagaccaggctggactcgaactcagaaatctgcctgcctctgcctcccaagtgctgggactaaaggcttgtgccaccacgcccggccaggatggctttcatccttcctgtccctagtgtgtctgacctcctgcatacctgagttacttttgtgcttaggctgttgtcttctcacaaaatgacagaataaaggaagtgttttaaagtcagcctgtgcattattgaccagtttgcaccctgattcctgaagctggatggagtggggttgacacttcagacttttcatcccccttaagtttttagcacacgagggcaggtgagtgtggctctactttgtgccgccctgtccctgggtgtggaagaagggggcagggcaagtgtggtgcaggctttcttccttggctcaccgctggaactgcacgattggcggtggtatcactgcacagtgagtgctgtcagtagtctcagaaaccaggcaggagacaagcaccttttgtgctttgctaaagagaataataaagatgggccttcccatgtagtggcgcctagccacatctcagagctggtgctccctgcgagtggccatgagcctcagtcctcttgtgtagctggctgctctgttccctatcctggactcggtcctgatccaccaggcctcccagcattttgccagtgtaggttgcctcctgaggagctcctccgtccacggctcttggtgcctctgtcagctttgcagattaactcactgtgcaccaacactgcgggcagctttggagcagggttgtcaggctgtgccctcagcttcagacatctttttgtgtatgtgtgtgtgtgtgtgtgggggggggggtgttgctgagctggacattgagagactttcatggttttccacagtcctctgctgagtcctcatagcctgccctcacctcaccctccagaggctagattcgttggacccccctttcaggctgagccctctaactagaatcatgaaagatggttcctttctctgcaaacaaggaaactgagtcctgagcagggaagaggttagcttgactgacagaaaagggccccagaggctgttcagaatttcccccctagcctcagcagcatactggtgaggtctcaccttgctcccaaggctgttgccattagcaacctacttcccctgttggttctgggggcccttgaggggaagaggaggtggtggttgagtgcaggctggtgacactgggaaggaggaccaaggcacatggagctctctgtaaataaagcctgttggtttctagtaattgttcccagtcccagggagatagatcatagacagggacattgtactatatgtgcctgtatccagactccctgaaactcagaggacagaaatggaaggaaaacaaagggaaaaaggccagctaggcagcgtgtatgcgggagacagtccaacttgactttgtgtagttctttatttggtgagtcagtttacctatttctaaaggggtggtgatagaagaggtgctcagaggtccgatccccttgaggcctcagtcatgtggttactgttagtcaggtcctgttccagtgtagcaggacatggagctgaagaatgaagagaggattgtgctgagcattgtctgcaggtagtaatggtggatgatggtcagcactggagggaacacaggcagaaggtgaaagtggtcagccttgagagcggggtgtcttcctggttgggtgtggccagtgttgtagctgctcccagtgaaggattgggaccgagcagggagaacattggtgaagccgggagctttgctagctgttggcctttagaggctccctgcggccctgtacctttgaagcggtgaattcatgataactaagctgcgaagcgtttggtatcatagagaagtgaagtcatactggctctcatcgcccagtggaccagtgctggttgttgggggtagagttgatgacctcccttttgcctcaggtttcttacctgtgacctgaatgcacgaactgcacatgcccatgtctgtgaaacccagtgccgaccttgagtgtatgagtgctttgggttgtggggttcacacttctttttaccaggtagtgattatatgtagaaaggtgttggtgcttttaaggcagctacttccttgcctgcgttctgccttaattttggaagccgggagcttttcagacttagatcagtgtgggcagattgccaccagcacacaagtgtgtgcccagcaccaggaagcagggcttgttttcattgttgagtcttatctttcagtatgaatacttactattgaaggtcccctcttcagcccttgccttagaattggaaacaacttaaagggggagaaatgcatttggagttagtggttggcaggcaagataaaccaccacatggggcttgccacaaaacagggaaaccagaagctgccccacaggtaaaaattagggcctaaaatagccccaggctagccagagccttctgagagccttctgagcacgggaggtgagggatgagatgaggactgagttggtggcgtctgtattcgctgctgctgctgctgctgcttctgctattctccttgatgcgcgactgaacagagccttgcagtttggagaatataaatggtggactgatgaggtgatagagaagatcgcctgcagaccctttgccagctggcatgtcccctgtgagtggcatccctggcagcagtgacatcaaccttctctctgtccccccaatgcctggaacaagtggtcggccatatcatgtcacttaggaagcctgtttggcagtatttgagagttcaggtgtcagggctgtgttgtgtatgacattgtgctgagaaagatcagaaagaactactgaagacatgagatatgcactgttctccctaatgacgggacaggaaacccaagctctcgtcttgttccgcgtcatgggatctgagggccgctcaaccccacacttggctaattcttggtgatctggaagcctctcttggcttgtgtcatgcctcagggccactttttgtggagaaggactataatccttagatataataacccgctgcaccgggcactttatacaatggtctcctgtatacaagctcattggcactaccctccagcagtccccaggcaatgatagacaaggcttattaccttgttttgttgatgaaaaggcaaatggctttagtgactttccaaagtcacatgtccgtgtacatttatggtgaagctcagagtaaaatccaatttcaaggctagtcaaggtgtgcagatggtaaatgcttggcacactctggagcaccccctggctggagtcagatgctgcaagctgatctcagtaattcttttcctgccaaccttgggttcagaaatttttagtatttcattcagtcattatcattcaaacaacaactcttttctacatgggtccattgtcatggatgtcccatgctgggctagaagttggctaggggtgtgtacccccttttccacttgttcggatttctaggtgagagaaagttggctgttgcttagagtggaatctagttggaagacctgtacctgcctggcagagacagtcttaccaacttccaggaaggccccggagactcttagaaggctgcacggtgtttgaggaaaggaaggctgtttgatgtggagtgccagatggtggtccagaagggcacgggagggggcggggtggggtggggtgggggaagggcaggagcagcaagacatgcttgaaccatgctagtcaacagaagtgagcatgatacatcctcctgacaccctgagctccactttgcatacaggcttcccttgggatgtcccaagagtggctctttatactatatatgacccttaggatgcggggctctcaagaagggtgggatgaagaagttggtaaatgttgttgttctggggaatcccacctgcttctgagaacgtggtccagttcagtgcatctccatgcatcaggtttgatgctgtcattgaagttggacctcgagttgcacgcctgtccctttgtcctcatctttcctccgtgcagacgcaggggcatctgctgtgctcccctaactcatgcctcttcttttgtgtcatataacttttcaaaaatcagctagtttcttgctgtcagcctactcgttagttttcttgaccttggatttcaaggtgcttttcatctgttcacctggctgcctgtccctctcattcataaagtcatggtcatctgacttcgtgcttataggacgtcctctctagtcattcctgcattgacccaaggagctgctggcagaagttcagctgccctgaatttgagaagaactgttgtacttgaaatacagatgtaaggacagtccactgtaacagcaaggaaggaccctatatggtgtgggcttcagtcactgctctttcctttgtagcagagccttttctttaaacctagtcttacagggaagcccaaataataaaataaaatggactgctgtgagttagggcaatcagggactcctgccagcaagccgctcttcttcacgagtcctcttgtgcacctgtttctgggagggttcacctttgagggagcactgtttaagattcctctgattgggccggggctgtgactcagcactagggcacttgcctagcatgtgcaaagctgggtccagctgtaaaaaatagcaacaaagaaaagatattcttgattcagtcaaattcccagtgtggggatcctggctaaggaggcagtggcttatatgacccaggccttctcttcatactggggtgctttttgaacccatttcaggagtgtatccagagctctgagaaatggaagtttctgttcattgggatgtgctgcagagcccattcgagggctgggatcaggcatgtttggacaatcagcaagggtctctagcttgctagactgcaggctttcatgtttgagcactcctaaaacttccagaatgttccaccatcatcgttcttttgaccttctgacttgcttctctgggcatctggcggtgtcaaggactcctaagtgctcctatgtcagtcagtgtttcccatattttagtgatcattggtaccctgctggttgcaccacacacaacacagttcaccattctgtaactgttgttttctggtcttccaattgagctgctgggtagtttgattgtctgcaagtttcttatgttgcaagtagcatgtaggcatggtggtactcttagatgtggcactgttgggtcttgtacttagaaatgcgagtctgagctagttgaacaagtcagagctagttgagctctttgagaggactagagttcagttctcagcactctttgggcaattcaaaagtgcttggaactctagctcctggggatctagctcttttggctgcacacacagacagacatgcacagtgcatacccgtcagatcatccttaccattgttcctgatagagcaggaagggacaggacaagctgtagaggcagctttgccccagataaaaatcagtcatggaaaaccagaagagaggcctgctgctgtttgctgtgcaccttctctgactggtctggctccagagagctgggcattgccccgtgtcccttctgtactcactccagtagcaggccctgtggggacttactacatattaattgattagctatagatgctttccttgtgtacatgttttgtagctgagatttgtttatttgaatgtattttgtgttgatgaagccttgtgagatggcacagattggactgtagaaacaattgggcatcagggacttggcccacaaagaggtctctagctccactaccactgcctgggtatggctgacctcttttatgactggtgtctcagatggaggtgtaggggaagggtggttaagagccagaggggctgcaagatttggtctcttttcttctgcctgtgttgatgattttggaggagggctgactttgggtatacatagtgtttatcatctgaaactgagttgattgggttgcagaggaggacagaccattgccagcctctcagaaccttccatgctgtttgacaggacccctaggaaagcctgtagggtgtaaatggtgtcgtggagcccctttgggcacagagttgaggtgttagaatagtatcatgataagtgaacattgtctttctgcttcaagggaggggatgcacctgagactgggagcaggtctgtcccgatacaaagctgcttcttaccaaggtcatgatgtcatggcccagggtgtggaacaaatgaaggctttggagagagttgccatgatccttccctgtgttgcaaagtggtttgggcagtgatgacataatacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctggaggaagcgtcttccaaggaggggtggagaccctcatagcctacacacagcattctgagtgctctgtaaacaagcacattttagctcacaccagtggctttgaggttggagttgggattattgtcccaggtgagggaacaagcagagtggccaggtaatgtgcccacagtcatacagctgtgatgtgtcccaggcagggtttgaatacagacaggcactccagcctatcagatctcatggaagactgggtgggaggagttacaggaatccctgggcaaggagaaggctagaggtgtctgaggtctgagagatgctaaggtgtccaccttcctgctctcccatgggcagctcataagccatcgtcctgtcgttcagttccccactgggtgctttgcactgcagcccgaaatggtacccttactggtatcttggttactgctttcttgaggttgatctaagaaaccggaccccctggtgcatctccttaggaaacacacactgacaaacccatggatggcatgactgagcatgccttcacatctgcactctggtacctgggccgcccgggccttttgacatggtgtgtgatgtccttacttcattgtgtggcacaatggagcctctgtcgatgtgccaactaattaattttaactttgcaatgttgcctcatctccatacattgtttctgttgcccgctgtcttccttgtgagtgtgcgaggaagctctttggtgtcatttattgctggaatgtagcaaacatccatccctcttgcatatcctcagtctgattttctaacactgtttccagggaagtgttgggtgctgcttttgggagaggtcttagttactggaggctttaaatttagcacaaaccccaccagtttggactcctgaagggtaggttgtgtgagacctgaaaagatgatgtggccagccactggtaaaggcacgctgcttagtcttgtgttgcccggctcacctttattgctgagaaggaagtgacatgcccgggcagggaggggtgggacttgtaaggaacaggaatgttttctgtgtgcagaaagggtattggtaaaagtcaattagcctgtgtttttttaaatattattttgggtagaacatcatagcttccctctgctttccccattttccacattttttgatgtgagccttgggctaagcattatgcatgtgggatttattgtctgtttctatgtcttcttggtgggcttttgttttgagaacaccaccccttattttatttaatagcatatgggatttgaaggtagctgggacctctgctttgggcctcagtttttccatctgtgaagtggaggtgctgaactctagcagtccttattctttgaaatgcctcagtttgcaaaaggcctttgtaatagtgtgctctactgtagagtgtgggtcatgagattgttaccatgggcagtgtagtcttgtagttcagccctctcactgaaacagaaccagccgcagatgatgcagacacaaatgcgtgtgtctgtcctgggtcaggcttacttacaagtgctgccttcagcctgtgggccttagtttgcaatctctagctctagagtatccttacgctctttggctgctgcagaaaaatgttggtttttcacactgctgcgggctgtgcacatggttagcctgtgtggcagaattcctattggaaatagggcagcacctgaaccgtgaactctcccgaggccccaccttgtcatgagcgtgcaccacacccgtgcatttcttccagcagctggaaggtgtcttgtccagcactccccagggagcaggtgtgctcctccagtgcaagtcacccagctcctggaatgctgtcacatttgggaaatcccatttggagtctgggtaagacactccctgcagttgggagtggatctccctgcagtgcacgtctaagtgggagaagggaggcaggccatggtgacttcagggattttgtctcctctttgtactctgttaagtaactgtggcccagaggatggtttcagggctaacagtgttgcattcctgtgtcatctcatatgacagacacccctcttcttgatgtttatgatgatgtttggttgagggccagaaaagtcaggcattcgagggacagggaggagctaaaggagaaaagaaagaccagtgtggctaccctctttttgtttttgtttttgtatttttctttttcttaaatttattttcatttcatgtgcattggtgttttgcctgcatgtatgtctgtgtgagggtgttggagcctctggaatgtgaatcatagacagttgtgagctgctgtgtgggtgctgagatctaaacccaggtcctctggaagagcagccagtgctctcaactgctgagcgtctctcccgcccctccttcccttttttgtgacttcgcccactgtggcatcggatggttcatttggtgccgctcctctcatttctttgaactgggctgctttctgccaggtggagacatgttggttgttcacaggctgcaggctgtgtggttttctcctcctcagctgctggcaggcgagggaaagctttttcctgttctcagattggtaagtaaggcactttgcaattctagatagaaagtgtccatgctgttcatgcagactgacatgtgcctcatagataatgcttgacctggagtgggccttgaaggtctggtacctcctttcccagactcagtgaagactaaaggtggtgaggattacagccctctctgtccagggcatcgtctgggcaggccatccattggctttcagaccgttcattttctcctctgccccttccgttttgttgtggccctgagggaaaccgcagctttataaacacagtggggaggcccttctgggggagagctgaggggatagaccattgaagcaagactagcccctagggcagcctgcatgtggctcagctgctcagacaaatgtttggacagcttaagaagataaactaaaacttaagtaaataaagccagctacctggttatgaagaaaaagtcaggtacggggccttctgtttcctgaggtttttaagctttggagctcacagggtgaggaatctcccggccttccttacagtttccctccccggactgcagttctatacctgtgtaaggacacctgaaggagctgatgcggggtgcaggcttctgccttctggggtagcctttccaagaggctggtttgagctcatactcccctctccccccattcattgtctattacttcacaggacaagcccagggagtctctactctgctagaccacttcccagatgaagagaatatagttgtggaggaagtgacacagggacgcttgctctgtcccacagggtcagagtagtgctatgaaggaggccatgctgtttttttgtttttgtttttgttttgttttttaaaacagtttctctatgcagcacaggctggctttgaacttgcacagatgcaccccattgcagtgtgctaactggtaccctggttggtgccaggactgtcagtgctggcagccactgttggccatgagctctgagtgtggagtgaggaaatgaatgtgtggtgggcagggagaggggaggcctctctctggatgcagtgagggtgtgtttatttgattcctgtgcttgtcctgtgcttggaggtggaggcagaggtggagatagggctgaagacagtcagatgcagataccaggagaggaaggagaaggtgtatgtcgggtaggaaatctctgctaggtattcaatctctttccctcctcccttctgaagggatgcccagctctctgtctgcttccctctctttattgaggtgagattggagtgctgagataggaaggttgaggggtcttaccagtcaggcagagttgggggagatggagatggcttttacctgtgaatgtagttgttgccttatgcacgcattgtgaaactggagcctaaaatatctatagtgttttgaaaggccacttgtcttgattttggtcactgctgctcagaggtgctctgttgccacacaccactgattacagtctcgcttgtttagctgggcctccaagagtgagaagagcggcctcattccgtgagaaaaggctctgctcctcctcttgaagccacttagtcccaactcaaaggctcttcctaaatccttctgcgtaggaggggtgggcatggagaagtgcagtggttctctgcttgccccacacctcagtgactgacatctccccatagcctcattttgtcacctgtatggttcagttgtctagccctttcccctcttcatccagacccctccctgtttagcttcctgagaatggtaaaacccttgtgagttgttctatcaaaatctacacctttgcattgcagtggtgtttggagtgtgaattgttatgtagtgttattttgtgaagtggtcttgattgtcccttgtccctaattggcatgtgtcactgagagccggcaggcaagcagactcctcttctgagtttcacggttagcacttctccctaccagtgctctagggtagggtttccattcattctgtcaaggtagttgagggatgccccccccccccattttgtagatgaagaagttggggctgaaagatagtagtagttcagtgacttccccaagaccactcgactttttatatggcccgacactgcctcctagcttcgtccttatggaaacacctaggcttgggcagtcttgtgtagattagagccgttcccaggctggctttgcctgattaccctgagttccatggtattattgctttatagctgagaaaagatggtctcaagggacaagtgacttggccagggtcatacagtgaatttgttggcaggattcactgcaggatatttgttgagcagaatggtgtctagctatctgtatctacatgagcctcatgcgctggggagagcgtggtggacagaacataaacgcctctgtccccatgctttagctttcctcactaagcttctacacagcttgcattttactgtggatttgaacactacaaagggaatttggtgtagtattttgcgttaaatgcagagtgatagataaattagtttggggaaaagaagttacaaaattgagtctaaaattgagactgagtctagggaaatcactcagaatggctacaagagcttggaggacccaacgttgagtctccagcacccacataaaaagccaggtatgactgcatatgcctgcaaccccagcattgagaggcagagacggggattccgggagttcactgacaagctagccagtgagctcaggtgaagagtgacatactgtctcaaggggaaagatggagagggccagagattcaaagtttgttacaggaagccatgcagcgctctccccggcttctgcatttgtatgacagccatgtgtacacatgtacaaacacacatcccacagggacgggggggggggggtgtctgatggtccagtctggccttgaactcttgaccctggaacttctttttttttttttttttccaatttttattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatccattagctgactgtgagcatccacttctgtgtttgctaggccccagaccctggaacttctaagtgctgtgattacttgtgtttgccatgctgccttgccccattctttattcaactgctgtttgagcaggtggtggtcatgctttggttgagagaatccggcaaacctgaagggatggcagctcccttgagttatgctgacagccaggagcagtgggggctcacatttactcctttgtgattgctctgatttgagtgcccccctaggctatgtggtaagagttatctaatcctaggacactgtctttttagcttgctaggctgggtgacactgccaggaaacaccaatatggcagcaagaccttccaaagctgcagtgacaacctgctgcattgcctttgcagtctgctctgaggctccccaggacagaaggacctaaacattggagttcctgcacactggagcccttcttactaaagcagcagctcaggcaccacctgcagcttttgccacaaaagagtgacctctacagcctggaagaaaggggtggggcttgaccaaggatgccagagaggcctggtgtttataaaaagccctctgaggtcagtgagaggcaggcaaaatcctttccatgcccctccttaggaatcctggacttttttttttttttttttaaagaagaaaggctattttaaaacatgaagggctggaacattctcctttatattccctcatctgcatattatcagttggtcacctttacaatcccttctgagttggagagtttgtttctggctctgattcccactacagcccctgctttgtttgtcccccttgcaagggtggacagaagcctgactgaggtatttccaccttcaagtggacagagcgctctctatcatcccaactcacacaggtttctgatcttgccacagaaggccttcttccaagctcaccaatgggttcccatcccagacagccccagttctgcttcggatgggatcttgctggtttttgctttgtctgtgttcttctgaaaatatagtttccaaaactgacctctagcgcccactctctggcctggtgcccttgaagtgtctgcagttggcaagagggaaaaggacggtggagcggaagatgcttcatcaggagctggcagtgatccgctttgctctgtggtaggtattaactgtgttcccaggcctgtttcctgctcccaaatgccaacatccctgcctcttaagtgaggtttaacttaatccccaaccttacctaaatgttacttctattattattcagagctgtgggctgaatttccctgcagctctgagaggctgacagtgcctgtctgtggggatgcaggtggggatgcagcagtaggctgcctgctctgcttggctctgcctgtagccctcccggcagcagccatccagcgagagcagctccaggctgctagggatctgggtcactagtgtgtctttagaggttagactggacaaacccttcattcaccagcaggaaaaacggaggcctagggaatgggggcagacctttctcccctttcctgtctcagggttagtaaccaggcttcttgtgccagagctctctctgccttagagagagaccatagtttctgagaagtggtctgcatagaagctctgaaactgccattactttgcctgggccagatgggcacccttgagctcaaggcctctgtatccagatgccaacagcaaggcagatatggaaccagatgtcagagtctgcccagtaagaagctccctaagggtagacaggtgatgagtcttcattcttgtgtttacagtacctgacatacagtaagtgctcattgaggacttgttcagtgagcagaaggatttggataataagacctaacaatgaatgagcttggtggtaacccacccatctggtgggttaaaatgaaacaaaacaaaacaaaaaaaaccaactctttttttttctttcttttatatctcaaaggcattcttagagctcctccctaaagaccgaccatccccattcccggatggcatactctctgttttgccttgaggggagtccttccttgaaagctgcctcttggtgtccgacagccaacttgctgagttcacgcctgagattcctgctaatacgctcccttcctatcccggggggggggggggggatatccttccttctcctttcccctcaccccattgcctcgttttaagttccctctgaatttgatggaatgatctgcagggcagggctgggtgatggtggaccttctctaatctaccatcccttgtccagtgctgtgcctgcaaggtgctcattagcgtcttaattcactggactggattttgtcccaggtatccatctgtatgggacccagaggccgactgagggttgcttagcatcctggccccgaacctttcctcaagagagaagtgaacttgctgaagcagagcccatccccatggttaagtcaagtcccttgctttctgagtgaggtgtagatgtgcacccgcacagcgctctcaccgtcagcacagtgtgccaggtgcaccgagcagacttgggcaggtctctctcagattcaaactcaaactgtggtcctgggttgccagccactttccttgatcccactgggttttgttccttatcctcttttctggtctctctcttactgggagctcagttctttctccttcctagggaccatttggtccactggctcagccacaggcctgactgcatccttggagcgatagagtgaggctatgggacctcttctcccttcatccgtttatgaacttcctcccttcacatagaaggggctgaggaaagtccttgtacagttggttggttggaggcctatgaacgagttgtgaatgtggggagaggagggctgccctgccgtggaggagggagggctgcccagctgtggaggagggtgcagctgggtgctgggcttgggaggatgctgaagatgacttgcaggagtcggggagtgcaggaggagaggcatgcggctatggcaataccacagcacggcctatgcccaggctctgcctgtggagtgggagcgcctgcaaggagactgggggcttgtttggcagccggcgcctatcagacaactggaaagtgccagtgcttgcgggccatctgtcccctgcgcctaactcccagccaccttctgcttaccacagaagggccccggcagttccacagcacaagggcgaggcgcctgctgggaggggcagacagctttccattttgcttttgtttagtaccatcctccttgtagctcctggtgctttggtgttgccaggtgtgtggaaagtttgcaggctgctgtcagccagccttttggtggagagctggtgggagaaaaaggtgggtgtgtaagtggcctgttcactctcactacttgtttgcccaactgtggactctggtccttgcctggctgcctgccgttttcccattctctgctttaattgtaggagtatagccaaagcaggccaacacttgggatttgggttgtgctgtgcaccacccctcttccagctactaaacgggttaaaaattatggggaagttcagtcgacacttgcaagatatggttgccgtagcaacaggccttctaatctggtaggtgacccgagagactggagaagatgtaggggttggtttggcatttcatcatttcatgaggctgcctctccagctggtttctttgctgagctaaagcttgctgttcctgccgccagaattgctggcacattccaaaacaacagttcggatggcgtgagcagtgttcatgggggttggccagactctgtggaagagaaggagctcaggggaggagagtctttgtgtgggacagccctccatacaaagagatggcctgggtagtgggcgtgtctggctcactctccttatccattagccccttggaacagcatgtctatctagtaaatggatttgttttttaacgtgtgtttatgtctgtgctggtatgtatacatgtgtgtacatgtatggagaccaggggacagccttgagttgtcatcttcagacctgttcattccttacttgagtcagggtctctcattggcccatttggctcaccaggtcatcccttgggggctcatcagttagggtaagctggctggccagcagtcctcagggactcctgtctctgcctctctagcattgggatcacatgtgaacatcaccaggccaacactttcaggtgaattctgaggctcacatgtgggtgctaatgtttaccgactgagatatctccccagatcctgaatcccatttgatgttctgttttgtaattgccttgagagggactagttctttaaggaaacttgaaaggtcttcctctagtttgccaagaatcttccttaaatttgggggcctctttgagatggaggacccagttgtcatgtttgtgttctggcctcatcttctcgtgtcacctctagatgggttttgtccagacatttggttcacttgggcctatgaggtttctcatgtctgccaggtaccagacatagtccagcagtgccgggtagtgcctgggttctaccattctcttgcagtcgttgtctgtagcatattgcaggcacggcagagaggaagcagtcctggcctgagcctcccagttcatgatgagggacttaaggaagaagggcaggaggagagagcggcacaccctgctccacctcgtgctttaggactgtgtcaggggagccattcatggggcccagtgtgtctcacgttgtgtggagtgagtgggtgttgtgctctgtggtggggacatcttattcaggttacatgggtcttgagtgttttcattgttaatcatcctctggtctgcagaggggaaaaggcagaggagttacctgtgctgattatcttggagctgctaagatggtagctcttaaattttgcagctctctctctctctctctctcctttctctctctctctctctctctctctctccctctctctcccccccccctccctccctccctccttccttccttccttccttccttccttcccctcctcctcctccttcttcttcctccttcttttttttttttttttttttggtttttcgagacagggtttctctgtatagccctggctgtcctggaattcactttgtagaccagactggccttgaactcagaaatccacctgcctctgcctcccaagtgctgggatgaaaggcataccttgtcactgcctggctatcttggcacctcttacatttgtgttggtcacagcattaaggacagtgctgttaatggaggtctcatatggtcaggaaactgggtgagaactggacccagaagagaccagccaccatactgtcttcatcatgagacttgagatagaatggaggtgaggctaagggaggaaaggttttgagaagagatagaacctgacaggaagtgaggtgatccagagagactgtgtctgacaggaagtgaggtgactcaggggagaccatgtctgacaggaagtgaggtgacccagggaagacattgtctgacaggaagtgaggtgacccagggagaccgtgtctgacaaaggttctgcacagatagtttgtggagaagcgtggctctgttctagtgtcatttggagaagccatctcctctctaggtgaggcagtctggcccctctggccagctagtttctctgtagaagtggaactgtatcccatcctgcacatcctcggtgttatgtgctagctctgccatgatggtgtttgctcctttgtgtgctctgagttctgcctagcccagggctgtgcagactaaggtgcctcatgggaaagcttgtacttttgtactgtgagagcctattgcttagttggggaccacattgccctcctggctcttcagacccatctgggaggtgaacttatcccatggctagtagagtaggtagtaagtagaggaatgtgctgagccagaaccttccaaagcaccgttacacccacgtgaacattcacgaggactttgccacaaagggtgtacacagcacactggtcccaagagggctctcaagaggacccagtcaggtttctgagtcttcctctgagaatgcccactgttcctttctgtcagcttgcactgccctagacccatcttcttgtaaacattacacattttaagaggaacgtgaaatgaggaaagattggtttgccttgtgaccttgctgagtagcccaggctggacttaaatttacagtctcacttgtgtgctcaggattgcacacacatgggaccaatgcctcgctaacattgtttttaaagtcaatctctacttagattattataatgttgctctttcgatctgttactgagcttcagctgttcataggtgtgaccggagagatttataacctttccgagtataactacagatgctttctcagaggccagtgggccctctgacagccaggctggtgtttgcgtgcagtcttactcaattattacactgatgtgggcctctgttgctttgctcccctcaggagaactaaagaaacgctacacactcattagagtagcagggagagggtgggagggtggctcagtggtgcagtactatctgatgtgcgtgagggtgacttccaacctcagcactggaagtcacaggaagaagtcacctgttagtccagtaccaaggcttgctttgtgcagtcagcgttgcccatggggctccattcagaatgttcccatgataaaacatgatctcgagttggagatagcgcagcagttaagagcacacagtgctcttgcagatgacctgaatttggtactcagcaacatatcaggtaggttacagcagcctataaccccagcttcaggggatcctgtgttgctgacctctgtgagtgtgatcatggcacaccccggcctctacacactgaaagtaaaacaaatatttaacaatgtgtaaatagatatagataaaggtgtagcacctgagaaaccatggaggctcggtttctgtttctaggctctgaggtttttccttggtgggtgacttttggaaagtctctgtgtgggatgctttttgctgatcccaggctctgctggaagagttcttgcagctcggcaccctgggcctgggcctccagacttgaacaagaccctttgtgtctaaggagttggtgattggagtgctaatgaatcaattagaaaattactcgctgctgagatccttagccaaattggggctgctggagagagcctgacaggccatctgaaggccatacacagataaatctttcttggccatggccctcgtaaatcgcagcacagcctttcttgggcctgttaatcacttgagcaaagcaggacttcttctgctttgtcaggctgccttgtgtctggcacaggtttctagcttgtgtctccatttgtcccagcgttggggaggatggccgtttcagttctgtataacagccttggtgtggaatcaaccagaagcactcttgtgtccttttctttgtccccacagtagcagcagggagatgtccatctttatgagaggcagcagtagactcagaaaatgcatgcaacctgtactcaggtcatctctttaaggcagaattggagtctacagccatgtcaaacagccctgtgtcataggcctttctaaatggaatccattgttctgtttagaggatcttcccagtcccaggttgggagttgcaagtgaggaatagcctggcgaggtgggggtggtaaaggtgattttgcttaaatatctggggttgtggtttggtgcagtttaacttggggcaggcggttggaatgacagccatcagctgaagctccagcacttagtgtgactcattgcagggtaccagctgggtgcttgagcttgaagggggatgggaagggtaaaaagactgaaattgttatgaatctcaactgaggtcagggccagctttgaaaaaggcaattgcaaaaataatgattttggtgtatttctctggctgttccacaccagtttgctgttggttattcacggtgtggtctccctacccccagagctctgaaatatgtttaactgaggcctttaccagttcttgtctggaaaagccagcatgcttgtctgtttgcagggctctaggttaatttggattcatggggttttgggaggatggactgggattcttgactttctggctttttcatcctttctggggccaaggttgcttgttttaggacctcagattctattaattaattaattattatttttaaagggtctctgttggtctagaattcattatttagcccaggttgaccttgcatttgtggtagtcttctgttgggattatcggcatgagtcaccatgccttgctagattttgcacttttgttcccaagatggtctgggtgtctggtaggttctgttttttgcatgctcagctgtggagaccttagagacctgaaaagatttgtgtgactgctaaggcatcctggtgttatgctttgaactttgaatgtggcaggggtcagagaatgggggcacaggtgactgtaagccagcacaggtaggacagagtgtggaatctccagccatccttctgtccagctagctacttggcttgcccatggtgacttggccctattgtgttccagtattggaagtccaaaataaataagcctagctcctggacaggagcaggctgtctttctccctgtggaagctcaaagtacaatagctgtgtaggtaggcagcaccaggtgatctcttgtgtggcaggctgttgtagtgaggctccaggaacttctagtagggcacgggaatcatatatatgtggttggctgtgtctccttgaccttcaagttcctttttggatcttctccatgtgaggaacatggcgaacatgttgactttcccaattaccacttacctacccaccctttccacattctctgtgtttttgacagtagagttgttttagattcagctggcaggctaggggccagagtgccacctggcaatgttgacttttctgttgtgctctggatggtgcttggtctttctctggtctgtcccgggaggtctcggtgaaccgtcaaggttagttgcacagtggtagctccatcattttgggtcctgtatttttgaagtgggaagaatgcagaggaagagagcagttgatgtgtgggtgaaagagttttgagatagagttctacatatttcccaaattgcactaacaaagaaccataaatgagtgaagactggaaatccaagatcatggaccagtaaggccatgcactctcgaagggtctagggagtctgttcatgactttctcttctggtgttgttgacagtctttggcattctttgactgacccatgtcactccagtctctgcttctcatgaattggcattctcccggtgtctgtgtgttcacattttcccattggaatagggcccattcacatccaatatgacctcatgctagcttgattacacctgcaaaggacctagctatagataggttcatgttcataggtacctggatgtggggagaccatggacgtattgcttgtttgtttgtggggtgtggagggactcaagaacacaagccaaccttctcagaggtctgtaacctcagaggagtgtttaagttactattataagggaccttaaagttcgtacttgccacagtcacggtctggtctcagccagcgataggagtgagacgtcacctggctttgggagtgagaagttatttctagagatttttggaaagcataaagggaatgcctgtgcatgtactgggggatggccttagaaagcaggcaggtttgccttccgtccctgttaatgttgagactacttggctcccttcttaaagaagggtgatggggaaggtagagggttgcctgggtctcccctgtagggaggcagaaagactgatggtttgtcgagtgtgtgtggtctgtcccgggcagcttctgtagctggtaacttttattggaagggtaaacactgtacagtgtcgatacagatgtgcttttgctgtggaaaaccatggagcgccggatgtgtgttactgtatagtggctggggccagccagctttcttccctcatgtaagtttccctttgcacagaacccagatgaaacgtcttagaaccttgcaggcggtctgtcccagaagagcacgctcagatgacaggagtggagagaggcatttgtagcttttcagttggtgaaaccaacatagtgtaagtaggaaatctgggttatgcctgtcctcagcacactacagctgaaccacacatgccaacaggcggcagggcttggccggtgaggaaccttgttccctctctcggttactcatcatgtctctgctctcgcaaccatataaaacaggagaagaaaatggtattgtcttggtgctttctttcctttataagaccatccccgagtttgtgaggagtgtccaccccagtaggtgtcactgtccagagcacgtctttatgatcgtaataaagcaacccctgaagaatccaggaagtctcttgagtgtacttgagtactctgcctttcttggagtggcgtctgtcacattttggacagaagcattgttacttcaagagtgacagatgcacttcattcttagtcttagagtttgctgcccattcccataatatgtgtgggtgcatgctctttgtaaatgaaaatagatgataaagtaaacgctgcacctcaggccttcacaaccaaaaatgttcataccacgtccttccatagtgtccaatcagatgtgcttctcagccactgggcctgggttttattttttgttttttttgttttttttgcatttccccagtctcatttcttcctttctaaccttagattctgctgagttagcccactttgctgagctgtgtatctagaactttgtgtgagacctgcccagacatttcattccctcttaaagccagaagatcttggtgatgaatgtgagcagcagtgaggaggagaggtgtaatccttgggagccctagagtctgggctttatgtgggaggctttgaggggtgtgtgtgtcagaccagtaggtggtaggcttcagcttctaacctctatgtgtccttcctttgccccctccatgcactgcccactaatgggtacaaataacagaacactaggggtttgttttagagaatctcccaagcccttccatagggagcctcccagagggagataactccccaaactactgaacctcccggcctgcttgcatggccccctggagtctttcagtgcagctagaaagagaggaacccacagttgtgttgttgtaaagttgatggttactgtgtctgctgtactccagagctctgccattcaccttcttcactgtgacccaatgagagttctgccatgaactcccctccatccccccaccaaaagagaaagaaagaaagaaaaaaatccaccatgacttttctagaccagcaaatgaaggtttagaaaaggtggtaatacgtctggctggagccgggactgggacctaagcagtgtggacggcctcagagtgggtggcagatgcctaggacagcagactctgcctttgctccagcctccaaagtgttaggacgacatttcctcccccaggcttgcacctgcttgttgtctcctgaggcaactccaagctggtggaggagagtgggggtccaccgctctgcaaaatgtgtgaaatcctgttcctgagccggccaggttctctgagtgtcccggctggctcgtctgctagtcacgaaacatgatccatacactgtattttaggattccccatctgtcagtgtcggagaggttgtcccctgaggggggtggggagccctcaatactcactccatgatgggataagggtctgtggttgggggcctaggtgtactagacagtgggagatacaggtcaggtgtccacatgcacacaatgtgccatgtcactttccttatgacttctctccatctgtcagataaactgccatacagggcatgggcaagggagtagtctttttcaacaggtccaaggctgttcaaggactgaacaatacacgttttggctgtctggaattctctgctagttggtgtgggagggagagtggcctgggagccacagaaacagaggcagatgccctcttcaggcccactcaaggatgctgtttgcccaagtcccaacctgtccctctggcctctgctggtgtcagtgagtgaagtgaagggccattgatccaccctctcttggggaggccacagcacatgcaaggctttcctttaaaaatgtattaacctgaccggaagcaggccccaggttaaaaataaacaaaagtaagaggctaaacaagtgggcgtgggaggggtggggctagaggctcattccttcgcttgcttgagagggctcttaggtgcctttgagcttcacacgggggtctcggcttcacacgggggtctaggcccccgtggccctccttcccttcccttggggcttcttttcttttggcttcatctgtacagtggaatctctttaaaccttaacccaaagggcctccctgagtgcagtgaccgtttgccatgaaagcctgctttgttagccctgcagggcaccctggccaccctctttgttccccactgtttctcaggagtcctggctccagcctttgcacatggagctttccactgtggcttgcccagctctccggtctcactggggacaattcttaaggagctggctttcttctggctgggtcagcccggaggtgaaactcaggggagacccatcctcctgtcttaggtagggtatctgttgctgcgagacaccatgagtgatgagacaccatggcttggggagagagggcgcatgtatctgtcctacccttccatagcactgtttatccacagagggagtcaggacaggaactaaagcaaggcaggaacctcaaggcaggagctgatgccgagatcatggcgtggtgcttgcaattgcccctcatggccgcctcagctgctttcttagagaacccagcaccaccaacccagggatgacactatccacagtgggctgggccctcccttatcaatcactgattaataaaatgctctacaggcagaccttatggaggtattgtctcaattgaggttttctcctttcagataactctagcttttgtcaagttgatggtagggatggtagccagggtctccttgtatgtggatactgtctgggcaaatgggtggagggtccgacattgtaatcgtaattccccatggatggtgctcgccacctcccccttttaagacaagagcctcaactatgtagccctggctgtgctgctttgtagaccaggctgtcttcaaactcatagtgatcctcctgcctctgcctctctagtaaaaagtctttgggactttgaaattaaagaacaccccatgcccgacaatgaggtttcaggaagtaggtggggttttgcatctcctactttagctgctgcgtcatctgagtctgcaccagcttgttccctctggatggaaagacacgaagtccagggattggtaaggacttaaccaagaactcagtatctttatccagacctccattatggaaagatgattcgtcagatggcagaggtgggttcagtctcttctgtgttggctcacatgacagccaagagtctcagcttgctgcttcagcacaccacctttctgagctcagcctttctgatgcacaggatggttctgcccccatctcccagtgggtggggatagtgtgacagctgccgtttcttgtgtgggccatggagggcactcagcctccagttagttagaagagtcccagggactgtatgagtcgcctctggctcaccgtcccctcctcctgtatctttcctccctgtctctgaaatcatgttagaccttcctcttgttcccccttcctcatccctgcaaagccataggagattctggaaaggtaccgagagagatgaggcctttccacctttctgagagtagcattccggtcatctgtagctataaataaagcctgcgcttgcttctccgtgcagcagatgggttttctctgtgggctttgaagggatcattagcccctcctatccttcacaggtgtggagagtcccactactttggggacacaatgggcttggttttgctcactggccttaagcctcaggcctctgaagaaacttctgtagcctcaaaagtggctttggaaagtgggtgggtatgtatgtgtaagatgggacagtcactccgacttcctttgccaatatgaccataaaggagcgaggcaccttcagagggcttcctcggtgctgtgttttctctttgatacctagaatgcacggaggcaagacagaagaaatgagttaattttgtaacttctgattgaggagatgttttgtgccaagccgtatgacagggacctaagcactgactgaaaagcaacatggccgtgtttctttcttggtttgttttattttgtttttccaagatggggtttctctgtgtagccctagctgtcctggaactctgtctgaagacaaggctggctttgaactcacagagatccacctgtctctgcttcccaagtgctgggattaaaggtgcgccaccaccacccaatattgctagaaggtagctgtcctcagttcctggggtggtgtgttgtgtgtctgtgttgtgttgtgttgtgtgtgtgtgtgtgtgtgtgtgtgtgtgtgttgagagagaaggaataaatgtaatcttttttcttttactgagtgtagagctatgtattagactggactaatactttacttgcatttattttctgggctaagcattagcgttggtctctttacccatttctagttgaaactggagcccccgccctgcgtgtccgcgccccacccccccaagattactaaacttttttagagtcccacagctagacatgtcgaagtctaagcagtagatttcactcttcaagctgttatagagccacctgcctgtcctcagcactttcttttgagaatctgcaatatactttccatttaatacatacaataatagtagcctgaaagctattcccctatttctttcaaacaaacaaaccagatggtgacaagtgagtgttagctgatatctagagtggctagcatgctttaaaagaattaaaaaaaaaaaaagatctttgtgtgtatgaggtgtgtgtgtgtccatgtgccgtggcattcctgtgaaagttggacagccttgggtgtaggtccttgccttccatactgtttgaggcagtatcttttcttcgctgctgtgaagctagggtagctggcctgtgagcttccaggactttcctctgcttctcgctctcagcaggaggagcaagacctgaggtgtgtgactcttgtgtgggttcactagatccttaggctggtggagcaggcattttacctactgagccatctccgctgctcctgtgtgcaggcattttacctactgagccatctccgctgctcctgtgtgctttgtacctatttttaataatagtacaaggtcttgctatgtcaccaaggctggtatcctacccctggctcaagcagtgcttttgcctcagtcagcctcttaggtagctagctgaggctacaggtatgtaccaccctatctagcttgaaccatgctgtgttcatccagagcttgtgggagagaaagtccaaggacccactgtttttgtttgtttgattgtttgattgactgattgattgttttgtttgagacagtgttttctctgtatagccctggctgtcatggaactcgatttgtagaccagattggcctcgaacccagagtgctgggattcaaggcatacaccatcgcgcctggctacatgtgtgccctctaaatgtcgagggccttgtgaatgaatggctcacaggaaaggagtgcagagaggacaagtgtgtcatttggacctcacagatcccatttggggattcctcacactgttgtcatgatctgatttcaggtacctgtgaaaatgatggcagttgtaatgtataattccctgttggcacacagtagctggtttagatgtaggaggctagggcgtccatgtgggaacaagctgaggcttgttaggggtgtcactttgttctgccctttgtgtcaccagggagaagggtgggagcagagagctgctggagctatttttacattattcacgtcatgttcagaattactagacgtttgtggctagatccctcagtcagtgagagcactccctccgctgcctgtacccgcatggaaacttgagctcaaccccttgggtatacgtgttgttctgaaggcagaggaacctaaagtgaccgcgcagttaccctgggtcattgggagttgttgtattagggcttctattttccagggttcttctgtatgcttctggggctggtgtgacaagagtgagaggcagaggccatgggctcacccacagacttatttattcaacacatagtctttcagtttgaaacacacactagatatatgtattttcagagtggagtaaaatattatctctcaacaattttatacagttgatcatgtacaagccagacatgtatgctgggctctgaaggaaggtctggttgtctgtaggagggactggaagccatggcaaggcagaagaaggggccaggtcatttggggtggtcagagtctgcttctctttcaggaggtgctgaatggcaggaactggcttaaagtcttgagggtagaggcttcagctgggttgttggctactaagtatcaccgtgttcatacatgctgttaggggtgatgtcctgggaatttagtttttacactgaaaagtttgggtggcggggtggtacctcatacttgtgattccagcccttgaaaggctgaggcaggagggaggatcgctgtgaattctagaccagtcttggctagttcaaaattaggcaaaggtgtgggtgttgctctgatagaacacttgtctagcaaagtcttgtttcagtcccctgcacttggtgaaaaaggaaaagaaagataagaataaagcccaagaaaaagctttgtgccagtgcggcctcagtgggcagaggggggcagctctgcccttggactttgaggccatttgtttgtttgttttgttttgttttgctttgccttttcgacacagggtttctctgtgtagcctggaacttactttgtagaccaggctggcctcgaactccacctgcctctgtctcccaagtgctgggatcaaaggcgtgcgccacaaccacccagcctttgaggccattttacttcgtgcgccacaaccacccagcctttgaggccattttacttcctgggtggccaggtcagagtgtgttgttgaagaacgggggtcaaagaaccccccccccccaaatcctgggttctcctgggttctagttgagtttgtaggcgcgtgtccctggcacagcattatttgcagtgagtattccaaatgtcaaattccccttgacttgagctgagcagatgaaacaaaatgacaggcagattagaaggggcttgagaagccttttaggatttgaaaaccggactttgttgactttgaaaatctgctgaactgggccatctgcacagaggcaagggcatctgctggctctaggtttgagaggctacaggcacccttgcacacacatctcccctcccccaaccccaatgcatggggctagccggtctctgagtctctcaagggtaatgatgggtgctggggagcgtgtgggtgcatgtcagacccgctgcgtcttacaagtgcttgtgccttggccaaggacccaataggtaaaaggaaagaaggtggccttgctgtgtcctaatctgtagaatggaccaagagagatgtcagagttaaaagcacaggaatcttggctgagaactcccaagtgtcagtgcagaaccccagaggtggttctgtttgctgtggatgtggccctgaagctcagagaggtgcgagcgcaggaagtggtgtggttggagtttgagcctgcctcctcggccttcagctcataacttctctcatgacatcacactgacttccgctctcagtcctctcttcttcatagactggtctcttctgctcttccaaccgcttcctcttcctgcctggattccccaggaatccctcagcgggtgctgcctcggacagcctaggagaaacaggaaaagcagagagtctaagcaagaactcagcccctcactacttctgtgatatcccccagggatagtactctccttaagggacacacacacacacacacacacacagagtctcttaaggacagacagaaacatctctcaccttgctatgctcctcaaaaagcgttgatggagttgatttttgggtctgtgtgaaggtgctctttaggaggtgtggaaatcctctgccagtaatggtcaagtcctaggacacaggatcaggctcaagtcctgaattgtcctgccttcagcagtaaggtggatcgctgtggcgcagaggctagaagattcattccttctgccctttctctctcatttgcacacttaagcacagtacctttcatcccctgcaagtaccatcttctctagatgcatcactgagaagcaggaactctgaagattcacatgggaagaatgctgtagagaccatgagggcttgggggcctggcagcagcctgttcacatggctgtacttccaaagcgaagtgctgttcctcttaatagagctgcctcttgtgtccctgtgctgaacgaagggcaaagctagctgaggccctgaccgtgtggccatcattgtggccctgggagcccttctctagccctgtcttagccgccgctgagcaggctgagtctgctcatcagcagatcctcctgttcttagttccaggttcaaagcaacggtgtgaagtgtaataggcgtaaatgttacgtcctgtgtgggattaaaaaaagttaagatattgtcgtagggcaaggaagagtgcttttaatagtgagctttagaaagtgatcaaatccacctgttagctggctttgtgtgccaacagttggtcaccagtgaaagaacgtgacacagacttgtacaatgccacatccactagaaagattgccagtaactattagtaggcaggtgtttcacttgcgtgaccttatgccatgtttgagatgtagtgtgtgatcctcctttttctggagatggtttggctagcattattcagggcgaagcacaggaccaaatgaacccaggctgaccaaggacttggactggctggaacaagcagagggttgggtaccgctgaagagtctgaatggacaaatgctgaaggccatggcggcacttagccttgaggcagctttagttgtgctaggcccagttccaaacagttttctgtgatgattctgctattgcacctaatgttttcaggcagggaaattgaggcatggggaggctaagttaagcaatttgtccaaaacgagactgttatatatagcagatctggggcccaaggccttgcagctttaaagaggacacagctggtaggcagagctctgactgccctcttcttcatggtggtggttattctgtttggactcagggaagagtgacagtctgactgtagatgtaataggaagaagccggacaccagatggccatggagcacactccctgtgtgtggcagtgaactccctgttgccaggtgactgcccacaaccaggcttgcccatggaggcaggatatatgggatataaaggtctccatgacctactgtgctgctggctggctcccagtgctttgttgaagaccggacctccattacctgcagctggtagtgtggctgcggtggtggtccccatggaccactgcaggggaagtggctggctgcctactgggtccagcttggccatattagggagtgccggctgtcaggcccccagaaggctgacaatggtgcctgggaacagtgctgcgtaggaggtgtgtgtttgctcgcctcctgacctgagtgacagtttagttttccttttggtccccagtgaacactcagcctggcctgaatgcatttgcctctcaggagcttgggcttttctgtgtgggggacaggtgaaccgttaacctgagctggctcttcttccttggccagggtggagggggaagggatgttcttgaagcccctgtcagggagccatgtgtggaggggcagggaggagatgacatataactcactggtaagcctgactaaattagcctctggtgactcgaactgtggtgaggggcctttgagcatttcctgtgcagctcagttgacttcttatacagatgagaaagcgaggcccagactggcagctttaccggacctgggtgccttctccggccattggtggcagtcgagtcttgtggcctaagatctcaggccgttgttgcactggtgtgtctcgttgctgcccttgctcgccttgccaggccgatgagagcggctgtgaccggcactcgggctcttccctactgctctcaccactctccatggcagggcggctgctgatctgcttatatcaactgctgtttgctttgtaagagctgagacccaggaaaggtcatgtctcagtttccccgctcaggagctgtgtggtcttggggaggctgaataacctttctgagccctgatgattggtcgtaggggtggaggtgggtaaggtgatactggttcaacccccagtagcctccagaccttcaactttcatgtaagtgtgcaagcccccaactcaaggtttgaggctctgagtgagtgcaggtaccatgggaaagccccagatgggaggtgcaggggatcccaccactcttcaccatgtctctgccacctcttctttatctgccttggtgctgtgggcacaggcattgtcctttcttggttgaggttgcctgtgggtatatgagtagtcacactgcaccagcccattggcaaggccttggtcaacctgacacctggacacaggcaagtaccagatcccctatgtcatttgctgattggattccatccatcttgctcttaggcctgggacaccctgctttccattacatcacaggtgtggagtggaggcagtcacagatcagacagggagtcactggcttctcagggtctccattgtactgtcataaaggctgtttatagggttgtcattctttgttttttgccttggctgagaagttacatcctgttttgtgtaacctgatcccaactatctgagcatgaagggcaagcttttttctcttttttcttaacatagggtatcctagggtggccataacatctggaagtgattagatacctggtttgagctgaattcatgcatgcatgcacatactttttacaatataacatggctgtgtctttttttttttttaaacgaatttatttcatacacatgggtattttgtctgcatgtaagtctgtacaccacatgtgtgcctggtgcctacagaggccagaagagggtgtgtcaggtcccctgagcctggagttacagatggttgtgagcttccacgtggcttggagaatctgcgtccagaagagcagccagtatctttaccactgagcatctctccatccccaccccccccccacccccgtgtctttctatatcaggtatgtatgtagttctatgttgatgatgttaacatgcagatagtatccggttgtgacctgggcttatgccacacacacttggataaatgtcgggcttagagtaaggacatttccaagggtttccagttaaaagcatttgctgtggtggacgttggtgtctaacagtgtcttcagtggttatgatcacacatctcctcactgttgccaggcattgcccacatggcattttgggaactctgttctgttcccttggagaggtgatccctgctctcactccctgtaggtgcctgggaggggcagctccatttctaagtggcctgttctgaccatcagttgggccccttttgaggcagagtgtctctgtgtggcccagaatggccatgaatttgagatactcctgtattagaatgctcctgagtggcagaatcatggtcatgtgtcaccaaacctgtcccgaggtctcagggcttttctccagctgtaggataaaaaatggttgtgttcctctgtcctctccaccctagcccttgcagcctcacctggattggtggaatgaaggcagccacccagggccacaccttctttcccctagtgcatgtgtgtgcatgcgcgtgcgcgtgcgcaccttattgctatcgaggttactgtctttcctttggttccttgctgctaggcagagtcttgggaaatatggaagtttcctgccaaggattatgtatcttgggacagtgactgagagctggaccttgggagtagaaaactgtcctcctttggtgtcccttgtggaggcatctccttgagtcttgttagccccaggttgagcctaggggcctgggtaggaggctgaggtcctgacagtggcccatgctgggtgagtcagcctccgctgaatcctaaagcaaagcacactgttgaccactgttgactgtgaggaagcttggctgtcacgtgcaggaatccttgcttcgaagcagccgtgctccttgaaggaagaaagggactggagtgactctgtcactgagctaacatgcctttacaaatgcaccttgatttaggatttcagctttttgcagcatattttaaaatgtcagataaatatacagccttcctaatgtgtctgctttgaacagcgcttttaaaaagggtgtcgccagtcctcggggtcacatcctcacctcctcctttgctataggtgatctgaccaccttccccagggcagtatttttggtagggaagggagaacagaggcagactgcctccttccgagtccagaagacacgtgtgtttgcctagttctgagtctggtaaggctgtgtagtttctggagtgcttttgtgaagtctgctattagacttccaaagcaggcactggcttctagtaacttctatatagatagatactctcctcacttggagtaaaaaccctttagacagagactcagaaggaagttgtcaacctattccacctgtcctgtcactgactgatggcactagttgtctgtggcctgtgatgaggaataagctggggggcggggcagggtgaggcaaggctgtgttaggaacttgaaatggccttttctgaggtggatgttagttaggccttggtgaagaagcattggagggtgagtcagactgcattggtctgggggtggggtgggggggggtggtggtgaagcccaggcctcttacgtgctagacgagtgtgctgcatccccgggcccttttaatgttttcattttgaaacaaacctcattatctaggccggccttgaagtccctgtgcagcccaagcaggtcttgagctccctccccactgcctgaccccgagtagcttggatcacaggcctacagcaccaggtgtcttcatcttgtcattgtataggagttttgtaaatatatcctgggaatctagctggtggttttctcccaaaggaattagaggaacctttgggactctgtgagaactcggttccactggctgaggagaaagtctggaaagctgagcagtgtcctccttgagggccagctgcgggggagcttcaggtttgaggaagtagtgtttggcctgagctccctccacaggtgaggaagtggaggcctggagaaggtataagttgccagggttgcacagtagatcagcatttccccaggacaacccagtgtgtctttcacctgctgctgtatgtgtgctaggctggctgggggctgggctgggggttgggcaggtaatacaaagccctgatcttagcatgtgaacaaggctctgccaggcagcgcaggtctggagtgagccacactggactacttggctctaatctgtgctcaatggaacaccctcttctgtatggtctacttgggcatgggtcaggggaaagcccccattcttccattccctccagtcaccccttctctttcccaacaccatttttgaggatcataacgtttatcacgagcattattatgagagactttttcatgtttaaaaataaatgctagcttaaaggactatatttggtatatggaagtcgtttgcatgtaaatgtgcttaaaggacaacactttgcttaagatggagagggagccctgactagagggcgcaggagtgggtggggaagaggttcagggtctgcctgcttgggacacttgacttggagccttactggagccatgttttttttctttagagacaattgcaaaacagggtaactagtgcttagaaattcatagaaaatgtttcttatcacaacgtcataattgttgtgactcagaacagtaaaattgccgttccactctgcctgtctgccctcactcgagtccccacagcagctgcaaagtcttcagaaatgagagagaagggggggaaaaaggaggaaatccaaggcagtgccttatttatgttaacggctacatttgacttgaaaattctgtcccctgagcctggaggtcagcacattaccggtgattgatggctgtcaggaacaagccaggtggcaaatggcagtgggggaggtggacagactatgctgtgctttcaggggcttagcagaccccgagctttgaaaggaacacaggaaaacaaaagcagatggccccttccctcttctcttctttcttttcccctcaccctcccttttgtattgcatgttaggaagtgagggaggggactcataccaccagagtcactcagagtgtatgtatcctttatcagtgtgacactcatgagatcctaaatgtgttgagtctgagacactagcctcctacccctagcacccagagtcttagcctagaaatcatgaggcttagcagtttcctcaggttgcctgtctccaagacatgttggatgcctccgctcctcagcctcatccctgagctctgtagggctcttccccacactcttgccaccttctggactgagttactcaggattatgtttccaataggctttttgactaatccttgtatattttctgtgatggaaacaaatggtatcaggccgacaggactatttacagatggggagacacagaaatgatggaagagctttgaagtttaaacattagctaatgaaattacagatgaaggcattggatggaataccctggtattgccatggaacagggcttccaggaagaaagagtgcagcccagtagggggacaggcgggctgacagacctctgtggagtccctttccagtgtctgtctctgagaggcaggcaggcaggcaggcaggcaggcagagttctgatgcctgcctgggtacctggcctggttaaatagatggtcagtgctggatgctgtgtcaaggctggtcactctggtatctgcagggttccaggttggccaggaaaaggaggtttgcctggctgagagcaagcgtaggggcaagaaggtgttccgggtagctgctgggtgaggctagaatctttttttcccggggaatgggttgcagttcgtcatttcctctgcctctgcctcccccgcactgcggagcacagttgtgtagagatgggactggctgttcattcatccgctaattgttttgataagagactctaattatccactgtgatcatcagattaccctggctccaggagggagacactagagtttgagctactgccttgccgccaccaccatccctggtccctgccaaaaggatccttttccttgtgcccaggccaccatgcccagtactgactggaaaagcattctaggttgttgacgaagagttctacttgcaccataaactcaagagcagaacctgctgctgtcaggcaggattctccttttgattatctttgtctctctgtgttaagtccacagatggttctagggaatctcaccctgtggagaggagcatgggggaaacagaggaaaacacagcagtatctaatgaattgatgtcagtattgagacaaattcacatgcctttttgaactgtttgatttgattaagttgtacttccatgtgatttttttttcttcatataaaagagcaataggcaaaaaccaatcaggaaggcagattataaattaatccaataattggatcccccagcagaggtaatggggaatgatggcatcgtaattgatctgatacaggtattcacatgagtaggagctacagcataaggagtgtctcatcttggaaggagggattgtgaccagacatgttagacctctgagaccttggcctttgacaagccttggtggggtgagtttgacctttgctggtgggggatgtgtctctcccccttccctcctgtcttcatcattcaggcagtatcagtggagcccagagaagctgctgagagaaatgggcttctgaacagccctatggttggcatggatcttagaggaagcacagccctcatcgataggctctgactgggagcagtagaggtgggcagcagtgtgatggaaatgccacaggcactgggcagtccatgctggagtgctccctatgttagtacaaggctcggcactgggcagtccgtgccagagtggtccctatgttagtacaaggctgttcccacccctctgactgctcctttctcatgttgcaggggataccaatttcctttcaattcttattcctttcttaaaattgagcctcattctcccaccaaagtacagagcccgagatccttaatccaggattttctgtccagggcccctgctgcttccagatgtgctttccccctgcagagcacagctattgtcttcacctttggggtttatctagctggggaagtttggcaacacatcaggcctagataacctgttctcaagaaacaacctcttttagcagacttactgatgtcttggacctgcctgcttctcagaagtcatcattcagaacatttctgcaggacacattgtatcccattagggcactgccattaacctggtactcctacaacctggagtagctctggctggccttgaactcacagaaatccacgatatgcttccacatccttggtgtgctggggttaaaggtgtgctccatcatgtccagcctactaaatgattttgttgtaaaggggggttttgcccacggcctcaaaggctcgaaagtccatttctctttccaggtttcctgacttaagcattgctgggcattcaaggccagcacacctggtttgagaggccagtgctcttgctcactaactctgggcagcagacttcacccctggttcctgccttgtgcatctgtacagtgggatttattaaaatacattccctgagaatacttggattaaatgaaatgattttgtaaaatgatcagggtagtctggtcatgctggctgtctatagatgtcatttcattagtcttacttgaagatgtcacacaaatctaagtgttgtaccacatttaacactgagctaagaggacactaacctgatgggggaagatacctcattttgctgatcctctgccctactgcaaaccccagcaattttttcagcctccttttaaggggtagaagttgagtcacctgttaagagtcttgacaacagtgcatgcctttaatctcagaactcaggagacagggacaggcagatttctgagttccaggcaaagcccgggttagatgtctccagaagcggacagggaaacaagtctgacagcgtgtgtagggttcaaaacaaaacaaaactaaaaggacaaccaacctctgggcaccagggacagttcttccctatctggctggggaagttgagctgttttgaatcgataccgactttcaagcacctcctccctgctctttgcttgcctggaggcagagggcaagggagctgggacaggaatggcactcctgcctgttgggacagggtctagctagcaggccggggcagaggctctagggagcaggctgcagcagaagcgggaacaccgccttctagggaagatagggagcctccttccagagcaggactctggcatcttgtctagctggagaaactggtttctaggctcctaggccaacttgctggaggggtcctgggatggagaggccaggaactgaggcttggctctgcctgtttgctgagctgctgacttttcccccttcagtaaagctacctgttatctgtgtatctcctggtcttttacaaagctgattaaaccctccaggtacagttttaggacctagaacttttttttttttttttttaaactttcccaaccaaactttgtggtgtgctggaagtttgtcttgcttagggctaatcattgggtccttgagctgggaaggagagtggaggaccctcttctgctcactgaaaatggtcctggtataccttttctgtccagtattgttttctgcccagccacaggcagacaagaggactggcagagactgaaaaccaactagaatttccttgttcagtgcttgaagtcagagccacagggtccttatcccccatgttcattgcatgctgagacctacttattttctagtcttgaattggagtagacagggtggagtgttatgtcttctattttttctaaccccttctcagtctacttccttctgcaagccagcagtgcataaaacatggccttccttgtccagctgcctttcctgattggctaaggcctctctgccactccccactgcagagggcttattatccatctgactctgatgaaccaacctcagctctgtgttcctcatcctgccttaaattctcaacggcacctagaagatctccaaacctgaaggagcaacacaactgtgcttgaagggctttgcttccttctgcagttagttagcacacaccctgttgacttgcatgttgtcaccacaggctaaacaccccagccctctgctctctacttgagcaaactgaaatccaggaaggtgaaggattcctggactttgacctgagacctacacggctgttggtgcaggttcatcagggtgagatgcggtgcgctactcctgcaatgcccacacttaccatgggtatggggcagggcgcctagggcaggccaagggaaatacacacagcctcttggccccaccgttttaagatttatttatttatttatttatttatttatttatttatttatttaatgtatatgagcatgctgtctgcatgcacactagttgagggcatcggatttccattactatggttgtgagccaccatgtagttgctgggaattgaattcaggttctctggaagagcagtcagtgctcttaacaactaaagccatctctccagccccatcagtggtcccacttctgcccctagttttcttatatagaagctgggatcactgctgctagagttgccttctaaagaggtccgactgctgcaccatgtctggcaccttgagaaatccccacttctgtagggtgaagccctctgtgccctttcctggagcctctaaggtcctgtggtctgcatttgcccaaccacccctgtctccccagcatgaacagaaggtctccttggagtttactcagtacattactgtgtctttgcataggagcttccttctgcctgatgtaacccttgttccttctttgagtacaggtttctctttatagctggctaccagggcatttccctggcaaatacctcctgcctcctcaaacagaataaactgctcactcttgtgtcccgttcatccctttcagagccactagataagagtttgaaaccaatgtcttcagcattggtccctagaattccaccctggccacctgcctccttcaaagagaagaggccaacaaaagaacaataaaaataccgtgtgttagctggtttcctcttactttttttttttttttttttttacaacccaataaattggtgccaaacctgcttctggccattttcctggaggtagtcannnnnnnnnnnnnnnnnnnncttctggccttttcctggagtagtcattgtcttcttggaaactggcgccagcctggggggttgatcattaacagattgggggttggggagagcttgtaatacaggtagtgggcctgagggtgcaccccaagtgggctgtgtcaggagctttctcttccttcatgagcctctttcctgtgggtactacatcttgcatctttgcatgttttatccaagagaggaattcacctggtcctggcctccattcccctccacctaatgaaagcaaatgctccttgtccatgtggccattagcgtcaggtgacagggagcccagggggagcagcgggtgctgttgtagtgctcttcctcctgtggggggaggcaggggtgacctactggacatgaaccctagacctgagaggtgggctcatcgcttagaagggagtgagaatggaaccagttattggagccctgtttcttcacctgtcagtttggggtgaggaaacttagcattctaaggtgtgcctgacttaccctagaaggggctgctcgccccctcctcactcttttgctcctcacttgctctccccttcctgcttctgccctctccccattccctccccaccccccatacctcctctacatactcatggnnnnnnnnnnnnnnnnnnnnccccccccccccctttttactactctgttaactccttggggaagagatgcctcagcatgggcccaccaaggtaccctcttcccccatacctgaacatacccccccctcccacacacacatctttttataaacacatcagaaacagcccttacttctctgggttgtcacagggaatggaacaaaggtaccaccttgctgcctgtttgcttccttcctggcccttcccctgctgggagtgctctgcaggagttgaggtggtgtttttagggttcacctggctcttacacagaataagaacacttcctcacagaatgaatcatggggccaactgtgcctggtgtgctgtcctcccccacctttccatcagtacagttgaagggtattctgtgtgtgctgttagtagcagtatatcaggcagcacgtggtgccctgagaggtgtcaccacctccagcctggcaagaaggctgcgatggcccctcttttggcagtcctgctctgtctgcacgcatgtgcttcttgctgagcatccttccctggatggcagactggcagagctgcttggaaagctctctctctctccccagccccccaccccacccccacccctactttgggggtgtgaagatgaactggtgtgactatagcttggtgttttggtgtctgtgagaaaagcagaattggctcaagctgctttctcagttaaggggatttaagaagaaggagaaaaaaattaatcctaccctggtgatcaatctgacaccttccctttgagccccagatggcttgttggggtagaaagttggccacggctgctgtaagggaaatgaatggtgtgtctctgtacgttggaaattgtggctctcagttacgtgcacacatttgtgtgtgtatgtgctcgaatgtggtgtgagtatgtatgtgcagtgagtgtgtgtgtgtgtgtgtgtgtgtgtggcatattcccagaagtttcccagtagtaagtgtcatccttggaggtgtcagtcaggtaaccctcgctgatgcatgttcatttgccttggtttgtgcctctctcctagttcttcacctcctggaggggtctgagctaggtaggtggtttggaagatggagacacaggcctagctatttgtcccccgtacaaacagggtcagagctcaggaagtagaagcaaactttctccctgttcttgccctgccatagcctcagccttggcaaacgctgtccaggtctacacttgtggctgtgccttttctttgagtaaatgtgcttccagctattcataattatattttaatggctacataaggttttattgaagcatttccttattggctagtcctttctgcccttccctcttatcctgcactctacacagcactgcagtgaacacctttgcagttcattctccatggcttccttggggtaaatccccagaagtgactggatgaggaaggatgggctcatttcaaggcccttgacttatttgttacacagacacaggcagtacagaaagacttgccctaactgtacttttactgtggtttagctcttcatagatactgttgtagctctaactacctaccttacacactagcctgcttgcacagcacttggtataggtgaagtgcagtaagctctccgttatcccatattccaagaagtaagaagggagtcccaggtggaccacacgtgaccttgatccattgtgctggatcaagatggctgcctacgctttctctcagagatggcaaaaggaagtaagctgtggcctagagagcctgactatcaagaaatgagtaccccagggctggctttgtgcaccgaaggctctagtataaaccctgatgcatcattttattcaagagtatttgtggggcctcttgggcaccaagctcagtgggactgggagatggagaagagccagcagtcactccaggcagacagaatcacacacagggaatttctatatgacgtgacagatggttggatagggtgccatggatgatcagggccagagtgacaagctctgcctttcttttgttcttgagattttaaactcccttcccccattcctgctgattaagggaggttaggctcctattcccttcttggccagtacataggtagcttttgactgcatgggctttacacgccagacggggcagcttcctctatactggtgtgagacccagctctacagacttcagaaacaccctttgacaaagtaattttaaagcagaacctaaaggaatttaagttcagtattcttgtcttggcaactgtaacttctcatctagttaactcctgtacctgtgcacttaaccatgtgtcaggtgagggcccagggtgacagccatgtctctgcacgtcacagtgtgtgatgtagaagagccttcttgtggacctgagagctcagtgaaatggggcgccgccctcctttctgattgtccgtgatgcttgtgctccatagtagatcctcagaacttcatttcactctccctccctcccagccctgccaagtaattctctgcctggagactaagtccaggttgggagctggcaaggaggagcctcgggttcatcagggagacctggctactggctccagctcagttccttgttgcctgtctgccttggttccctctgtctcccatctcagccacttggttgcctcctaggtctaaaagtaaaggccctcccactccctgctctggagtttcggaaagcccagctctctgaacctaagcagcatccactccagacacagggcagaggtgatgtttgcagagggagggctgcctaagacctcacactttacactttccatgtgaggccttggacattgactccagggcacaggcatacggttgagtgcggtgtgtcccttgctccctcccgggttctagctgaagataggaaggccagaggcagaacagcctctcaggctttagaggagcgtcctggggctgtgctcccagctgcctcccattgtgctggagccacacggtacagcccccctcccccagatcttcctctggagaataaaccatcagcaggattgattaccctgcaggtccctaggccgctgtctctggcctgcatctggagctgatttctgtggcttgtagacccattgtcttggatggctcatttccacaaatcagagttggctccactgccctaaccctagtgtgaccccagatgcatgtttgttcgtccagtgaacacttcctgcttgaggaggggggaaaggctgaagtgcacatgagtggctccagagccacctccctgctctgatgcagacaggatgttccttcccatcccagcccctccctagcctcccacctaggcctgcctttctgaagtagattcaaggaggatgcatattttcaggaagttggatccatcacctggcaccagaggggagactcacagtctaatagctcccacagggtgtagtgttataaggctctgtgtctcccacaacaaggtgggagctacaagcagcccctggcatgggctaggaggtttgaactaagtcaaaggcggcagcagcttattggcgaaagtttctagcactgtgaggatcagttgtcagtggggtttccttgcacacagagggactcactgagatgtatcactatgcaggggtctagggggactggacacatgctccatgttagcccctttagcccctgctctgggctgggggatttcatgaccttaagtttgtcccttcctttttttttttttttttttttttttggttttcgagacagggtttctcatttctctgtatagccctgtctgtcctggaactcactttgtagaccaggctggcctcgaactcagaaatccacctgcctctgcctctcgaatgctgggattaaaagcatgcgccaccacacccagcaaatttgtcccttcttgtcacagtttttgtttgtttgtatggttgggttgttggttggttgtgtgtatggttggttggttggttgttggttgggctggtaagatacaaagctctcaggatctacctgtctgtactctccagtgctatagtagggcacaggtggccatgcccagctttttgtgtgtgtcttcatgcttacacagcacgtgttcttacccaccaagttgccttactggtacggcttgtgtgctgacaggaatttagcttgtcctccacttgaagaccttagaacttgactacaatgtgggctccgggtgcagaaggcctgttccttcagtgcagtgagtggcctctctttgcctctcttcccaatggtgatggaggatagaagccaggatggctcagccctgtggctggctgactcacttctgattagggacctgtgtggccagcggcttcctgccattgtttccacaagctctttgcaagctcctctgtctttacaagctaagctccacaacaggtcctgcgagttagggagtcccaagagcacaccagcacccagggttcttcaggagctgcctctggcattttgggctcatcctttctggcttttgttcaggaaaagagagccctttccgtgggcatttgagctgccgtgtgtcgcatgtagcctggtcctatctcagactctggagcttggtggctgcccatgatcagaccttcactttgctgcccccttctgggacaaccagctctctactcagggaccgcctttgcctgaccttcctcaccccaggaagcagtatgtccagctgcagaattcttattgcttgagagccccagagaaatggcactaggggtgtatcccttctgcatactccttccaagaatgaggacacatgatgcttcctgtaggtgccatcacccccatcctcaaatccagacccaagggcaggcaggcaggcttatcctacctatccaccaaaacctttctccttggtgagacccataagtcggcctcttagagcagggtgggtcactggcttgtcatgtggtgtaggataccacctacagttgtttagtagcccagcagcaaaaatgcaggaacctataaaatagtggagggaaggaggagagggaaggggagtgaaaaggcagagccagaactgcagaccttcagagtcaccccttgtgaacccgacccagcagacctgcttcccacccggcttcttccctccctgtggtctggatccacccggccttgtagattgcatcagggagccacttacccccattaaaactgggagggccagggagggaggaaatgggctagggtgtgttgggaatgttttagctaatgcagggagtgctttttaaaaggcaggtagaattttttctttatagatcaattaaaaacccttcttaaaattagcctctgggaaggtgtgtcagtgggctcttgttttcttatgtcccacactctgcacatcctccctgacagaaaaccttaaattttttctttcagaggtgaccagtgtttttaaatgccaggtgatgaccaagggagagggacctttgactagggttaaagtactgtcctgggagggtgcgtagactccctgtgactcctctgggccatacagctggcgggcagcagcaggcacgaagaggaacatctcaccagagccaggcagatggtgttcacctgctcgggacacactccctggtccggggcccttggagttgctgagataataacagacagctgccagccctggacctagatctgcgggcattcaaaggcatacaaggtgcagggagacagagcctgcccaggcctccccacccgccaggccctgcttttgtttgagagttgtgagcccctcctttcccgcaccaacatccgagcaacaagagcgctttaatggaggacagttctgttttggaaacgacaagaaagctccttgtcaagtgtgacctggcctttcctttgtcttgcctcccttctttgtgtgtgtctccaatgggttttgttccaaggggcaaaggagctggacatggatttggtgtgttcctgcggtttttctttctgttttcttttttggcagcagctaaagcttttggttatttctgagtacaggacaattggggagttggggattcaagaccactccagtgtctttgagttactgagtggtgtcagcaacagcgagtggcagagaagccaactttctgaccgcctggagatctctcagctcattgtatatgtgcgtaaggacaaaaaatttctcatggccttcagtccataggggcatttgcccaaatatcctcagaaggcaaggctagctgtttcagccagcactctgccctctagctgtgctcaggaggaactggtattgcttggttaccgtgttagcctcctccactgccaaataggtctgtgctggccaaggttatctggacctggctccatccagtgtgggcactgtgaccagtgatattggggggtgctgagaggcaaaattggatgttacttcccccagggcaggactcaggcctgactccttcaggctaagactcagggcagcttagtcgaggagtggtgttaataagattacagaatcagcttgatcatcttaaatgccccagccagagcgctcgattgtgtacctgtgctggcacctctgaggtgtcctcagttgagtcacaggagcttgttctgtgtgtgccccttagggcttgtcagaagagcagtataatttagttgtggtgatggctcagtccagcatttcatctctctctctctctctctctctctctctctctctctctctctctctctctaattatcccaagctagtgatatttgtcttgcatgaacctccaagacagaaattgtcttttattacacgttttttaaagactagggttttttttcttttttaaaggtttattatttttatgagcattggtgttctcttcctcaatggcttcgagggcacagagcctcaggagccagagttacagaccactgtgagctgccatgtgggtgctgggatttgaacttgggttctctggaagaacagccaatgttcttaaccacacagccatctctctagccccaaagagtagtcttaaatgggtatctctcagtccagctctctagggccacatagtaagaccctgtctgcaaaacacacaacaaaacaaaactgcaacttaaacaaatctctgacttactagaaatcaaaaccccttctactcttctttttattttaattattgatgaatgtctctggtgagacttttgactttttttttggattgagttgagcttgaaaatgtcatctaatgtatttttacaaatacaggaagaatgagacagacagacagacatacacacacacaccacacacaacacacaacacaccacacatgtgtgcaagcctgtacgcagtatgatctgatgacagtcagtaggcctaggtgtcagctggggagcggcaggaatgctgtttgatctttgctttttggagccccagggttgaaggtaagggcagaaaagataggtacagaatagcagcagcagtcctcaagatgtcagggtcccggccctcgctcctcttatagcttgcctccccacttatctctggtgacctaggtaagagtaaaaatggctggtgtgtttttgtttgttttcttttgttttgttctgtttttaaacttctctttgtcaggctggtttcaagtaattcagcacttgctaattatgaacctggtgtcctggcctgaaaatccctgcctgtttgaacttgcagcttcccagttccagaagtggatatatgctctttgataccagcccatggcttacaggatccaaagtgtgtgtcctcacactgctcccattcttacttggccagtgtgtcatgtctactgtctgggcagtgtacaagcacaacttgcatctataggaactatagaaacgggtggatggctctaggaaaatatgaaatgaaccagactgtggccagtctggctagaaggatgccagcaggtagtgacaggtagagggggaactccatcagtaagtttgggaaaggttgctgaggaatgtacgtcatattccactgggacataggtcagcatattcacacatagggaggataattgactgtcagttcatgggaagcagtttgcaggtaagagccctgctaggcaaagaagcagatgagggttctaaagtgagggcttctttcctgctatggttggtttgtttttatcaagagtaccgagtctagggttcccttgcttctgttctaagagcaggcgtggccctgggcaggaaaggaactttctgctctcctgatctgtctccacccagagatggatctaaactgtgctttccccagctgtgacatcggaaagcaggaaatctaacccctgggatgtgtcctaggtaggtgctgtgtcccttaagaaagtgaagagggaccagttaccttgagacaaaggcacctctcctagtcagcctctgcttctcactggtgagagagggagggctctttccttctcagttgagaagtcgtttaaaccagccaaggtggtgcctggtctccatactcaggagactgaactaagggaatcccagatttgaggccagcctgggctacatagtgagatgtcttaatgacaacaaacagtatgtaatagcctagaagtccatgagttcgctccttcatggtgatggtggcactattgtttttctgggtgttgtgaatgtgattatctgtgctgtgtgagacctgcctacagtggcagacctgggatgttctctgacaacacccactgttcagcctctggcctttctctgatagcctttctgcctcctggcaaacataggatgatacctacctgactgtggtgatgactgagggagcctgtctctgccctcttgctgccttcgcctgacccttggagctgttgcctagaatgacctgcccttctggagccccgcctgttctcccctctttcacatatccccctcccccaccctgccaggacataattggcacttagagcatgaccatgagtagcttatgtttcaagtacgtgaatcctttgtagcaagggattccaggaagcaccagtaggacagtgaataaagaaacaggatttgcccagtgagtggcagacctgtttggggctgtttggcctaggactttctctgcactttactgtctgtacttcagagtgatctaagagctgaatgagaaggtatttgcagagactgcacaggttggcaccttaggtattgagaagtcctggtgaaaatactcgtttgtgaaaatactgagccaaggtctctttggtggcaggacctgttctatactcctagagctggataccaaagtgggtgctgtcaaggttcctgagcagtgacactagtgtggcataaaggggcataggccacagcaggaacatgggagagggagagcagtagccaggggagcctcgtggcggaaggcgtccccacctaagcttgtcttgggtctcatggctcacagagccctcctggacagcaccctcaccctgtggctcctgttagagctctctctgtgattagtgcggtgtacctcactcttgcctctaattgtgtggtacagcgtgtgccttattgtatcaggatataatactgttagcctggcagttaccttgttcactaattgtttcgtgcatttatcttgtcttctctgctgctccttttgagaaacaggtactgtttctgtgactctgatctctgcccagggcccagaggcaagggtgtagctgggcaccaaggagcctgctctcagggccccggtccaagtcctacatcggccaggtggatttgctctgtggccttttgttctacacaagcttggtctgggagcccctttcagctctcttgctttctagtgtagtgactatgtctgttgcttggagccatcgcccctttgtccggccattgtggctactaaggctgactattagaaggtaccagtgactgaggcacatgggattttttttacctcagggtctaaaagaataggaaatagatattggagacacagcctccacttgatgcttagttgggagccacatctactcagtaggtgtttgaatacattttgttcagcaccaccactgggtaccccagtgagcaaaatggaggttcctttggttctgtcctcacagtcaaagccaggagtatgctcttacacacacggtgctttgggggagcaacagacacaaaagagaggtctgctcctctgatcatcagcgctctaagagactccagaaagggatgcaccaagtctcgtgtatcccaccttaggcagtgacccaaaagtgaggtgattgtctatattctttcttttttaatacatgctatgaggggagggactaggcaagattttaaatcaaaactagctgaaggcaatatcatgggtgcttgggagtagggcagccctggcatcctgtggctgggtcaccccttagaattctgcctctatggggaaggccctgggacccagggtggcagtgggcgggggtgcctgggcttcccgtctgctcagcctcgcttggctctgaatggattagttctgtttgggttagagcttactgtggtgtgtgctttttagccctctcctgtgttggctttctcatccagacacctgctcaggtctgtgagccttaggagcagagaaggttccagtgtggctgagagaataatgaagtagccattatactaagagaaaggggcactcaattttgcattcttttgggttttcaggactgctataattgtagttggacctgagaagtgtctggactccacagaagttaaaggggaagtgtcctctgtggaaactgaggggagccagtgttgtctccgggactgagacctgcctggaacacagtgccccataggctagtttgtgctgctaacccggggagatgtgactttcttgcacgtgagatttgtaagtgggcactgattctctctgggcagatggtcctgagtaaagcttctgctgaaggagctgttggcacagaattactattatgggcactgggacagagtggaaagattggctgtgctttgctcctgaccatagtcagggatctccgagcctgtttccccagtctgtcaagtggaaatcattcctgccccacagagtttacaggcataagccactcagtggcctctcattgggtaggcagcggtattcttggaggtgcaaaagttgtcatttctggaatgccatgcctgttgcacagggcaatctggtcagtcaagagtgttggtggaaactgcttgatttcatgaaggggttcagggagcctcggtaaggtacaacaactcggcttccaaatacagaaatgtgttgtgtgactcttcctaaactcctcagagccttgtgagagaggacactgtaagcctgtcagagaggcagcagccatagctgtccctcctggagtctacattctaactagagactcacacatgtggaacaattagagaaaaataacagatggtgtctgatcagatatcactctctgtgaagctctcccagactgccccaccctgaaggagaaataatccttccttttctctggtatcctgggcctaggacaggcccgcgcaacactgtatcacatcggttgtaattggccatttatgcaacagcaagcgtttaccgagagcctctgcaggccagggacctccttgggccttcctcatgtcttcgatgacacctatgctaggcccagagctatgttaactgaggactttctactctcagagctggcaatgtttatgacgtgttcaatgcctatgactgtctgtctgtctactttgagatagtgtcaggctagtctaggctggcttgaaactatgtaacccagctttgtctcagacccccaagtgttggtgtgaactgattagatgaattcctggtattggggttctgagatttttgaagtttcttttgcaaataaattctttaatgtgttggaccccattagtaaggttatagagataaggagatactgtttgctttctgctgtcctcagcctatgcctccatatgagggtctcatatcagatatttacattacaatttataactagcaaggtaacagttatgaagtagcaatgagataattttatggtgggggtcaccacaacacgaggaactgtattaaagggccatagcactaggaagttgagaactacctccctatctgagctggaagaagagatagcctcagccagtgttgatagtgtatgaaggaaccttgtcgctaatcctcgagccctgagagaagatctgtcttagagacctagcagagccacatgctatgtgaacctggaagagaaaaaggacatgcaggtgggtgcctgagaaggcagagagtggtggaacattctagagtgaggaagagctagcgcatgcacgccaggccttggagcaaggcaccctgcgagtatctggagacaattcagttcagagcaagctcagtgtagacctggtagtggagggctggccaggctgatctagtgctctggggagaagagttctgagtaagccagtagcctgagttggctctttctggagaaaggaggaggctgacctggtaggccagatgttcttgtgtccaagagcgtgggtttgtgaattatcgtaaacagccccaatttaataaatgttaaaaaaaaaaaaaatgaaggagccacctctccaagtctcccagaggatggcagtgtgctagaatttgaggcaccctggaaaggttgtgggcatatatgactcctgctatagaccttaattttccttttggtggaaatggcaggtaggaatagtagaccaatggagaaggtgtgtttgcacacccccatgactgccacctttgtttccagggattggcagctcaaccgtatagggcagggtgctcccttcttggcaagtgaagtggaaaatgccagtgtcttgcagtgagtcccagtgggtgtagggttgggtgtgtgtgtgtgtgtgtgtgtgtgtgtgtgtgtgtgtgtgtattctgctgggtgtgcctcccccatctcccttggacaaggcctgtgtgctggcctggctggcaaactgcctggagttcttttataaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggtcatagacaccttgggaaatgctgatccagagctgccttgcctttgactcagtatgtgggccaagggatcctcccatctccttcctgttacatagttctggattgagtttctgaaggcccatgcattgcccaggtttaattaaaaattcttgtcttgggtggagaccatgaccatgagtagagttagacaaaaatcaaaggaaaacaacctacaactgggcagttttgccacagagtagggagcttggttatcagtcggggcccagtctgctgttcctgagttctgggtttcacaatggtggagaccctggattcagctactgttttctagtaaccactgtgacaagagaacaaggactcttacaggagtgatgttgtgtttgcctctcttgacagttgggcttatgcaagtatgttctgttcatgaaattacatgtttataaagaagaataaggaaggagagcgagagaggtttttttctttctttgtttgtttgtttgtttgtttgtttttcttcagaagggccaggctgagcttgtccaaaaaggtcttttactttggctagcacagggtagggccagtcaaggtacatacccttagtcatttggtgttcagttgttatcacatgtagcaaacattgagacctgctttgccttttcggagccagaagattgtaagaaggtagcctctgtccctgtcacatggccagctaagaactgctatggcgttacaggaaggagtctcatacagagctgaaacagtctcctcagtgcccaggacagcctaagaaaagtggacatgccaagtagagtccatggcatctgcagaagctgggcactagcaagatttccctgtggttgcaagtaaggggacaagaagaaaaggagggcagattgggaggtggaggaggaagagctgacaagagcacttggcttttcagcatcctgtggatctgctgttcaagtcctgcatcacggggcacactgccagccagagtggcatgcccacctctcataggtgagcagcaggggctgcaccgccacctggggtcggcatgttctctgctttcagtgctgcgtcaatttcagtgtctcagggcttcccatgaaagagacacaggtgggactcggcatggcttagtgttgaattctgatttataatctttctcttcatcttctggcctggaaagcaagatgtgtatggtgggtgttgatggaaggctgggagttctgggaacctggaaggggaggaaaagggagagcttgttgagcagaggctatgagagcagtggctcctgggttgagggattgtcaccgtctcagatgcagttagtccagggataggtcagagtaggatgcaagctagagagctcagtcattagccagcctccccttcccgctgtgcctccgttgtgtttggtaagcatatcatggtgtatggtggtgtatccccgccaagctagctctaggcatgctctgtgatgcttgtctcttgtactttggcttagaggatccagctgtggacagtgatctcaggcttggctaaggacttcactgcagtggagcacgttgtctgggaatgagcctctgcccaggccaggagcagcccctgtctaccatttctaggctccacagctacctgtagcttctcttgatctgtgtatgagtcccatgcgaaagtgactctttaggccagcagaacagaaggttcttgatcgagaacctatctgagagtaaacagcagtctttgctttgccaagctgggtcaagatcaggagagacagtaggtctcaggagttccctccttgccactcagtctctgaaatgtggcctgtgtgtcttctctctgtactccttgggtgtacagacactttttccggacagttgaagtctctatagttgtcttgagaattcagcagtggtctttgctgtagtgacatgaccagtgactcggagacatggtttacctaagtcatttggtaggaagctctcatcaatagcaacagcagcatctagacattctcagatcccgagttggggtatgcctaggagcagtgtgttctgagaagtgtggctgtgtgcagacatgtatgtgtgtatggtatttggatgagggctagcggtaagttagaggaagactgtcgatttaatcttgtggatacagtacctactcttgctaggcaggatttctgcaggaattttactcacccagataatatttactgagacagcatctctgctccacaaaccacactcaccatccctgagatgacagctggctaatttaataaggaattaacagtcaggtgtgacagtcgccgtgctgaggaacacagggaagatgaggggcatcttagagcagtcttatcttcagtttatgtgtgctacacctggcagatcccaaaacatatccacagataacttgattgatagccttcagatcatgctggatccagaacagaagtaggaaggaaactggtcgtttgtggtcgtgcctgaccctttgctttgagagcagaccagtctgcactctctatgagactcctgagaactggccagggtgaatgtcctaattctgctgaacaggagtgtggggtctcctcacagccgattactacgccaacagaattggagacacgtggaatggctgtttggcttctagggaaacctgtaaatatcagagctattgcctgttttgcgcgcacgcacacacaccccagagtccatcattagatgtgtgaccattgcctttcctcagtgccactccttttagtttgtttggagccctgaatagctggaaaggcgattacaggcgacaggaccagtctcttcggtctagtccattacagccagccaaatagtgtgtgactaggcctcaaggagattggttggctcagtgtaggaactgagagggctccctcacaatgtgactgctcacaaggaagaggcacccaggccatgtggtatttgttggtggtgtgatgttctttgcacaaagactgagtcttcacacttggtgtgacctcaggtcttgccccttagcccttcattctgtaaaacaagagcttggggctctgagaaggccagagtggccttattcttggtctcccgcctgtttctgtcagttcccatggagctgagctgcaggtgttgggcccttttatgtctgtctgaagatatgatagagggaagaaatgtggactttgaagtcggatccaccaggctggagtcttagactgctacttgctggcctgccatgcagcctggggcaggtcagctctctgagcttctcttctctctgtaactcagggaagctaatacctcaactgtaggactgtagagaggatcagagataagcacattaaaggccagacttcgggaggtgcctgctaacatgtcaactgttgctgtcttgtgtgtcacctccggggggaggagagacttagcataggagcctggaggcctcatctgtaagcccctcattgcagcttcgtgcccacttttggctcctgccttcctgctctgttgatggcagtgcctgtcggtttcttaggctggcttcacagtctctatacaaggccctcagtggaggccctcaatgtctctgcctgtacaagagccaggctgggcctgaagtctggtcagaagggctatcagtactagctccacccggcagctgggttggaggctactagagtggacagtagcaggcaggcactgagtgcccagttcctcatggtgtttggtccaatttcctttgcattgtgacctacatcattctttatttgctaaaccctctgagcaggcagcagtaataaatcaattaatgactccgatgaatcgtttaatggctgacaaaataacactaaagccaacagcttgcatctctccagcagtaccaaaggacgctggttgatgggggcgggggggggggcgcgacgacgaaacagagactgttagcgaaattagcccaattagttgtgctttaaaggcttaggaggcatctgctcagctctgagcttccgagtggggagtggggcatgcttgagggctggcagcatgaaccgcagtgggcggctcctcatggctacctgaggccaggcaagggagcccaaggattccagtccgctctactgtgcagaagagaccagggtaggcttgagctgtacactccttccccacccatgctttgctatgagggaccctggtgacgttttgcaactgaaaagcgtcattgtgtcaaagcagaggatgaggaaacgtgactctgaacctgctgtattgagtaccagctgaggaggcgtgggctcccatccttgaaagatatgtggaggactttgcctttaataactccttttaaactcgaagcaaaaagttcctagaggcaatggcttctgtttgctgtgtaccttggtcccagtaggattaagttgtcattggacctgagctagtatgcaggtccacgccagggaattttccactctgcaggagcacctgccagccttcttgttcaggagctgtcactggcctactgtgacatgtttgtggttgtaagtagctctttaagacagcaggcagtgtgtgcatgtatgtatgtgtgttttgctaatggcgtaagtgatcactgtacacagagcatgctgtacgggatccattgacctactgcatggtattcatccaggggctctgctctccctcggcctcacagcctcgtgtgcatggacaggctaagctctgcctggtgcagcccacactacgggcttgagagagtttctgcttacagaggagggcaccctggctagcgtccaaggcacaactgggtggctttagcaacctgggactgtaccccttaccacgaggcaccttttgatccagttcccagagtaacctggtgagtcctaggacagatggaccagcctgcgatatggtggccttctctctcagtccttttcttttgaaaaggactaatgtgcctttcttttatcttgtttcttttcttcctcctgtctgtctgtcttttttcactcttccaaggtggccactgaggagagactacttgttagaagtgtagctacttgagagcagaccttcatctgtcttcccttcagtgcccccctcctgacatacccatatgtcactctattcctagactcccctgctcacgctgtgctcagtgtctgggatcccagctacttgacctaggcaggaggatttcttgagctcagaaataggaattcaaggccagcctggacaacagagtgaaatcctcacctcacaaatgagcaaatacatgaaactcagaaagctaggcctatctgtcattgtccacttctgtatcaggctcagaaccaccaattgttcagcacctgccttgccaacatagcaagatgccttacctgatagtcccaacaggggcccagacttccattcctctgtgtgtaaccatgaatcgccgaatgaggacatgtgcggtgtacaggtgttcccagctcctggtgactcaaaggacagtacaggcctgtatttagtcattcatcccaaactgggaggagagaagttgggatttaccaagaccagcggcatggatttagcctgtcagggcctgacccgtggcattgcttgttctgagctgtaagaccccagacaggtcttatgtagcctgcattttcttacgtgcagtgatagcttactaaagggccaagagtgccagagagtgtagccattccaggcctggacagctgttgccctctcatgtgaaggaaggttagggggaagggagcccttgtccatgtgaagatgaaatggtcctgcatagacagagagcactgttggaatcccccctccagcctcccaaaagacacagcaggagcctgtgctggaagagagggttaagatgccagctgttaatctcttgcaggtgtcatctttgagttctgctgtcctgtaaggccctggcttgagtgccacctcttccttaaagcctccctgatccccctaatccctgcttcagcgcctgcctagagtaccttccatgtccctaagttctctgtcacaactcaattcatcttttaggccttcaaggcaaatccataccctgttagtctccagcctagtgggtgcagtgctgtccaccggggtttgctgagcattcaatgcagcccagccctgcagcccctgtgccttcccactggcttccttttttcttcttctttcagaccacttgcaggttaggtccacaggctctttggagggaatcttacaaacatggtttcattccctacttggcaaagggcactctctgaagcagacagagagggcaggccaagcagaaggtcagactcacagattacctaagtcacagaatgacttgtggttattgggtggcttaatgatctgtctgctggttttcatcatgagccagaaagtgcacgggtttgtttttgtttttgttttttaatctgtctgtttgtttgtttttgtttttgtttttgtttttgaggactgcttcgaagactggtacttgggtttcctgattctgaaattggatgtggagggactaaagttagacctaattattaactgtataaccgtaagaatcagcttccttacagactagaccagaaaggacaccttcctgggttgctgggaaataaattcttcttccctctcacctccctcctggtttatgggatcagaatggaaagatgcttgcttctctggccattcctgagttagtccttagttgatgagataggatttttttcagagaagagcatgtcttggctctactcccttgagcttagtggcctggctgtggctggtggccctttccacctgctggtagcctttccttagttgcttgcaggaagggctcaggtggcacctgtagtggcactgggatgacagaaccctcctcagccttatgtgccaggtgctcatgctttggaggcctgtctttatatttggatgtgcgtgctttatagccagagccaagccttcagcacccttacttattaattagttcagggatctaaccgtgatcatccccagaacaccataggtgacggtaggcaatatgctagtttctttttgctctgtcactagtgagcaacccaggttaccccgcccagcccagcccctccaaggcaaccagttctgggacatagataaaggaagctttgtgtaatttcattctgctgttgaacactgtcttagtgaaggtttctattcctggacaaaacatcatgatcaagaaggaaagggtttattccatttacacttccacgttgctgttcatcaccagaggaagtcagaactggaactcaagcaggtcaggaagcagctgatgcagaggccatggaggggtgttacttactggcttgcttcccctagtttgttgagcttgctttcatatagaactcagactaccagcccagggatggcaccacccacaatataccctccccccttgatcaccagctgagaaaatgccccacagctggatctcatggaggcgctttcccaactgaagctcctttctctgtgataactccagctgtgtcaagttgacacacaaaaccagccagtacagacacagagccgattcttggtgctggacagacatgttcacactcttcccaaatactggtgtcctgcctatttcaagtcaggtactttatgttactgggacttgtttttgacactagtttggttttatcttttcatgtaggtcatctctttgatttccctgagttgcagaatttaatatttcaccaaaatcactgtcctgttgtctgtctgggagactttttttttttttttttttgcatattatcaatggctactgctttggtcattgcctttctgtggaacatagcattttctccaccctttgaattcctactgtgcatcttcagccttcttgatactgctcgggtggcgcaaggctacctcagaactctgcaaacactcttaggacctgacttgctgggagcagcataggtctcctgctctacccagggggcatatctgccaggaccacacttacctttgccactttcatttcctggccacatccaggacaccccttaccccctgctggtcgggccctctgccacatggcctgacttgtgtttcagttcaagaagacttgcagttggtggtttcacacgtggctgtggtgctgcatgccaaggcctaggtgttgggcaggggaagagggaaggattcgtaaacaaaatactatttttgcagccttataaatcagtcaggagttactggctgagctaggagagtccagagtccatctggctacttataaaaataaattattttacaagggcaggcactacagcattcacgtggaagtcacaggacagtttgggagaattagttctctctgctccatgtcggttctggggattgatctcaggtgtcaggcttggcaaaaagcacctttacctgcggaaccatattaaccactcacgagtaatgactttattcatttttcctagagcttgatcagcatagatgtaagaatcaaccaatctaagtatatttgtatatgtgtgtgcacatgcttgtatatgtgtgtgcacacacatgcttgagtattttctcctttgtccgtatgttcatgctagaaggtatgctggagaagaaggtctggggtctagaatccatatgccagggctctgagacagacaggcctctgggtgcttttttaatctctgatctctcagtgtcctgtcatgagtgaagagatagtacgcaggaggctgacactccgttccacaccctgctgtctccagcctcatctttccagtgtgtatggaccaggatgggcagaccttaggaaacagacttcccacatgagaagggacctgactcggatgtgagaggtcctttcggccttgattcatgtgtggctgctgcagcctaggcagctctgcagcctagtatgctgtcgccctagagaaggtgccgagggtttgggtttgttgagaagactcacaggagatgctttgttgagtgctttaatggaactctcagtgcttgaaaccacaggcctgaaaggtctggctccaaggtggtcagctttgggcagatccttgaatatcaacgcaatcatttattgaagacttgcctcaccttgtgctgcggtgtgggcgcaggcaagcagctcttgtggttaaggcgcaggaggatgagtgcaggtcagcctgggtccccttggtgagggtctgtaatagtttgtcctgaaccctccacagtcttctcagcgatgggctctcagcaccagtttctgcttatctatccttttatgccttcattcttgtatcgctgaggcacagcaagcccccccccccccccccgcttgcctgtggagaggcggacatgatagaaatcgtctgctacctcctgcctcttcctcatggttgacatggttgtctttgttgtcttccattggaggatggtgaaatactgagtccatagttgccctggcctgtgtcatgtacccctagtgccctagtgagcacatgtacacgcacgcacgctagcgcacacacatgcacctgagttcatggtaagccatatctgaaagggaagcgcagtatactcagtctttcatttcaaagtttatgaccccccgccaactgtaacaaatacctcaatatgtaaaaagtcaaaactccaaataacaaagaaatggaaagtagaactgcagttgtcagggcaaggcacttcaaaatgtagtaattcagaataccaaagatcccatcaaattagcagagactctagatctgctagtcagggggttacttcaagctgttggtgagtgaaggatggagttcagtgtagtacctcttctggaggaacccaagagacacatggatgtttatctcggccccacctcttagtgttcttttgctcctggcttggagaagtaattgttggctgttccaaaaattacaacttgtcccctaggcaggagatttgcgatgagtttaaggtcagcctagtctagttgtgagttctaggccaagtggagctgcataactcaaggggggtgggtgtatttcatagaactcttagccacaataacacaactcactcctgagcccgctcattcccctttagatcctctcccagataaaggcaggactggggtgtggctgtaactggggaagcagatgcaggcctgcagtatttgtgattaggcagagtctccttagagagggtctgttggccttcattttgaaaataaccagcagctagctcatgctctttacctgggacctgccaggtaaccactgtattcctctactgggtcctcgttctgtatcaagaggacgttccctgcctgcagacctcagtgcctcctagcacccagccctcacactcctaccatggggatacgacaagtcagaggccagtggccatgggcattccacataaaccacagcactcatttggtgttcattttcttgtactgggtatattagtgggagtccgtacttctattttatgtcaaggagaggaaagaagtgacttcctggagtgacaagaaggggccagtgatggagcatcatgttctgggtcatgatggagttgtcagaactaaggctgggtggaagtggacaggtgtgtatagagatttagcttgcataggagtagcagggaacacactctggtaggaggcccaggtctgtgacttccttaaggcagggctttggcatctcagcctcaactctgcacatgtaagtacagagccaggcatagatgtgctgactacacatacagtttggacacaattgttagaggtggccaggtgggacatccgatgcctggccacccctgggaggcatttgttgaggcagacgtgccaagtggctgctaagacagcaggattcaacaggaagcgtagaggctatctcccatggtggaaaccacgttcttctcaagaggcattgggacttggtgagggtcagaacacacatcttctccatctaacctggacagtttcttagtggcctgttatctgtcagtaatacttattgacttgctctgtgtaccatgtcagtgatttggagagggcaccggtgtttatgagttggtcctcctgcttcttagagcagctggtggaaagtcaggatatggcgtcaaccatatccaccggcttggctgcacatcatggctctgccagatactacaggagtactttatatgccctgcagagtgcctaatggtagacagcggcctctactctcatgttagagatgaagcagtggggccccagagtccatgacttgcccggtgaataacacctctgcaggactttgtatagacagtagcctttggggaggaagggtctgtttggggacagggaccaaaagctctgtgtgtggttggatgtttgccgctgacctcctcgttctgtctccacagagtgcagcagctgccccaagccctgtgcttggcaacattccccccaatgatgggatgcccggaggccccatcccgccaggtttctttcaggtacgtgctggcccggggccctgtgctgggcaggcagggaggacaggacaggaaagcagcttggtttgccatggtttaaatacagttgctttgtgctggttgaggccctgcactcttaccttgtccacttctccaaaagctgcagaggggaagaaagcgcttgggaaggtgtctccttccaggcatgctgtggccgtacccttctgtccaccctggtgttgtgggaagtcagtgcttccaggccaatgcggagttgttgtttttataacaaaagctgtgttctttgtcttccctgtttttaatgagtaaactgtcctttgtttctgttctgttgctcctgtcttcactactgctcacttttcctgtccaaactacaaaccttaggcgtaactacaaaagcaaaccccagcgtcctggcaagcctcagcatcctttcactttggttagccactgattctttccgagtgccatcacaagcatctccccatggcatctgcatctgcgccatgcgggcaccctgcccacggggtgggagccccgacttctttacagcacaccttgttggtctttcaggcagggataggggtctgggaggtgtgaaatcacctttctgttttgtcagggttaggtgtggcctccacaccttcttttccatcccctcccttctcttttggggctcatgcctcctctgccaggctggggctgcggcgtgctgccgggcagtcagtcagcctgcaggctgggagagggaggctttcctgctggggctttttattgtgacagcatcatttctttcaaacctgtcctcactgaatttgaaacgcacttgattgcccacaccttctgaagggtaggtctccagacaaggttgtgaagagaattctcacagaagcccaggcaggaatgctgagttggaccagagaggcctcatgcacagtacaggatagagccttggagtcatgagaaaagataggattggcacccatgggaacgtcagggctcctcttcccctttcctgggaggtgacttgggaggcacttctgttttgcaagattgcatattttagttcatggtaaatctgggaagaggagggttagggcacatactcaccaaaaaaaaggaccttggtgaaatttgctcactccataaaacagaagtagctgagtgttgatcagttggcagcgagaagagagatatagggacgacagttcaggacatcagatggccacacatatatctgcctgtgtgtgttgccggcacgccaccagaactggggccatgtctaaggtatggagactggaacggcctcagaagtcttgggttaagagtacagacatcaggggctggtgagatggctcaatgggtaagagcacccgactgctcttccgaaggtccggagttcaaatcccagcaaccacatggtggctcacaaccatctgtaacaagatctgatgccctcttctggtgtgtctgaagacagctacagtgtacttacatataataaataaatcctttaaaaaaaaaaaaaagagtacagacatcagttagagaggctgacagaaatcaagagcctaaacccccgggacctgttgaaagaacggcaagagctccccactgctgttctgctcggtgtgagttctcgctctggttgaggtatctctgcgtatctctgcacatggtctcacaaatgccctgaaacaggataaatgtggtttctgtgactgtcagacagagcccagacagatatcgcagccacctgtttgcctctgttctaggctctcttaaggataattatggcttccaggcacccactgcaggctgctgtagtgagaggcagggaggagacaattgcagattgtgtttgtttgtttgtttgcacaaattgaatactttttgtaaagttttattttgattttatgcataagagtattttgcctgcatatacgtatgtgttccatgtatgtgtctgatgccaatggaggtctggactcagcattggatccctagaactggagttacagatagttatgaaccatcttgtgggtgctgaaaacttaacctggatcctgtacaagagcaacaggtgctctttagctgctgagctgtctctcagttaatgtcaattgtgcttttaaaaaataggccatgacttctattttggcttgggcctagaagaaggactgggtctgtgtgctgtgtgggcagctcccagcttcctgcttcgctgtaatcctccgtggttaagttctaattccattcatacttcgtgggccctcccctatgacgtctaggggtgtgtggtcagaaagcgcaaactgaatctgccctgatttagccactgccagccactgttacagtgaggtatccttagacgtttgccttgagatcatctctgttccctaggcaaggtgcattgccaagggttggccggatcattcaggaaggttctgcttcctcagcctctgctctctcacaggctctgagcagttcatgtttcttatccccccccacactatagcagtaaagggctagacggctttggttcccgctgggtcgcacgcgccaacaagcatcctttcactgtcagtcagatgaaggaggtaggggtcggccaggcagcaagtagtgcctgccttctgtgatgctgaccacttggcctcggcccctgcaaaaggaaagggtgtctttctataaaggaagacgtgacagcccatttcccgaacagatcatctctcgacagaaatattagcagttgattgccgccctttactgttctaaggcagccactccgatattagaaggaaaatagagatgatatcgacgattttatctgtggtcaacaattgtacttcttcccttcttggctgcagcctagacaggtggctgtgctacaagagggctgtgtcctgggaagccagcccgggtggctgggccagctttatccagcctgtgtcctgtggtgtcataggctttttccaagtcagaactgtaataccagttggtcttaaatttagaaaccagcagggcctccaggatggtcatgaaggaacagctgactcctgcctatggaggctcctcagaaaatgtcacatgggacttcctcaggcttctgactgccatgcagggattgggctaacaatacaagaggccctgtttgctgtcttccctttgagtctaggtttctgagatgggcagtgcctgcctaggcctatggagtagtgtgagataggcctggtcatttgtcctgacccagtcacacttcatgattggagataccgtggggtttttggaggccttgtagagtctagccaggatagttgaactctgtttcttgttatttaaaagaaaaagccctaagtatagcagctgtagcacctgtcagatatagagtgggacacagcacatgtttgaactgagtttgtttgtggtgttcatggtataggacagaagcctagtcagccctgaagtgtcaacctggaattttggccactcgaacgctaaccaaaggctggcttgggcattcaggactggcactctggagaagggcacagaggacttggccatgtgcttgctgagtgaccttggaccagtgctcccctttgctgatcctagattttctcatcaatagacggtgcaggctggagtagatagtcttccaactttgattttctgcattaaatccagatggactttacataatcaggcagtggcatttcccctcacagattaactcaggctacacatctggcaagcagattggccttggccaggcccactggtctggctaggtcccctagtttcttggccccgaggggagactctccagtaaagatttctaggtctggaactgcacagatccaggagaacaggggccatagagcagagcactgagtacagactgtttctgttcctgttttgttttcagattatgccattattccattactaattttcagttgtgtttctaagcatgcagcttacttccatttagttcggtaattctgccgatgaggcaggactgctcaggacttaggaaggcgaaggactaccttacactgtccagtaaataaagtttgtactcagagtccagcctttggctccccggcttcccacgttcttcctcagaccactgaaatccaagtgcaggtgtctcctgattgtcttcttgaaatagcagcacatgaatttagccagcagacgagttgcacgggagccgactagccgtgctgaatgcagcagaggagcagtgtgagcatgatacacactctagtgtgctagtcctctctgctcactcagtgacgtgcacatggagtcttggaggaagaagggagctggtgccataggggccgggcaaaggtcagagggataaaagtagatcagtcctgggctaccaagggaaccaactccttttatcaaaagctcagctgtggagacagtgatgttgtgccccaactattctagggaggcctccttcctaccccattctcatttccatctgtgcctaatgctctggaaatagggtgagctctgtcctagttacaaggaccagggtcaaggacaggtaccagggagaagctactgtaaggtagaaacactgcacacagcctggaagatagagaaaaagcacacggaaggaagggacctacaacccgaccctcctcctgcagatgcagcctcaggaggctcttgttgctgtcctgccaaacagtagtcagctttgtctcatgagactccagcctccaatcccaagtccttgaggaaatagagagaagctaatttgaagctttgtagagaatgcagttccaccatctgcaggttttatggtgaggtagtgaactgattgacagttacagacaggatgcccagtagagaaccttgtaggctctgattcttgggagggggatatatttccaggggtggcaaagcccctaaaacaagaatgcactgctggtggcagtgggttggccctagatgctgtttacagccctcttcagaagaagaaaggagtggagcgcagaagtacacaggccattcctccagccagaaggctgctgccataggacagacacctctgctgccctgatgacctcttcaagtctaggggttggagaaagaattaaatcctggtttcctgctttctgaaaccctctactaagcagtacttactgacaggactagtgaccaatgagaaagaagggaagcaggaaagtgggaggagccaaatccataggtgtcagacatagtgtcaatggctggggaactctggtgaacactaccagagggagctgtagacaggagctgcccagggactcagtccagcaaaggccacaaagagagacatcatagtgagacatagaaacacaggtcaggattaggccgtgctgggcagtttgggtgcagggttacctcgtgccccttcagccccctccctgcctgccctgctggtgctcaggcccttcatggtgaagctgtctgacctttttgaagttggagaaaagcattctccccagaagagttaaccctttctgtcttctagggtggtgttgacttagcaggtaggtcccagagctgcatcgtgggtgcagcacagatgagggaaccctactagaactggacaggtctgcctaggaagatggtctggacagcagaggattgtggcttccgtatgaactacttctctttccagccactgctcacccttccaccaggcccagccccttcaccccagcctcttcccagtctgttgcccattgatttaaggcacacaggtgctatgtgagtcttcactcccctgcccctagcttcttaccaggcccagtcatctgcttctagactgacagaaggtgagcctgttactgctgagaagggttagggatgaagtgctccagctgttgggtccaagactcagttggagatgcggtccttcctgctttacccctacctgttcagtcagtgttctctggtagtgagtgactaacttcccacctctggttactgtgatggaagccagctataggccccccaaccccaccccaagagctacgtaccctggattgtatctaaccctgctgacaaattcttgtgtgtccttcgagagtctttctacccactctaggacttacttttgtccttcggtttagtgacagagccttaacaccaatcacctttcctgaccaccacctcctcctcataggtcaggctgtgctcatctggtggccagcctggtgccttgtgtctgcccagtggcagattgaccggcaccagggttcctagcaaccatggacaaaaggttattcctgacgtgccaggctgcctgagtgacaggctggggccttggccggtacgcctgccagtatgcatgtgtttggacaggtttgtgtctgcacactccagccatctccccccgccccctgcactccacatgtagcgccgtaactctcactgatgaaatggaaagttgaacataaatcaatgtctgccgcccgttagctatgcatcagcagtcagcgcctgggagacttgctcagtaacaaagcccccagtggctctgcaggctgcgactgccccctaatgcatagccagccccaggccatggagccctgctggtcacctccaacaccacctagctgtctccctcctccccttggtgggccctacctctgcagctgtaaactccagccaggcctttgcacctccaatgccggaagggctgctgctagctgctgctgaaggcctggggcgctctctcctcccctttggacttgcattttctctttcctgcctctgagagctgctggcctatgcttcagctgcctgactatggtatttcctttccccaaataagagtcccttgtggaggcactcccatttgtgggaactgtcgtgtgtgggctccctctagccagtgcagggcagaccctctgcctgtcctaccacctaatcagcaaattgtgtgagatttttctcctttacaagaaggagatcagatttgctgagtccttgtagcagaaggggtttgagaaagagagttccagtatagtcctgtgcagaacacaggtcaggatggccccctgggtcagtcatagtgtatatcctcccctgggaagacctaggtctggctccccggataggattcagaaacagctgtgagcagggccttgggagccacagggctttcctttttctggaatagaatgtgggcagcacccgaggtgctgtagaattcctgctgtttctttggttgctggagggggtgggctagatgcacacatcttcatgttcgataatattgtatgcagctgctggaagatgaggaacagcctcaggtctgtgctggcagggtcctggggagctcctccctctgggccagacagacgcagagccccattccttcttcctatgaagggggttatttttcctggtagctagggttgctccaaaaattcagtgaacctctctgaacctcaattgctgcaccccatatttggggttgatggtatatccatgactcctgggacctgtgtgaagattctgtgacataatgcctaggaaaccctgcctggtgctgggtgtctggtgcacactctgtgcctgccagcacttggatggctcctgtgtgccttcaggccactttattctctgagcttcctacctagccaggggtcagggctgcttttagtgtaattctcttggcagtacagttttcatggcattgctaaggttcatagattcttcaaatcagctgatcagcacttaaccctctggttccactggcaagagttggtgccagtgaaacaccagccctatttggccttttaatgaagcagcttcctaatctcctgctgaagtctgtcctcttgacttgttccctcagctttggccattctgatcccttgttctttggtctagcccccaacaggagtttctaggggaagtgaaggcagggaagtaggctgtgggttcaggagcttctgcttctgttcctagcaggcgtgttcggatgagcttaatggagacctactctcaggctccagggactgcatggctttctgtcaccagaagatgcctgagcaccttttgagtttcgtttctcccttgcctataaaacagcctacttcatcagctctgaattgaaccagggagcataagaatggtttgaaattgtataggactccttcccaaggccagcagtcaatcatttattcatttggcacagacacagttgctgcttcagcctggctgtagtggccacacttgtcaggtgccatcctggacctccatgtcaagtgctctcccacagctcttaattataaaactccagtttctcagtatagcatctggagccctgtctggtctgtccccatcatcctcactccattgatagaacagctcttggtccctagggcaaggatcagatctgttgctctcgggtctggtctctgttcgtccatcagtctgtatgtattcttctcccaactgccgagttctctcctagaagtgaagggtcttaggtcagtattcaagaagcctttgacagagtctggccattatctttgttccaaggtcaaaatggacaaacccaacacatgggtctaacccagttcctcttcctgaaggtagctttaactaatcccaatagctctgaagttgtaggaatagtctggatctgatctggaaaagtggccttgttttctaagtcctggtcccagtgacattagaggaggtggacgtgggaggcacaagaggaaatcgtattccaggtttacctgttctgccgttgaagaaccttgtatcaagtgggattcttgagtgagtaataaggaaaagatagggtgttcctaaagaactctaggaggtggacaggaccgtgagtgacagcttcacatattagcagctgcctaacggtgctagctggctgctggcactgacctgagtacttgactcttggcaccacagacttgtgattgtcttacaggcatgttaagatcttcacaggcacaggccaggcccctgccataactctggcttctttcatcccccagagtccctccctctgccagagttctccaacaatcatgtctgagcccatgtggcagtggaccaaaggcctcaaacctgcatgtttccagaactctggtatttaccaggcccatgcctgttgtttcaccttaactgagaagagaagagagtcccagggcatttaggcatgtcagggagggagaggtttgagaaaccacactgatggagcaaaatgaaaccagcagcctcctgatctcttctggagtctgctgtttggtgggtgttggaggtggaattctgggcattttggatgtgtggcttccagggctcagttacctgcttgctggtggctgtgaagtcgtggattgtctgttggcagagctgtgtgcacaagtgtctggaggccgtccagcagagcaggagtctctgggtagatgaggccagcctccttagcatgcgcctcactttcatggtgctgttgtgattaacagcagagcagagccggcaggcggggcggaggccggcaggagccagctgcatcagaaacactgtccaatttcagagtaaatgacagtttttagggggtgggaagcagaatgctgtggcaaagcaggaatattctccctgtgtcctgaggaactgatatgattgctatcaaggtccatttctaatgcccacatattcccaaaacatgttatgttgccctgaattgaagtcagagagcacatctgccatcaggaccctgctaggaaccctcagggaggagactgtgggaaccttgacccagccagtgctgtggcagattccagcaaggtcacagagcctgctcatagagagaagataatgactttcctccatccccatgatacaaggtgggaattagcaccctggacagctgttagctctcttggggctgggggggggggtccccatggccacaagccctgatttctgatgtgagaaggaagtagagaaacagcttgggaagaaatggatgtgtgatccacggataacccagtctaatggtgactcccttccaggagctccctcaggttaaagttctatcccaggtccaggtccctatctttctgtaagcacaccttttcctgaactagggctgcctaactccatcctctgtgcccacattgtctacctttcttcgtccagggcacatctacacccaccaggccctgccacctatgattctatcatggccactgctgcctaaatacttcctgcatttagtttctgtctctgaagctgctgtggtcatagttacacttcagtctcccaccaggcttcaactcctgagggaaaggcagggtgctgcttgtttgtgacgcttggtacagcggctggtaccctcaaatgcactgactgtagtatgctgtgagccctgaccattagtctaaatactggatattttttctttgtccctacaaaaaggtggccagttaagcagataacagacacccggtgtctatcagggagatcccaaggtttcagtggctcccaaatcacctctcctctttgccccatcccaacccatgcatttaagattagacctgatgaacccagagactcctcctcgaacctcagtccttagaaaaggggccgagcagtctgaacccgctgaaagattgcaaatgctcatgtcccagacaagaggaacccagcactgtaccagggatgaagtaatcaaggtcaacggaggactgggggtggggtgggggacgcatgtgtggaggtcaaggtcagcttctgaatcagtttctttcttccacatagtccaaggatcaagcctcagttgttcagctttgcagccatgtatctttaccagggagctatcttaccagcccctaatcttttatgctgtggtagtgaactgtggtttattcaggaccaaaagacaagcaaactctgacttgcattcactctggctatttcccatgggataaaccttggttctctgccttaaggtcactggtttgtcatgccctcccccattgcaaactcactgtgtagctaaggctacctttgaaccctaggtcctccagcctttatacttctcaagggtgtgtgtcatcaggctcgactccattttcttctttgcaaatagttggcttttattgcctttgtcttttagggaaggtctgagtttaaaatcagaaagtgtgcatagtattgtatttttccttacaaactaataaaggctctagttttccctcatcagccttgaaagctatcatctcattcaggggatctatcgagcattcttgcgattggcaggctagcaaatgtccaaggccctgcgactcctcagctctcccattgccacacaaaggtagctgtgcagagagtacagatgtgcgtggctgtgtcccaggaaaaccttataaagagctggcaggttggatttcccctgagcttactgtagtctgacctcgtagctgtacccttggggtcctatgctgccattcacctcagcctccatctgaagtctgcataaaacagcggaggcctgagtctgagcatgagccgtcatggctatggagtgcctggacactttctctgcctaaaagcagtaagcatccctttacttcccagtactcaggaggcagaagcaggcagatctgagtttaagccagcctggtctacagatccaggacagccatggctacacagagaagctttgtttctcacaaaacaaagaagcagagcagcagcagcaggattatcatgtactgactcatggggcacgtgtggagaaatctttccttgggtgtccctgtgcatccaaccaggtccatgtgagcctcactcactgtgagctctcacttcttttacccagtgctgtgctgacatcatgaagagatggacagggaacaaggctgtaatgctgactttacttagctcacataaaaggcggtgcccctctgctggtcctttctggtgtttccccagagtgaaaatactcacagtgcatttcctctcactctcaactagtgacgtccccaccccagatgcaaggaatatatggtcatgggcacacctctctcctctgtacagagtagggtacagcctttcctacccacaagttatatccaaaaaataaagtggattgtctgtgaagtgcttttgctgtgtgtattatcatcataattttatactgcctcatctatagcaatatgtccagcaggcagggccaccagtaccgcaaggccttcctactctagtctgatagagcccagtgcccacagagtcgagaaggggtggaagtgtcatgacgctttctttacctcttaaaacaatgtcttcaggtcccctttctctaaggataaaagtcagattttccttagatgataatgacactgtcattccaaagcactgtctgagtcctggggacagagtaaagagcaaagaacttagcagtcaaactgaggctgtgggcaacagggatgtgactctaaccctggttccacagccttaagcttctgcctgcttcttccaaggagtggtgggtgtaggggccatttaagaaaggagcacataatttatctctatttctcctttaaaaaatagcatatgcttattttcctttagtcttttatattacagagctatcatcctttaccccagagtcatctagaataccaacttacatgccatatagttcctcaagcccaaagcattaggggtaccacccagtgcgtcatgaggtcccttgatgtagctgtcacatgcccagacctcactgcactggtccagccttggatgtcctaatgaggaaaacaggaataattgtcatcccagagttctgcatacaccactacctgacaggcaggataatagtggggccttacaggacgctatgtaactttcttcagtctgtgggtattcaatgacaggacaccctggcctgggccagaaccagcaagccaaactgccaatttctctgccagatgcccaagaggcccgttgtgagcttggccacactactgcagtgtctgtatagatggttccatttttcttagatgaaggatttccccatcatgccctagtgcgcctctcaagagcttcagaacagggctagcccgagtgtggcgggaggggctcccgctggcagtcgtgaaccgcatctctgtgcagacctccgatctgtgagccgcaggagtgctgcttcctgccatgccgatgccccatcaaagcttttgtgctaaaccatcagcgtccagactgtggggtctgtgaaatggccaaacacttgcctcgatcacaccagtaacagagcctcccaggccttgcctaagtggctctcacaacctgctggatataacactattcaatgctgaaattacagaaaaaagaatgaaaaggaagtctggggcttcgggggtctgaaggtagtgatctggagccagctgtgagggaagggcaaatccattaacagggttggagcggtgtgaaggcggaataggccataggtgtattttccaccttttttaagattcaggagcaggaattgcccttattcatttggctcccccttgcctcagtctgctgtcacttgacatggtaagtgaaggtggtagaaataagtctgatctactgctagtctgtagttctcaatgcagcttcctgtagccactctgggaagcaatgggggaactaggtgtcactgctagagccctaggtgggcttacgagcgttcagcctttcccgccattgggttcttctttccccagatggacttggaggtctttgggccacaggctcactggcttgcggggtgctgggcttcttcagatccctggctcccagaatgaagcttcggctccccacttagtagccacagagccagtgcgtatatttcctttctgagctttgtttcttgcctataaaacagtatgaccggtggtccttacattgccgagcatagaatcaagtgcaggcaaaaggccctctctcccctgggtttccaggattggttttgctcatcagtgagaggccaggcgcagccaataacagagctaactagaatttgaaaccagtttttctccaagccctgtttctttttaaaaaaaaaaaaaaaaaaaaaaaaagatggagttgaagacatagtgtgttgtagagagccctgacagttggaaaacttagctcagcaaatagctagtttctggtagtcttggacatcccccacccccatcctgattcttcctccccagaaacgaaggacactagggaaagagatggcagtctgtcagtatagggccatctgtaaacgaatactggagctgtactcagccatcctgatctgccccagtgttgtgcagatcttgccacagaaaacctccagcttaaggagatgggccttcgccagctaggcatctagacacactttaagttcttcagaaagttcttcaaaaagcttccagcagctgaacagcccatggggatcttgtcctgtctgggaagctgatctttggggcaccctcctttttctatctcagcaaaaaggtcagacacctccaggaaaggctttgtgtgttgtgtcaaacttgctatataggggtttgcccatgcagagcaaattgggaagaccatcaggttcccttcataggaaccaaacagctctctggcaaaatgctggccacttgtttggggcctatgtggcaagctattcaggttccttctgtggatgcttcagacagtctgaaggtcacagcccagacacacagcatagtaaagaatgctccaggctgaggacagatggtacaggcacggagaacatgagtgaactactggcaaagtgaaaagaagactttttgcttctgacccatgcagtaggctcccagggaggccaggtggtctgaggctgacagcatttccccccgagagagatgactttttttgtcattgaggttgccatggggtttcctctctgggctatctctgggctaggatgctcttgacactgtcacatggagacagggaactgctgattccctccctgtcctcatatgcccccaggttctcacctacagccttgttttaatggtgcatctgtcttggtgacaaacttgctatctccacttgttcagacccagctttgccttctgaaccccagggtgcctcttgtaaggacctagcctgccgctgccgccgctgctgctgctgccgccactgccaccgccccggctttcagacctgggcttggtcattgaaccttgagtcagccatcacttgaggccccaaggtgtggagctgcttcaagtgtttttctctatttcctggtagccaccagggaccgctcctgcttggtggggcacacaggtgtgtggagcttgccccgaagagtctgctctgcaaatgcatttgtgtgaccaagaagggagacaggactgtgagggaggaggtgctccctgttgccaggagcctggggaccagcagacaagcctttgcccctcttggcagctggaccttacccctgagctcccttcctctgttccttttcattttctttttgggggttggcttcaaattatcttgttttgtttacattacacccaagttttgtggtataaaagacttgcaggtgcaaatatgtcccgccttcattaacttcccctccctttttaatttatgtgatttcaattttccttccctgtactgttaattaggggaccctctaatcagtgccattatcacagtggtattcatgtttaggaaagccgctaaacaaatgcttgcaaaattgctaaatggctaattaatgtctgttaattaagaaaattgctcatggtaacaaaccatgccgttgctggcagccgctagaaagacacacacttgttgaaattagtagcatggcaggtaggggaacatctgctcctccaagctttccggaagtgagcagcccctcacttagccaagaagttctggggctgtccccggtggtgccctcagctgctggacagcccttgcctcttgttttgcccacctctttgtggtctctaccttacccccagccctaccttctcccagcccctggctctttgttcacatggacttttagaaagaagactaaggatgggtggaaccagtggctgtagctacttgctttccttacctttgcaaatgtctcgagtttctatactaagggacagctcccatggagaagaagggtgcattgtagtctgtgacacttgcccctatcctgagtccaggtcttggtggcctgttgggccaaaaggggcctcaaaggcaaactgctgggagccactgtagtaaacttttacaacttctaatctgcatacatgcatgtttgtgtggcatgcgcacactcactgactttctcctgcacactggagttctggagagatgcttgcttgtgacataaggcactctgattctctgtttttctttatttttgtttttgttgtcttgtttgtatttattacattgatcttatcacgcattagcaggatacaacctgcaatttgaccaactctgtaggtagtgaattcatctccttgtgttttggtgggcagtaaaggaatacatggcccagagctttggagtcagcttggaactgcaggcagctcaccatcatctggtgtggaaagtgggccctctacccactgagtcacaaagcagtgactatcctcacacctgtgccacctgaccctcaacctggctctgccacttagggcttgtgtggttgtggcctgctctcgtcatctcttgagaccgtatttcctcctctataaaggtcgaaagaagaggcacacagactgttttgtagccccggcactgctcgtgctgtccttggcagctgtctgtatcccattggcttagctccgcctctgctctgtctgtgtctgtcccttgtttcctgtgccctgcttcagccagcaggaccttgatgtcgactgtctcaaatcacctgtctctgagactgagctccgtgagggacaggggcttcacctgcctcctcctgtccctctgaagtggtacttacaggcattgcatctgggtccgggcccctgtctgagtcaagcagtgtatttaacatggcaaactgtttggtagcagcctgtgtctgcccttgctcctctgtgctttgatgaaggtgctttgttttattttttcgtttttccaaatcccttgtgaatgtactggtcagcctccctccttcccgcctgcccgccgttgttcgccattgaaccaggacccaagcagcgctccgccacctcctgccagccacagcccaccacccgcacgcccgccgccactctgcgttttggtttaatttttgttcttttaagcttcttctgcgcttctccatgtgctgtgatctataacctgcctctactgtctggcctcacagggtcctccggggtcacagccctcgccgcacgcacagcctccacctcacaatcccagcagcatgatgggaccccacagtcaggtaaacgcactgtggctcgccggcccgccggccggggggcgccggggcaggaggaaggagagagccgcagaggaaaaacaaaaatcagaatgtgctccagcactgccttccagtcctaatcgacaagcttaattaaaaatattcttctaaatacagcctccacttcttggacatcccacccagtttggatctgaaaccaagaaaaaagaaacaaaatctttctgtgaccttgccagtggcctttatgtttttggtttttcctctctcccttttgtttggttttgagtttggttaaccatttgtttgtaaccaaggctgcacccctggccttttctttgtgcactcttgctgctgagaaagctttcttgcccattccctgcattaagttagggagcccactaccccttaccgtgttttttgtttttccatcatgttttcccataagtccttgctcccttcccattcctccctgttgatggtttctctgtgtgtgcttgtgtgtatgcttgtgtgggcgtgtcctgctctgtctgcacacctgaagatgtctcgctccttttgcttgttattttctttgcccttgtgaaaagcagaggtggcctcctttgccctgcattgatttagctattctgcgttctatgtgaagtcccagctgctgcccctccacccaaagtagattcctgcaagccagtgcaggttgagagacaagttgtgtggatcttttgttcctctgcccaagggaagttttgcctggaaggaagaagaggctaccagactagagagagcttagaagatcactagttgtcataaactggactttgcagagtgcaaagcatttgtgtttgtcactatacagtagttcatctgtcattgaactgattccctataattacagccttttatgtcaccgcgatatgcaggcggccccaggcccccgatcagaatgggaaaccaggtacagtatcttttcttgttttctcttccctgtcagccacccttaggtagacctggacgcaagtcaaaagcaaggtgcaaggctattgggtggagtattaggctttaaggtgggggaacttgcccaagtgtctgctctgagcccatggcccagcgtcttttcacctgcttttcacaggaagcctcatagcagcctgcattcagatagcatcagctggcaggattgcagaaactcggctcttgtagagaaagtgggaatgaccctacagctccttaatggaagagggtcttactccttaatgaagtcaactgacaatgtatattttttttttgttctggaagctttccagaattgccaaggctggtaaatagaatcctgctattgggggagagatgtcctgtaggaatgcttagatcaggagcctggctgcagagggagcaggacatttgtgaggtgttcagtctgcctgctttcccagaacacggaaggatttattcatataattagaaaaataccctgcttacgaagaggacttttcagcccagagtcatgtaccttgttgtcagttagggataggctggagaaatgggtcctcataaggtcttctctggtccaccccatcagggtagagtgctaaagaagagcagatgcctctgctgaggatggacagacaaacacagcctgatgtaggcatcagggagattctcagtgccaaaatatttttagctacaattcttccaatgtcttatccaaaaaactctggcagcattcattgccagcacactgggagttagaagtttggtcacttccattatgactctgacacactgcaaaaaagcctaactgaccagacacagaccgtggaggaccaagcctttccagggtggaagcacccaccacattcccaccttgctcttctctcccagactccttcattttctgttctctccaacacagagggggcaaagttagacaaagggaacttagaaacccagatttttaagcaacaaggacttcttgggtatgttgcaggggaggaaaaggaggaaggccagggctgtagaagagcaggcttaccttcaggggcatccgtgtcccttgtgggactcggagagcaagatgaaggcatcggccttctagtgtgagacctgctttccttggccatcgttcacatagtctccttcctctagggaaggcctgagccgccctggccccatttcagacaccagctgaaggtagtgattctcagctcctttaacctggaccgccagctaaaaccctggcatgtatcaggcttagaagtcatggagaagtgttgtgtgaaaagaagccattgttacagttacacaacggggtaggtggggtgcacctataatggggatctaggaggcctcaaatcccctatctctattaaaaaccaccagcacagatgggcagacatagaccagccaggtgactcgtagttcaagagcttgaggagaaaaggagaaggtaagggtgactaagtttaaggtacagggacccagcctcgtcagctccactctgtgaccctgagatgcagcgtggccctcataaagcctgcttgccctggcttcatcctcctcttctgaagctggggaagcagggaggggctctcacctcctattgaacctgcttttgcattcacagccagtcagaggcggaagagcctaggtggcctgtagtagcactcaagtctaggaaccctgtcatgggcccccagcctccacagcattggcacctcaatcaggagctgtggtcctctgtcactaagactttttttcctgaagtcaatagcttctctttggtctaaaggtccacaggacacttggtccagcctctgctgttctcttgtttttcaaattacagcctgaataacttcacccaaagtcctgtctgtttttgatggtgtcatactggcacccactgctagaagagcaggctgcccttaatcaccttgttcctctgcctgtagctgtggcggcacctctgaggtgggcgctcagaggcctagatgactctgctgactcaggctctagctcttagagctctgcaccccagttacccccccccccgaatctccagggcccctttatggttcacattaaaggtctccctgtggtgatagtttttaaccagtagctccactaggttcttgttgcttggaaatatacttaaaatgagttacatgtttgaagtaaaagaaaggtagggctggacttaaaccgcagcccctggattcaggtgctgccctttgggtgggggtgagcagtgagtccacatcacaccttgctcgggcgggcgggatgcaggtacaggctcacatggcgagcccagcttcccactgcactcccacctgatgctgcagctttgcctgatgcttgtaggaactgtctgccctgcttcccagagctgggggcccggcccagcgtgcagcgatggtctcagggaggccatgaggggcccatatggccaagttgggggagcagggtgggacaggcagctgcatcttgctcccctccccaccctcaacaccaccctatctctgtaagtagcgactcaggctgtgtctcgtgtgtcctttttcagcctccaggaggagttcctgggacacagccactgctgcccaattccatggatcccacacgacaacaaggtagagggccaggcagggtggcatggcccatggcattggggctttctctttgctctactcctaacagcacccattttttcacacaggtcaccccaacatgggaggatcaatgcagagaatgaaccctccccgaggcatggggcccatggggcctggcccacaggtaagcagctacctgtctgtatgtccttatgtctccctgccatctgtgtgcacccgccttctctcctttttccatagtctgtcagtctccacatttctggctcccctccctgcctgcgggatgctgagtaggaatgaaagccagggagccggctgggtagcagatccctccagggtgaatgtcataagctatgatgtgggatcttctggaatccaaagccacttccttcccagagtggaaaaagcttaagggagatgcaggaccacctcacgactcagtggtggttgagtcaagtgagaggtgatgaggagtcactgtgacttctggggaccccaggcacttttaccaccaaccaagtgagagtctctgtccatgttcccaggaaatgtggccagccacgctgctcagcgcccactttagcccacagctagcttcgctgctcccaggctctgtcccttcctctccttcttaggtgattgaggttctttgggtcccctctttggctccagttcccctgaagttgtaccctcctgccccatgtcctcctttttgtagggaaacctacagacctggaaaccatctagtcattcccagagttacacagcaaacaaatctgctgccttttctgtggtgttgaaagatcttagggcagcccggccctaaatcctaaagggaaggaaggctagggcaatcgtgnnnnnnnnnnnnnnnnnnnnnnnnnnnnnnnnnnnnnnnnnnnnnnnnntttagcttttcagagatctgataatgttaggtgagatcttgctttccccgtgggaactatgagtagacccaacagccacatctctaagatgaataagcacagtgttctcactatagtgcttggtgtcatccctgggccttgggtgtggtggcacacatctttaatcctagcactcagaggagaggcggagtcagctggaactcctgtgagttcctggccagacagtactacatagtaagactctgtctgactgcatagcaagttccaggttaactggagaaacaaaacaaaacttcaaagcaatattcaggacttcagctgtttaggcttgattaagcgtattttcttttctggcaaagttattagcagtttattaggcctcatatagtaaggttgagtgagggcagaggcagagctgttgcctggcatgcatatcccttggttccatgcccagtgtcacaaacaataaaatcgggaaaaaaaggctacaggggctgggaatgtaagctcagcaggtaaagtccttggcatgagtggggcccagctgtaaccccagcactgggagagtcaaaggtcaaggtcatttccaactctacagtgagtttgaggtcatcctgggctacatgagaacctgtcttaaaacaacaaaaaccttacagaactagagtgaagctccagtagttgggaatgacgttttcagcgtgagcacagaatgctccagaagtttaagccttcctcttggctccagggtgtctcaccatatcaatccagcgcttacaatggctagcggttaagagcactgactgctcttccagaggtcctgagttcaattcctagcaaccacatggtggttcacaaccatctgtaatgggatctgatggcatcttctggcgcgtttgaagacagctacagtatacttatataataaataaataaatctttaaaaaagaagaagaagaagaggccaggtcctgagatcttctgcctctttccttgccacatcagtgaggagggtctaaggtgtcttgaccatgttccttggaacatgttgggtaaggagcagtattcaaccctgaaactaaacctctcaagcacattggatacaactatccccatacaacttatctctgagacaaaaagggttggggctgatttagtactgggccagtacagtcagtgggtgggattcaggatcatctaggacatcacagagaagttttggaccctgtctttattactgtactattaccgtaaagaaacattgtatccaaagcaacttaaaaagaaaggtattgggctggtgagatggttcagtgggtaagagcacccgactgctcttccaaaggtccggagttcaaatcccagcaaccacaaggtggctcacaaccatctgtaacgagatctgactccctcttctggagtgtctaaagacagctacagtgtacttacatataatcaaataaatctttaaaaaaaaaaaaaaaaagaaaggtatttagttgggggcttgcttatactttcagagggtttagttcgtgactatcatgatggtgagtttggtggcaggcaggcaaacctagcactggagcagtaattcgagttcacacctcatctgcaggtggcaggcagacagacagagactaggcctggtgtgacacgacatcctcaacaaggtgtgcctactccagcaagggcacacctcctaatccttccaagcggtcacacatgagcctatgatggcctttctctttcaaggcaccacagattccaaagcttcacataggagagggcggcctctgtggtctccaggtacttttcttagtacttgactgcagaggctactgcccaggcacagaaacagacaagagggagagaccttagtcttggtactgggaagatactggtctcttctgactcgactctcattcctgtctgcaaagtgggttgccaagaggtgacagcttgtgaggcagggcaccaaagtggctgtggacactctgttccccttctgatgatgtacactctgtttcttggccgaggcagttagttgggagagccagcctctcaggaagcctaattgaacaccgctgtatgagtcctgttatactgtgagaccagacatagggggatgacgtcacttgtatgatttcttggtgaggtatcagaatgtatttgaccactgatcactctagaactttctggaaggggttgggaaacagctatagtgtagtctgagagctattttataggtaggctgccactctagttttgaccctgtatcctgtttcagtccaaaggcgtgaacagtcagttaccccctgtcattttcctctagggcctgcgatggttttagtgtgcagtgggaaagaggcagtacttcatgggagtctgcatgaggccctgagggcccttcctgttgtccacattctgcagaaggaattcagtcaaaactaaatcttggtcatattgggtaaagcacgttgaagactcctggaggccagtgggcaccaaccaacccagggttacagccttagcaattctggccgtgctagaatcacaccaccatcttggttggtctatattttcacaagttcaggtagaggatattcttgattctccagggacagtcccccaaagacccaaggctggtgcaagctcggaactctggaaggaccattagtcctgtgcagagcatcctgggctaagtgagggagtgaggcaggcactggggaccctcttgtcaggcctcctactgcccaggagactgcgttataacttcaagtttctctacaggtgagtctagtgacagatggctctgtttgaaggtaaagctaaaacagggcaggtgacaggaagcatgaggaagagtccactttgctgtagataccagtcatgaccccctagtccaacccagctgtggagtaggcacctctgttctccaggagtgagaaaggggcccgtgctcataagggggagggacagctcccgttcagtccccagtcacctccagcggatccagaacctgggtactgatcttccatccccatatcagaagctgttgcttctgactgaaaaatcttagaccccaaacctggtttcagctaagctcccattcctgtcttgcttaactaagtggctgtgggcacatatctggcttttctgggcctccaagttgtcttctgtgaagtgggaggtgtgtggagtagcccttctgactttacatctataggagggagacttactatggctctatgcaggatacccccttgttagcaagcaggatagggttggaatcctgtctgtgtctcccttcaggcagcatgctgcaaatctggccttcttttgaccaacactttgtgtggtagcagcatcctgactcctttagccctggagtatgacacttgcctcctccagtgagaagggcatttagatctttctcatacaccagttctcatgggccataatgaactggcttactgtgaggggcagaatcaagtagaagcattctgggtctgctgctgtcatcaagtaactgtaaacccacctcagaaccaacactttgcaatcagcatgggtctctctaaggccgaaggcaaataggctctgtgtccctgtgttatagactaaacagggttgtgaacctgcaggcacaacctggcaacagggccttgtcccaggttagcacctaactattcctttccttctgtgcctcattttgtaatctctaagggagttgctatgactattaaacatctgtgtacacataaaacatgtgacacagctttatcctccatagtaagaattgtcgtttgtgtagccggagtcaacaccaagtggccaagctgaggtgagctgtcttgtgacctctgtttaccatccaggttgtctaatcagaacaggcccagggagtgaggcgctgtgtgagctggctgtagccagtcctagtcctccctgtaggcctcactccttgccagccagctgatgtcattgcctatattctgtccaggtagtcttgtagactcgaggcctccatgagtggcctagcagaagagggctccctcagtggtgaggttgaggagacagttctttgtgacatcacctgttttagcccagtgttacctctgtgctggtctgacccaacactgcccctggttttcaccttcttcctgccagaggtttgggaaagatccagcgtgtgtgagtgagactctggtctcccacccgttagctgatctggccaactgctccctctcagacctgcagtcccgccttttgtaaagtgggaccagcttcagaaggttgttacagggacagagcaggcgaagtctaaggtcactgtgtgcccagcaagatgtgtctcacattggagcctctcaccaacctgctgctctcagatgcccacagggccagtgcccaaacagttgtcgcgctttgttctcctctgccagtcactgagcaccctgggttgtagagttgggggtgtagccacagagacactgtcctgccatatttaccctcagagtacagcagtgggggaggaatggccctgtgactataggggaggctattgagcattctcagccagaggcaaggtgggtggttccctctgttgccttctccctcagtctgatgtgactctgatcaccagtcagcattgggcttggtagcagagtcagtctgcctaactgctgaggcctgtgggacgggaatgatggcagcttgctgatcagacagggtttagggagaatcatcgtgaagcccccgccaacgcattgactgttgtgactgtccctctgtgctggcttgtcattgtggtcctgtctgttctgaaagtacgtgtgatttttttctcatcaggctgtcgtcacagactaaccctctcacttatattctgtgtttgtctccctcccggttccccttctccccctcatagactgacccttggttatcgttgcagaattacggcagcggcatgagaccaccacccaactccctcggccccgccatgcctgggattaacatgtaaggcaaatagccccggccggtgcctcagagcccatggcctccccacccactgttggaccccagaagacaatcttacccctcactggtgcccctctggacctctgtttcctcacccttagggtgagagctgtgtcttacactggattgtgtgcttggcacagttagccaccttgtggtcaccaggctactcctacaaggtgtggttactccctgcctgtgatgaggtcactgaggccagagaggtagagtgacttccttaggcttgcacagcttcaatggctgattcaagatttaatccttatgcaaataagccctgatatttagtgcttataagaatcagtggtctatcttcctaggaaaaaaaacagcagaaatacttatatatatatatataattttgtaaatacatattttacaaattttttcatataatttgaaggagttcctaagtctccttccgtggaactacccattgctaccccagagtcagatggcatctaggacttcctgtactgatggcagcctgctcctgctcccactggctccacgccatagagtgtagccccactttgattgtcaccatctctccttctcttaggggcccaggagctggcagaccctggcccaatcccaacagtgctaactcagtgagtatacaggtctggagggtgcctttccccagggaagaggttctggacattaggtaaccctgttgccaggaagaggtatcaggcgggagaactacagcaggatctacctgatgctgctaagaaggcccgtgtaggtggagccctcggcagtgtgctggggtcctcacacgtggtcctgccctgagctatcggctggctaagagctagggctccacgtgcgtcatggttctggtttctagcattgagggaaatgactgacaggcttggtgcagacagaagaaggggtgtgggtgttgctgtcttccaccctcccaattgggaggtctcctgggaccctactctcaggctccaccaaagactgggagaagggagaccaatccccaggaccattgcatgtgtctcaggccccttcttctggaaactgaccaggttactaattcactgggtccccaagcctaccataaataagaatgactgtgccccaaagtgggtttggaagtgatggggcatgatgcttgtctgtcagggaaggcagctccaatccatggctcccgaatcttctttccagatcccgtactcctcatcatcacccggaacctatgtggtaagtgcagctcaggattctgactctctagtgcatgtgaccgctgaggagagccactcaggtctagtatgttcctcatgagaacacatctgagcccaggagccaaattgttctcagcgtttaggtgtttgtacaggcctgggctagccttcagttctccagagctgagccagaagggctctttttcagtgactgctacccagcaggctgtgggccccgtttactggctctggctttcactggttggtgtgcatgtgagcagatgtgtgcacacacccaccacttgtgccttggcttgagaggacgagcataaatctagctcccttctggcttgtaggctccagttctgagtgcaggagaggcagtaccaggtaccaggctgctctgggcactggcagctagcatagcggtctccccaagcttcttaacaccacaggttagttactgacaccttttatctcatctcagggaccccctggtggtggtggccctccaggaacccccatcatgcctagtcctgcaggtaagagggcttgaggggggaaataaatgtctggtgggagtggggtgctatgtgtctgagggctctattgcagaccctggcctttcaggcaccacttctgagccttgagtgcatgctctgccaggcactgatgcctggagatgtaagggccatgagccttcactatcaacaacccactgtgtggctttagccacatgacccttatattcctatatactgctttgaaagaataaaattgagccaaggtctgaaacaacaagatctcattgtcctagatgactttagaagggtctctgggtccctgacaactggagaccaggactctaaaagcacatacacactccccctgaggttatgggttctaggcttgtggtcctctgtgtaagagattgtgtttccctgtttctttatctggagaaggcatgcatgcacaggagggcaggtgcatatatgcacacatacatagagtcacaattatctgtctcctggctaagaatagcattgcagccagctggaagaagtgcagcgtacgtcccctacccagcccaaaatagagggagaatttctgctcctgatggagcagcattagctggtttcctaaggagactttccttggctaggtggggagtggctagagcctcctcttccaactccccataaagggaatctgctcagctgcaggggggagctggctgcagccacaaccggctcccgctccggctcccgctctgcagcattgatgagcagcatgacctacattcagactgggtcatgctaacccactccttatgttaatgcggccccagccccagcccctcggcctagctgagtggttctgggtaacttgctgcatttttccttccctgggtgggtctgagagaaaacacaggttatgtctttgtgtccttgctaagcttaggggacggatttgtgtccctgtgctgtgcctgcccagataccctgacattctcaggtttgtggtcgaatggttttctcagttgaattttctgtgattaaaaactttgtgaatcttcattaaatacaaattagccagaagatggtgatacttagaagaaattttaggtgataaaatacaaaagaatgagttcaagtgccgagagtttgttttaattaagaaatgaattaatcacctgaactctgtggttcccactatttctacagattcaacaaattccagtgacaacatctacacaatgattaatcctgtgccgcctggaggcagccggtctaacgtgagtctgctttctgctcatttacataccagataccataacaaatcataattaacttcatcagctgaggggaaagcatgagtaattgattttagccatttgttaccaaagatgaataaaataaaccatcagaagcgcgattaactcttgggcaagtcagtccccatcttattgatggtgggaggtgggaggggcggggctccccctctggtcaggtgtgagacaagggaaagcaccaggcttcagggggcttctccccattcttctgactggccgtgccaccttgggtagttagtccctcccaccgatccttcctgttccccaggcattaatgctaagggggaaacctgaggttcctttgggcacctacttgacccatgtggataccagtatggcagctcctttacctcgactccttacagtcttcccctctggagtgcccttgccaaacttccctgtacagagtctgcctcgcttctgtagctgtggagaggagatagcccctggctttgtgagcccagtttctgggcaaagacaaaagtcacaccaggtatcacatcctacatgaggactgccatgctgacgacggcagacgtgtggtgatgaggatgagtgcagaccttgtgcacacaagcacacacgctgttcttgtgctgcacctctagcactgcgtccctgccacatacgtctcccagcagcctgcgaaggtcacgttctatggcctgcctcctttgccagggccctgtgttgcatgagtatggggaactctctgtggtaccgccctcccatccagccacttgctgtgtttcacctcactaggggtctctttcattcagatactctgtattctgagatacctcaggacagaagtcctgttttgtagcagtggggatagaaggttgagaatactaaacccatccagaggccccctgggctagtagaggcactgatgccggatggacatggtttagtggtttaggtcatttgccacctacaatcactcttgcatttttcacggccatggatgctattaggcatcactcaggctgtgtcatcctaagggctgtagcctcaggatgtctacctgctgccacaatttacactcgagttcgcatcaagatgctactgaatgtacatttaacttatggatgccgtgaccgtgtgtttcagagttaaggtcatgaaactacaaaccatgacaatgccatgtgacccagacagcaccagagtaagctaaatgacacgcaggtcgaggacagtcgagaatattacaccatctctagacaggtgctccagtgagcagagagggtagggaagctcacactctctctctctccactgtgtggggactggcacgtcctttgaaccaaaggctctttttgttcttcaaagtgacactggtgtccattcaaaaacagtgaccccctcaagccagtgtgagcgcagactagagtgagcactgccatcaaccccagtccctgattgctctgggtctaaagttctagatccagtggtcacagtacaggtcctgtgtgtggaccagaggggaggggctttgataacagatgtcccagcctttgggcacagctgtgcctttgtggtataccagtgacggctcacatcactgtaaaacaaggccgaagtgcactgaaggtgcagcgtatggcagagcacatacctcacatgcaggagaccctggctccacccaacaaaacagagcaaaaacaacttctggtgggattttgatttaagaactggaattctatgttatcttgatttcctaaaggcttttaatgaacttgcagaaagcagaactgttctctaatcaaagccaagctccagtttgctcattgatctgcatgttcgacagttttaatctcgtgcttggcaacttgatctgagagctctcaccaggcgaagaaaagcctcattccctgtgccacaacttccaccaagggtgtctgtgacaacagccatcacggagcaagtttttactatacctgtaaggtgacagtcatttgggggttgaagagatcgctcagtaggtaagagcactggctgctcttccagaggactcaagttgagttcccgttatcctcatggcagctcacaactgtctgtaactccagttccagaggatctgacactcatgcagcaacaccaccaatgcatgaaataagatggcagtcactgctggcaaccacaggaaaggtggcagatgttgtctctaaaatttcagtagcttggtcaggagggtggtagcaatgcctttagtcctactactcagtacttctacagaatgagctccaggaaagcccaaggaaaaaacatagtagccaaggctatatagtgagcaccatgtctcaaaacacaagaaaatcgaaagtgtgagacaagaggacatccatatctaatctggaaatctgttgaggaaatcgaaggaaaaggagttagaatcaaaaggaaggagtgcggctcagctagccgcttgtgctaaaccttataccacaaagagaatgactcagctttagaaatgaggcgacggagaactcagaaaatgccaggtcaaggccagacaagctaaataagactttctcaaaaaatttctttcttaaaactaactcacttaaacttcagctaggatctcacaggtgcaagtgtcctctgtagttgaatatcatttctttgtgagaaaaggtttaattgagcagaatatgtgtctcccccttccctcccatatgtgtgtgtctgtgtgtgtgtgtgtctgtgtgtgtgtgtctgtgtgtgtgtctgtgtgtctgtgtgtgtgtgtgtgtgtgtgtctgtgtgtctgtgtgtgtctgtgtgtgtgtctgtgtgtctgtgtcagtgcatatgactgtttcagagcttccgacatttcagaggttggggaaggcggcagaggcagaaggaaattagacatgtcaggacaggagcatttttgaaaatacacaaagcttctgtcttagtcagggtttctattcctgtacaaacatcatgaccaagaagcaagttggggaggaaagggtttattcagcttatacttccaaattgctgttcatcaccaaaggaagtcaggactgtaactcaagcaggtcaggaagcaggagctgatgcggaggccatggagggatgttctttactggcttgcttctcctggcttgctcagcctgctctcttatagaatgaagactaccagcccagagatggtcccacccacaaggggcctttcccccttgatcactaattgagaaaatgccttacagttggatctcatggaggcatttccccaactgaagctcctttctctgtgataactccagcctgtgtcaagataaaacacaaaaccagccagtacagcttccttatttctttaaacatcctggctactacctgctattgttaactagccttctcagtttaaggaatagtgtttctgtattagaaaggtaacccatagactaaggtagcaaagctggggcaaatggcacccacagcaagtagatgaggtgggtctgcatgcacacatgcagttccacattccatttccaaggacacatggctttattttgtttgtttgtctaaaagcagggctcgtgcatgtgcccgtgctgtctgcgctggggaggtggaagcaggagcacccagagctctcagcccagccagtgtggccgagtagacaagctccaggctcagtgagagcctgtttcagaaactgaggtgaagagccatgggggagacagccctgaccactacctttcctatgcaggtgtgtgctcacccccacatgcacgtatgcacacagacatgtgcacacacccacacacagactgaaaagtaaaaattaaacaaaaagttaaattaaatgttgatgcatgcctgtagatgtagctgctctggaggctgaagccggaagctcacttgaacttagaagttcagggccaatcggggcaagcagttcagagtcacctcgaaaaccagtgagaaggctaggcagaaaatctacataatgaaggaaatatatgtgataattgaacctaaaatatgtagagaaccttaccaactccatagtgaaagagcaactcaattaaaacatggggcagatgtgcaaatagatgctcctccagcaatgtgcaaataggccataagcaggaagctgtaagaaatgcaatgtaaaacagcaagggccaggtcatggtggcacacacctttggtcccagcacttggcaagcagaggcaggcagatctcttaagttataggacagccagggctacacagagaaaccctgtctcaaaacatacacacacacacacacacacacacacacacacacgagcacaggagcaaggtagttcatcatagaaggagggtgacgttgctcacagccatgggcagtgacgtgttggggctgcagtagagaaaggaagccctcatccactgttggcaggcacactgagtggtgcagctgctaaggagagcatcctggctctactaggaaggacaggggacttagtgacccagagttgcacgtggacataccttccagaagtgtaaatcccaggctgcagagagtcggagcagatgtgtgtggcagagctctgccccggacacagggcagccttagaactgtgctgaaagtgagaggttagcactagcctgtggagaccaagggatgcagtgtccagaataagcacgtccacagacgtgagcagcctgcctactgctgagctgacagttgggggtggtggaagtggtggatgccagccataaatgtaatggatcagttgtatgatgtatgaatgttttaagttactaaaccattatgtggacataaataatatgtaattttagaattgcctgatttggagacagatgtgttggtgtgtgtcttaatccagagcttgggaaacaggcaagcagatctctcagttttggggtagccagggttacataggccctgtatcagaaaaatgaccaaaaccctgatttttatatgttggtcatagctatgttagaatactgatgtgcatttgtatgcatgtgtgatgtgtattatgttagtaactgtaaacactttttgggagggtctgggacagcggtgtcttacaagcataataagatgaccattccccatttgggctaatgaaatttgtgcctgggaaaggtgacagagatgttgaacctcacaattcaggaggtcttgccaactgctccgttctgtgtactgcctgctgccctgtgcgctggcgctgcctgctgcctgcgcgccctgcgcgctgcctgctgccctgctgccctgcgcgctgcctgctgccctgcgcgctggcgctctcccagcagttgtggagtggctctatgttctgttcttctgctgaggtgctacagcctcttctgatttccctgcctatctattgaagctgcagccatgccttgtctatgacttgtgtttgtatctcaacctctctgacctctcttctattggtggctgtgacacaggtgcgacccagttctatcctcagcacccagttcaggccaagtgcccagcagtcctcccctgtcaaaccttgtctagcccctcccacccccatctagactgcacctcaggcactggctcccgcataggctcagcctcacctcagcaccctgacatgtggccttgtgtgcttgcttccccatgtggacttggcagctgcagacagaatgaagtgacatgtgctcttcaccaatgctccctgaaactcaacatgtctgaggtatagccacatagcaggctcttgttccactctctgctccaccgggagactatgcaaagcactccccacgcagtgacaagtttgaatcaattggtctaacctgtgttgtagtcaacatacttttctgtgcaacaatggttagtgaaccaggcacctcaccagagtggttcaagtcctgtaaggaggcccaggaaaatggcgagctggctgttacagagcctggtggctttagcctgcttcctttccctctgagtttgttcttttgactattacatagactcgggttcctccactcagcactcagccccgaggcccaaccagcacccagtgcttaagtctgcacagggagacccatcagcctggagcatcctgggtgctctgctaagctgctgggacctgaggcctgagcctttgaaggcatttgggaagcagaaaaggggtgcgaagggcctgggtccactaaccaagccctgcttaccccacagtttccaatgggtcctggctcagacggcccaatgggaggcatgggcggcatggagccccaccacatgaatggatccctaggtaagccggctcctacacacactccagctgcccaggcagcggcctctgctttagctcctggtcactgggcctgggacactgttggccttgactgggcacctagaaagtcctgagcaaaagctgctgcctaagcaggtggtgggggttggaggtgggggtgacccctccaagtaaataatgtgaactcaggtgcagacacagagcggaaagggctcccacagaagagcaatccagcaactggagcgtttgtacacacgtcctaaaggtcacaagtttcaggcctgcctggataacacacagtaaggacttgtttcaaaataaagagaaaatgaactgaaggtgtagtccagtattcaggcactcactagagcatgcacgggacctggtaagatccccagtttagaaagacgaaacaggcagggcacattgggcatgtcttcattctgagcactcaggatacggaggtgagcatggctctcctggctcagctgggcaagatcctggttcaaaacagcagatggggcgagaaaatggcttaggtggtgatgtgtttgtcatacatgaggacctggcacccatggagaagccaaacccagtgacacacacttacacacaaactcagtggcacacacttagaatactagcactgtggaggcagaaacagaaaatctgtagtagaatcagcaaattgaatccaggttcagtgaaagagcccatctcaaaggaaggtcaagagtacctccacccgtgtacacacacatacatgaaaacacgcacctgcataccccccacagccccccacagcccccaatccaccatgctgactcggtttcttcttccttcttaggatcaggtgacatagatggacttccaaaagtgagtggcacttgatgtcccctccctcggtgtcatcctgtgtgtttggtcaggtttgggcaatatggactcacctgctcatgtcttccacagaattctcctaacaacataagtggcattagcaatcctccaggcacccctcgcgatgacggcgagctaggggggaacttcctccactccttccagaacgacaatgtaagcccctgcctgccatactgacccctctagtccttgggtcccagtggtccccttaggcctaagggctccgtgactgtgtgtcagccagctgtctttcacctgcagagccccagccattcattgttttctgctccctggtccttccaggggcactgtgtggagtgggagtcctggattgagttgaggcatgtggccttctctgtccattctcattaatgaaagcatttttcaaggtcccagactttccccagcctacaataccttcaggaaccctgactcgctaaatccagtaccctactgtcttgcttcccccaacgagctgactccaaaggataagaactagaggccatttgtgctgccagagttcctggcaaggactggaactgagctggtctcataggtgtcacctagctcctgcctccttcccctgtccctacctattgtgccaccaggttggctggggtcagcactgtgcagtaagccttcagcaggctattggcccattggcaagtccatggcctcctcccctgatcctcatctgtgctttccctgcagtattctccgagcatgacgatgagcgtgtgaccccctccgagacgctgggagccagcattgcaggcagaagatgccaagaattatgcaagaagtgaggtgtccataccaggagctgggggagggcatctcctgctccctccaccctcccattcactcccccaccttccccaattttagtttcatgcaataaaaaggccaaacttttattccgtaaaacatgaaggacaaaactcaaaaatatatttcaagtcaacggccagaaaactctcaccttcttcccgcccaaaaggacctttctgtacatgacactttttgttggtttttttgtttgtttgggattttaccgttgctgggattttaaatttgttttttttttcccggggtggggggtgttctttgggggaattttttttttaatggaagcttctagcaagccctatgccccaccccaatcaacctctttgctttcttctttaaaaaaaggaaaaaaggaaaaagaaaaaaaaggaaaaagaaaaaaaaggccaaaaaaaaaaaaaaaaaaggaagaaaaccccacaagccctgctgtctgtccccaagtcctaccaccagaaaagctggtctaggtgtgcagtgtcacactgacgttgtagccatctaaaataataataataaactggacagtttgcaattgctggtttatttcaaaagctgtttggggaaaaggaacagaaaccaaccctttccacatgggccttggggtttgcaaagctgggcgaggagatgcaggtgtcagctttgctctggcttgactggccatcacaacacactgggccagaggacccagagcctgctgtcacccaacagagaccatcgctgtgatccagcgtacacactgttccaggatggctgcctcttctccagacctctcgtgccaagccactggggcctccagtctttcgatccccaccgtttcctggcaagagtcctgctggctgggtagtggcccaggccaaggaggagaggccccgccaacgggatgactacaatctgggccatagccctgacctccatattctggtcccgagctcctcacatagtgcgcactggcagggcaggctgaggttgtggttttcttttttttcctcctgtttgtcctttttcagagatgggtgttggttggaattgctctgtatttgcttgggactggatggacagacttcggcattgctgtgggggtgggggagcaccagcaaccaaacagacactgtttctggtcctgtttttattttcaaaaaccgatgaacctgatgatggagcctgtcccctccgaggaggggtgacttggctgccctggcctctccccgtggcaacctttgtgtcttgccccggaagacactgagttcattgtacatgtacaccctctgcgccctgcccacccttgtagctggtctttgttttcttacctcccctttctgacccatgtatatcatattatgtgagataccatctgcctgaaaaaagaccttgtgcggattcttgggaacattgtagctgtttctgtgttttttcttaccttgtagtctggttctgaattatgagaggaaaaaaaaagtaattatgatacattgtagtttgtgtacgatatatgttgataacgttttattaaagggacatcttttttccgcagcccttcctgacatacttgtggggacccgggtaggagctgatggtaccgatgaggaaggagacgctgtacccggtgccgagtacagttgccttgggaggggtttgggacagatggaggctatccttactcaggctgaggcagctgtagtcttctggcttgcagtcacatcttaccttccaaagctttgcttgtacaagtcaagaacggtccccaaagactgttttctctacaggtggtgggcagacagcaaggtggccttcccacattcctaccttcttccagaggccaaatttgttaacttcccatgcccaaatgcatggttttgaggttggtatgggcgtctgtaggcactagattgttggaaggttttttttttttttttttttttttaaagatttatgtgttacggacattccagaagagagcatcagatctcagatctcattacggatggttgtgagccaccatgtggttgctgggatttgaactcaggacctttggaagagcagtcaatgttcttaactgctgagccatctctccagcccccttccctttcctttcctttcctttcctttcctttcctttcctttcctttcctttcctttcctttcctttctttctttctttttctttttttcttttttttttttttaatctcacagaggtggaggtgggagaggcaaggcttgggaatgggcaaaggatttcaggagtgatccagagcgacctgtagcttacagaggggctggacagagtgtggcagatgctggttgtcaatgtttgaagtcctgggtacatcttccaggcatgggggcagacagtgctgaagcaaagttctttctgcttttcaaagaatcttagaaccagattgtcgttccacaggttggagttttgcctttgttagtacttgggacatgaccagggacagtgttcacctagacactaatagtgttgaatgtgagtcatgtgtgctcaccccttggcaaatgctattaactcggaaggatggtgggatagagggaagctggggagctcttctcagcagtttctgactgtgggaaagcatcccctttggaccagtaagtaatgcaggctgtgacatccacaccagtgactcatttatgcttccagacaagagctatagaggggtactgtgtaggagaagacgtcccagctctgtctcaggtggcggataacatgcagtgcatccgtcctccgtcccccaccacttgggccccagagtagcctctacaagttgtcttttcagcatcaacggccacttggagcctggttttggagaaaagaattgatcctcattccccagagtcttgtcattaccttgcttggatctaaccaagacatcagggatgggccagaacactgctgtgagcagcatgaagttagcagagcttaggcatcgaggagtcagcctatgatcttccctgctgcagcctctgagccacaggcatcaggctaaggggtagctggcctggctggagagatccccttggctgccttttttctggaagctgcagtcagagaacctgagtcagggctgtctctttacctgaggacctggcctaggcctgtctgtagggcagcagaggggctgctctaagactgcagacctcaggagtctgagctctaggcacttcgagagtcacaactcctttttttgttggccctgactcttcagtggaggagaaccatctgatctccagaggtgtgtggctttccaagccgtagctgcgggctgtgcagggaaaggggggctcgagggaactccagccctgggctcactgagggcttagccttggacttggatgttgggggccgtgtattgaaaagatagtttagtctgtctgctgatgggcagagacttacttctgaggttcctttctcttgcagtcacccactacacctacctgctaagcatcctgttttagacctggaaggatggtgctaccccgggagacctgcttttgtgggttaaattgagtcaactagatagtaaagactatggtgttgggcccgtgttagtgaccaacttgaagagctgttggcatttgaatgactgacgactggaaaacggcttaggtcatctagagaatagatcaaggtgggtcctctggagttctcagagatgggaaatggaactgggaaacagcaaaggagggcatctggtgaacccccataaccccctgcccagcccttgattccctggcagtttgtcacctaaaccttggatctcatcgtgccttcctatctgttccctgggaccaagcccccaaagccccaaaggctcctcagctgtggcagctgagtccccaggccctgtgctgagtcttctccaatccagggtctggcttctggctggtgctcagtgggtgtttgcagaggaacactgaaggctgctgagtcagtcagccctggaacaggcgcaggacgactgttcccagtgttcaggcaggaccttaggtgtgtggggggggggggggggggcgggtggccttggtgaatatctgttactgcagatccataggagactagttcttgtcagtggcaagactaggaactcctggggacagggactgtggctcccagcttgagtctcccaaccccagcacagtaccttgctcacagtacatagtactagaacagtgtgaatggctaagttgccagggatgtagggagcctcaggactccagtcctgacacatttggaggtccccacatcggtctgtctgggttagaagcacctgctctccacaagctgaactcctgaagccgggcatggtggtgcacgcctttaatcccagcacttgggaggcagaggcaggtggatttctgagttcgaggccagcctggtctacaaagtgagttccgggacagccagggctatacagaaaaacccggtctcaaaaacaaaaagctcaactcccgaaagatggagcctaaatgggtcgggtgagcagtggcctgaggtagtagattcatggagcatgctctcaggtggcagcatcctcaacaggaagtgctggccttgctctgtctgccctgtgaactgaaaaatggggccagcctgggaaggagacagcaggctctcctaggttcatcctccccacctccaatctttttagggaaagcccctgctgggagactgtatggcccagcaggtagagctgaggccccagctaccagatggcattcctttagtgccttaaggctcttacccaccaggacacctggaaagttgaaaggatgcttgcagagggtgcttccccatgggggagcaggaaaagccagctaggacctggctgttgcatgtgtttgaagaggtctggttcccaggacccagggtgggtgtagatggcaaagtgaaagatacacaaacaggcactggagttagggccagctcactctaacatcagacctgattttggctgaattgccacctctaaaaggtctctggaggcttggctacccagtcgcttgtacttcctcttttggcagagatgctccattgcaactctgcaggctgctccaaactttacccagctcagagctcacactgtctccaatgcttgccctcctctccattcaggcctttaccctgtatcactgactcagagactgtcactccacgtaccctctctggcctgggagggcagtgctaacatcatcctcagccgccagtgattcacaagtatgccccctcctgggaactgcctccttccaaatcttatggtctcctaggcagtggtcagtagctgatgtgggccaaggtggtgctatcttgtcccaatgtagaggttttctatgtaggaatgcaaatcctgtggctgcagggcctatttcgtctgctcagcatccacagccttggatcagaggtctggcacatactagacactcagggaactattgagaatggatctcatggctgccaacttgtcatccaagacaaggaagacatcctagagttggctgtaagtaaattcatgtctctcgaagctcccaggatgggagtgggcagttcaggtttccccgtaccctcagcattcatacgggcatattaaaaagacagtttttgggttctatgcctgcttcaagggacttgaataagtaaactgagcctgggtagctccctccagccttccaagtgaaatcacaagggatctggcaagcatcgcctgggaccaccgaggactagcctcagagaaaagtcagcagaaagtgaacccctttcagctggggcttctaaaacctccaaagtgatccgaggaaagtctgattagctgcagcccaccaaaggtgaaagatggtgtgcaggagcttagtgcccactctgcagaggacctggggcagctggatcctgaaggctgtggggatggcctcctcccaggccaggcataagtcctgtgagactaaactgagccaacctttctccctcatccttaaaaataaaaaaaccagtatctacctatttttgaactagagatgagtgtagcccaggctgagcaggaatccccagtgtaggcaaggatgaacctgaacatcagaccttcctgcttctccctgagtatctggatcataggtatatctcggctgtcagaatgaaggagcttttcaattggctgggcacattcactatgagactattattttggccccaagtgtgaccctgcatcccctcttctttcctcctctacatagcacttcttcctccaccctccatgttccacattcccaggcacctagcctgccagatccctccatctttcctatccccaagtcctgcagcccctgctaagccccaaagctggctgaggtgaaagagcacatggctcagagctactattaccaagctactaggcctctctctgctcttcccataggagacctgggtattcagagccacctcacccaaggcctttcttctgcgggagtggcagttacccatgtatgagccatgtggctctcaggttctagggaccccactggagcctcaggtgtgatcacagatgcagtgggcagagccatctcttccatttgtgctcctcacaggtgctgggcctaggctttctcccaaaacacccacagggtctgtccccaggtgtataccagggaagctgactcagaacatcagacgggggaacatggggacagttcttatggtttctcatcatgccttccacatacccatcactcagtactttttttttttaagattcatttattttatgtatacaagtacactgtccttgtcttcagacacaccagaagagtgtgcatcagatctcatgacagatggttgagagccaccatgtggtagctgggatttgaactcaggacctctggaagagcagtcagtgcccttatccactgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacccaaaactctaaaggaagtaatattagcttcaggatttggatgaagaaactcaggcatcgtctgaattcacatgtgtgcaaaagcatagctgccccaggacctggtctttaagaggcaagaaggcatacggtgtggtctgcatacagcacatactaatatctcacagacaatctcacaccaatgcaatactaagactttatttccatagagacaccagaccgtgggagagtggaaggctcgcccaggctccagcaccaccgtcccaggacatgagctcttctgaggcaggaaggtagtagggcaccaggctccagaaagttcttagttcacacaacaccatgcaagtacagagctaaaaacttcctgaacgtctccggctggaaatcaacaggcccaacaggttcctggaaaaaaacacagaccattaggattctactaccatttcatggcagcaaaggaaatggatcacttcctcagagtcaccagtgcctggcgagtcactgtcatctcctgcatcatctctcggtgaacaaggacaccaaggagccggtgctgcatataggcagggttcccagcacctgtcagccatgtcatctgctgacactgctctgacctcactccagccaccagggaatgacaagaacccccagtctactatactggtttgcaggttcctctctcactgctggaggcccaggagggatgtagatctggctcctaaccaagaaatttccaatcaggtatttcactgacaagaaaatgtgacagatctcattacagaggcaataggaagaggccaaggtgtctgtgtgtttgactgactcacggactttcacacacgagggcaagtaggaagaaaaaggaaggaggtttagacagaagagtgcattcgatagcacaggggtacgaatgaaggcaaggaccagggcaagattagaacccaagcccatggtggtggggctcagaagctgaagctgaaactgcagaggtcaagtaggagctctgacccaccatggagttcataatctaggagaaagactagggggagatggcaccagccactgatgggggtgactggcaactgggtgtgccacaggggggtggggccagagaagggcccagactgctacagcatttcaaggggagacacattgtctggctggagaagtaccacggaactgatttaaacttgaaaggccattcaatcccccaagtacactggccctgcgcggggcttagcgggccacacagccaacagcaccatgctctgtctatcctgtcatcctcagagtgcttctcgttacatcatagcctgagctggtttagacatctttactgccactatccagtcatcagggtggaatctcagccaagccccaagtgtagcagaaacagggtcacaggagaacatccacatggctgtcagggacttcagtgccctctggggagtttagcagtcccccaaaaggcagcaatatgactgtgctgtagcagggcccagcaaggccctgaagcaggtggggagcagacacaggaacattctcccacaggaggaaccgaaggcagggcaggcgatgtgagtgctcagtccctagaccccctaccagaccaggcccaactgccaggagtcagcgccctgttgtaatcaccagctggggcacctggacttaccaccaccaccttttttttgatgactgggcgacaccagaagtgccggtaaaggagctggtctgagtctgtccataccaaattcttgacgccctcgctagaagccagatctgtggtgttcaactgcagcaccaggaactggaagacacggccatcagtgcccacgctctgcacgactattggctgctccaagactttggctgtgttctaaggaaagtagacagacatacaaacggaatagtgcacacaggtcaagcccacgcctccctttaaaacacccacttgcttccgttttatggcttcacctcagagcaggtaaggcagaagacagagctccacagcccacagcccagcctctcttcacctgactaagcacctcctcctgtagcctggccgccctcaccttgccgccctcacctagcttggccttctctgcctcaaggatcccagaatctgccctgaaactccagagataactcctacagctcactggcgattactggacaagccttgacgttcaggcagacgcgttgggaggttaatggtgggaatccttcagctcgccaccttacctgataagagtgatgggctatcaaaggctagtccagaggtttaccctcggacctatcattcagttctcactccatctgacagatgaggagacagactcaacatggtaacctgacttgtctccagtcacagagaacatgctgccatcagtcttgctctggaggctctggcatcactgggtacttctgaaagccctactgcctgctctgcagtcaaccgagtttcacttgcttactgcaacttacagtgggccgttcctgggggatgtcctcccggcacgtcacggccagggcctgtctgatctcatggtaacagtaatgacacaacagttacgagagctcacccaaatgcccaggtcccctgcctgaccttactcaccgctctcataaatacaagtatatgcctgcttctcaaagaagctgaggtttggagaggtttgttcaaggggtggcctgaggcatgaggaagtcaggcaatcccactgttccagtctgcacgtggtagcccagcatacctgacgggagaacctcttctcttctgtttcttgtctgagcaaccctatggcccgcctctgtacacttcgtaccaatgcagcctgctactggcctaagaagcagagcattcatactgcaaaaatgctgatcttagcccctccagggttcacctgactttaggactagctaatggaagtcccaagtgtgggccacaccagggctgctggtcttataaatacctgttcttagctgcataagagataaataaaaagtgaagtacatctaagtgttagccgagattccatattgactcttctatctccctctacagatcaataaaactgcaggtagtacatacatttctcagcaattttaccttttacat

SEQ ID NO: 566 - DNA, 1949 bp, Mus musculus
ttcggttgagctccaagtagaccaggcggcggcggcggcggcagcggcagcggtgctgaaggcgcagagggcggcgcaggcggagccgggcggcgggcgcgcgggccgcgagcaagcgagctgcaggcttcgggcgggcggcggcgcagctcaggccgagccggcgcgggaggagttccagggcgatggggccgcggccggggctgacgctttgacagctggaaagagcgcggagcctgcgcctgggagggagggagcgcggcgagcggagtgtgagcgagcgggcgagcgccgggagggggccgggagcagggcagctcgggagaccggacggtagcggcggcggcggcggcgggctcggcgccctcttctctgcaagccatgtttgccaaaggcaaaggctcggcggtgccctcggacgggcaggctcgggaaaagttagctttatacgtctacgaatatttactgcacgtaggagcacagaaatctgcacagaccttcttatcagagattcgatgggaaaaaaacatcacactgggtgaaccgcctgggttcctgcactcgtggtggtgtgtattttgggacctttactgtgcagctcctgaaaggagagacacttgtgaacattcaagtgaagcaaaagcctttcatgattatagtgcagcagctgccccaagccctgtgcttggcaacattccccccaatgatgggatgcccggaggccccatcccgccaggtttctttcagggtcctccggggtcacagccctcgccgcacgcacagcctccacctcacaatcccagcagcatgatgggaccccacagtcagcctccaggaggagttcctgggacacagccactgctgcccaattccatggatcccacacgacaacaaggtcaccccaacatgggaggatcaatgcagagaatgaaccctccccgaggcatggggcccatggggcctggcccacagggtgagagctgtgtcttacactggattgtgtgcttggcacagttagccaccttgtggtcaccaggctactcctacaagatcccgtactcctcatcatcacccggaacctatgtgggaccccctggtggtggtggccctccaggaacccccatcatgcctagtcctgcagattcaacaaattccagtgacaacatctacacaatgattaatcctgtgccgcctggaggcagccggtctaactttccaatgggtcctggctcagacggcccaatgggaggcatgggcggcatggagccccaccacatgaatggatccctaggatcaggtgacatagatggacttccaaaaaattctcctaacaacataagtggcattagcaatcctccaggcacccctcgcgatgacggcgagctaggggggaacttcctccactccttccagaacgacaattattctccgagcatgacgatgagcgtgtgaccccctccgagacgctgggagccagcattgcaggcagaagatgccaagaattatgcaagaagtgaggtgtccataccaggagctgggggagggcatctcctgctccctccaccctcccattcactcccccaccttccccaattttagtttcatgcaataaaaaggccaaacttttattccgtaaaacatgaaggacaaaactcaaaaatatatttcaagtcaacggccagaaaactctcaccttcttcccgcccaaaaggacctttctgtacatgacactttttgttggtttttttgtttgtttgggattttaccgttgctgggattttaaatttgttttttttttcccggggtggggggtgttctttgggggaattttttttttaatggaagcttctagcaagccctatgccccaccccaatcaacctctttgctttcttctttaaaaaaaggaaaaaaggaaaaagaaaaaaaaggaaaaagaaaaaaaaggcca

SEQ ID NO: 567 - protein, 391 aa, Mus musculus
ASGRAPGGGREQGSSGDRTVAAAAAAGSAPSSLQAMFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQGESCVLHWIVCLAQLATLWSPGYSYKIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 568 - DNA, 200418 bp, Homo sapiens
  misc_feature (1)...(200418): n = A,T,C or G
acagagggaataaccaacctttactgagcactctttgggcatctagtgctgatctctgtatccccacccatgcggtgtcgggtacgcggatggaatggaatgagtggctcagatgaagaaaccttgccatttccagcacactcatcctcaggatgaaattactctgttatgctttgccacaaaacatggatccttcatttattcggcacacatgtaagccaagtaccgggcaacacagaggttaacaggaacctgttcttggcatccctcagcatccacaggtgtccaggctgggtcctgagttcacagatgctcatgaattcctacatgaagctgcaagagcttcctggtcaccttccagcctcatctatcaccacttcctcctgagccccatgtgcaccccctgaacccaccattgctctaatatgttggctgtctcatgcctctgtgcctttgtccatgctgttcccatggtctgggatccctttacctctgctggcctgcctagcaaactcctactcatcctttaaagccacagctccaagcctgtttcccctggacagcctcatctcctagactgtgagcgcctcgatggtgcaggctgagtccctccatgtctgtgtgcccagagaggtgaaggcacttttccaaccctactgaggccactctcctccctcttcttagggactccatgctagcttcaccctcaacctccatctagttcctccagccttgccctctgcatggactccctgcaatcagcatttgtgcaggttctagtgtctcccactttccagcaaaacacagcaacactcttacctgtgggtgctggctgtctcttaccccaagagttatccacacttgctgtctcctctctccctcccactcctccacggcattctctctcctctgcctcccttccactcctccactgccggggtctggctccagcctcatcactcccctaaaactgctctacgtggccgggcgtggtggctcacgcctgtaatcccagcactttgggaggctgaggtgggtggatcacctgaggtcaggagtttgagaccagcctgattaacatcatgaaaccccatctctactaaaaataacaaaaatcagctgggcgtggtggcaggtgcctgtagtcccagctacgcggggggctgagacaggagaactgcttgaacccggaaggcagaggttacagtgagccgagatcgcgccactgcactgcagcttgggaaacagagggagactccgtcttaaaaaaaatagtaatactgctctacaccggccaactgtgcccttcacagagctctttccaaaagccgtgttcatgctctccgttgctcggccactctctcctggaagcgctgtcttcccggggctgcctcctcctctgcggctctgaacagtcctccttggtctccttcactggctcctcctgcatcagccctgctggtaaacctaggagcctgtccctagcttccccctgagagcactcatccattcccattacagccagaggaaggaaggtcacctcctccagctgccttccttgacaccctggggcagcctagcgcccctgcactgtgcccacgggggcctatgtgttccatcaccacccttgtcacgttggatcttgtaggtactaatggagtcatctgcttccccacaggtgacaaacctccaggaagcagggaccacagctctcttgttcacacatccatcccccacatccaggacaatccccaacaagcaacgggctgtgaagggagatagggtcagatcatgaaggaccttgaatctttttgctgcagaatttgggcttcattttggataaaatggcgattccccaaagggttttaagcaggagcgtgacatggtcagacctgtgccttaaacacatccctctggctggggaagggagggtgaaggggagtgttctgaaggcagggagaccagttaggggctgtgcaacaattcagggctggacccaaccatctctaccacacaccagggggccggtctctgcttctcctctttctcactcccagccagtgccaagcttggccagctggatctggtaaacacggcaccttctgtgtgctctcctcacctggtagaacggtgttggtgccgggtacagaaatggagattgactacaggaattggatggggagaaataatgaggccagctctggacacatggactttgaggcaccagagagacaggcagatggaaatgctctgtaactgaacacacatggctttggggctaagaaaaagggtctgcgccagtgggatggattcaggagtcattgtcattgaagttcagatgcaattagtgccatgtgaacttgcccaaagagagagagaaggtccaggacagagcctgagagaagcccatctgtcctagattttactactgttcagcaaacattcactcccccttcctgccccattgatgctgggcttggccatgtgacttgggagcggatgtgaggcttgcgtgagttggcctggcctctggagctccttttactctggaaagaacatgacagacatcctctgcccttcagcctgtgccccagaatgagagacccatgggacagactcaagctgtaccctgaagcagagctgcccagttgactgcagacctgtgagtgagaaataaatggcttttattataagccactgagatttgggggctgtgtgttaggtaacactgtatcagcaatagtttgactaataaaatttttagaggaggctggagaaaaaagaatccgttaaaggataacaggaagaatagcccgagaggaagagggaaaaccaggagagagtggagccctgaagctgtgtgaggagagggtttcaggagcatgggaacctctgatgctcagacaggggtgtgctgcgccattctgcaccatgtccgtaagtctttcccacatgtgatgcttgggtcatcacccatctctttttagttttttaaaaaattgcaggccaggcgcagtggctcacacctgtaatcccagcactttgggaggctgaggtgggtggatcacgaggtcaggagttttgagaccagcctggctaacatgttgaaactctgtctctactaaaaatacaaaaattagctgggcgtggtggcgtgcacctgtaatcccagctacccaggaggctgaggcaagagaatcactggaactcgtgagacagaggctgcagtgagctgagatcgcgccactgcactccaaacggagcgacacagcaagactctgtctcaaaaaaaaatattgcagtaaaatatatataacaaaatttaccattgtaactcttttatagcgtacacttcagtggcattgagtgtattcacattattgtgtaaccaatggaatcatcatccatttccagatctttttcatcttcccaaactgaagctctattatcattaaacgctaactccccactccctccttccccaggctctggcaaccacctttctactctgtctctctgaatttgactattctaggtacttcatatgaccggaatcgtagagtatttgtccttttgggtctggctgatttcatttagcataatgtcttcaacgttcatccatgctatagactgtatcagaactgcattcctttattatttatttaatttatttatttttaaatttttttgagacagagtttcgttctgtcgccctggctggagtgcagtggcatgatctcggctcactgcaatctccacctcctgggttcaagcgattcttctgcctcagcctcctgagtagctgggactacaggcacaggccaccacgcctggccgagggcagctgtcattctaaagaggttcctttgggaggggctctggtgatttgacctggaggaaatgaggtgggagtgaagcctttaccttggagaagagtgaccagcaagagcaaagttttggcaagtgaatgaaaatagagccatgctggtcccaggctgagagaactcagaggctagggcactctggtgagtctggtgaggtggagttgggggagtggtgggtgtcaggttcctctccccagctaccaggatagggccttgccttctgcttttttttttttttttttgagacggagtctcgctctgtcccccaggctggagtgcagtgacgccatctcggctcactgcaagctccgcctcctgtgttcatgcctttctcctgcctcagcctcctgagtagctgggactgcaggcgcccgccaccatgcccagctaattttttgtatttttagtagagacggggtttcactgtgttagccaggatggtctcgatttcctgacctcgcgatctgcctgcctcggcctccacaagtgccgggattacaggcgtgaaccaccgcgcccggcagccttctgctttcttgtacttcccagcgtccctggctcaagtgatcctcccgccgcggactcccaaagtgctgggattacaggcatgagccaccatggcctgtcagagtacttaaattctttttttttttttcaagacagagtattgttctgtcgctcatgatggagtgcagtggtgcgaactcggctcactgcaacccccgcctcctgggttcaagcgattctcctgccccagccacccgagtagctgagattacaggcacatgccaccatgcccggctaatttttctattcttagtagagacggggtttcaccatgttggccgggctggtctcgaactcttgacctcatgatctgcctgccttggcagcccaaagtgctgagattacaggtgtgagccaccgtgcctagctcaaatgcttaaattcttatgaaggaaataggtaggaaaaaaacaaaacaaaacaaggctgagcacatgggtgctttcaaattgaactaaccgattctatactaacccattccatacttgaagcctgttttgctatgacaaattggctcaggagaagtatgtgtccgttggaagacatttcaaaacacatttgattttaaatttaaatccacttctttcttagcacctctctgtttgctggccatgagtaatcatctttttcaattttcgaaacatttccccaattactgtctcccctgagcccccaaacacccatcccaagcggctactctccatcatcagaaccttgggctcagccaacactgactaatagcctagtaggcgattccccatcacttacctctctttgtcctcccagcctgcctttggcataggcattaacatactcattgcacagagaggacggtgaggctcagaggggaaggtcacttgcccaaagtctgccagcaaggcagtgaagccaggtctttgcgtgttggattttgtattccccctgtggaggcccccgatccctcagggaaacttctgctaaaaccagagctgaccggcccgaaggttttgatcagaggtatccccgtgcaattctaggactgagcgtgccgggtgcagaagtgggctgcatactcagcttccactgaaacagcccccagcgggagcttgcatccatcctcctagcagctgtgaggagcactgaaagagagctttgaaccagggaaagggaacaaggtcttctggcatccttggcaagcacagtctcctgggttgagttcatgggcctaaagtcccttttcctttaaccacctccttctggaggcctggaccccaaccatctggtgccagaacccaggattcctgctgccccagttgctggcagccaagagaggaaggagcggcccttctagcctaagcttggaattcacctctccgtcttcactcccacctcacttgcatgtcctgcaacatctggtcacccagttcatctgtccttctgttcctttcaccatgttactgggcactgagggtaccccagaaaatgatgatcattccctgaccctaaggagtcatattcccatggggaaaatgcacccctgaaccacacccatgcagtggggacacagagggcacacctgccccgaactgggagttcagaggggggatctgggaaggctctctgaaggagatgctgcctgcccaggctggatctgagaagtgttagtgggagtctgtcaccggagggggctttgggcaggggacttcactacagtgtaagttccacggggtaaggatttttgtctggtttatctcccaaggcctagaacagcgtatggtatatagcaggcgttcaataagcaggtcctaaaagaaagaaggaaaagaaaaaaaggaagggagggaggcaagagaaagatgggggacagagagacagagagaatatgagtcagggtggatgtgtgaaatggcatagccattctggaaactgaaagtacagagttccaggtggctgtagtttaggagggtgtggctgagccgagggagtggccttatctaaccctattgttggtggtatccattccttatctccctactgggcccagtactttggggctggggtgagttttccctctctctctcggtccctgggggctcctggtgcctgcactgagtgttaacatacacaggtattgagcctgcgctgtgtgctggagatacacagataactcaaactgagatcctaccctcccagtctggtgggggagacagacagtaaacaagtggctacaacaatggggagaatgaatggtgccagcaaaacgagataagattggagggacagaaggacaggtttcactccaggagtgagaagcagggaggtttttgtggaggagatggcactggagggaggggatgttagccttaaaggatggtagaagaagggaactgaggcaggaagcattccaggaagacagacttcaggcccaaagatgtggcctggggggatccagaggggaaaggtagactggggccttgaatgctgttcatgggtgtttggacttgcttctgatctgaccacattttggataattgtgccagcagccacacacctacttagggctgctgagtggtcctgcttccagggaacccctcagcaatcttctagccagcaggggtgaggggtggctaagacactctccctgctctctctgcccgggccctctcaccatctcttttagctccaacaagggatctaccaaccatcgtgcagctttgttgtgtcaagttccagcaaagggctgaccacagagtgcctggcacaggatctctgaaccctacccctctcttcttgccacatgtttggaaaggaggtgctagtcctttttccagggtggtggtagggagagaaaaatataggagggaaattttaacattgtagcacatcagattatcaagagatactgtatatcttctaacctccctttgccatttgacaggtgaagaaactgatgctcaaatagatatgcttgtgttgcagccatgaagttgataagggcatggccaatctggttgagtcctgggtcatagcagggccggagaagggcagtgtcttcctttttttagccaggaccaaaccgatactcctaatttgtgggccttgcagacacaagatgagtcaggcttcttgtgagtcagtctgttgacaagccatccctggccattcctagcccattcaaaatagaaggaagtccagggcaagggtatgagcaggccaatttaattagtgtgggctctaaggtaccttaagttagccctattaaattaaaccgcctaggggaaaaaataactgtaattatttccttctctcccctatccttgtattccaactcccaacctccatgcttccctcattcacgaaacaacctttaaaatagggactagcgcacagacgcccataaactaggtctcagcgttccttttttctgcccctttcccctgtgagcgctgggtcctggaagggagcagagtgagtccagaggtgtccgcagggcctggctgtactctaatttagggaggttgttacattgagtagaacattattccaaaaatgcacccagagtctccttcctgaaccaatgcagattcttttgctgcggggcatttcttttaaaagccccttttctctcttctacagatcaaaataagcaaactttaatggtagggaattattgtttattttgttgaaatctagttctgagttttcctacttgaaacgtgttttccccaggacactgacctatcctttaattgtttggtgcgaggcatgttagggggaggggcgttacttgtttattggaacagcgcagttaaaaaaaaaaaaaaaaaaaaaaaaaatcaacctaggctaacagtttcaaggctcccctaaagatgtatccaaacaggcagccaatcagcgcttacacagctttttctgcttgactcttttaaagagacagtgccgacagtgttttatcacatttaaagagatccgctctctaaaaacagtctgaaaatgggggagccttcccctatttcgccggtatctggtcttaagagtccctaatgaggggcacgcagtgtgtcttctgggttctcggcgtgggcagaaaggagtcagcagcaaatagctgggtcactctgccagcccccccctcaatttcccattgtacacctgggtcactgacaatggaagcttcccctccccctacgcctgactctcgtcccctcactccccaatttagctccatttatttgaagtttgcagatttctgtggcgagcattccgcgtcgcgggccgcccaggtgacgccccccatctccgagtggcaccctttcccgtgcagaagccgaggggctaacttgccaagactggcaaaccttggaaatttgggagaaatcactctccctcctcttaattcaagtcccctgtccccagcccccctcccccccggctccccaaagcacgccaagggccattttcgcgcggctccactttggggttttccaaagtattttaatgatctagtaaaggagcagccgcgcgcctcggcgccggctcgagccgcccagctctcagcgtggagccccgggcccggcgctcggaagccagactgggcgagagggaggcccgggggcggggcgggctgggggccgggctggagtctggggagggggtcggggtcggagcctagggggaggacaaccaagagcggagggcgagataagggctgggctggtgcgggccgcggcgggggggagctgaggggcagataagggagagggacggggcgggagggagcgagcggcgaccgcttgggggtctgcgccccctcccatcggacgctgccgcagcgcccccctagccccccagtggtccacgccgcggggagcgcgggtcagatccccctcctcgctggggcgaggagaccagggtgcccccagcccgatccacgtcgcccaccgccccggcgacagaaagagaggctcgcgcccccggacgcccccagttcgcctgcaggagcaggcagcggctccgcggaggcggccgcagcggggactgccgcggccggcgctgtcagggcgtccctcccagccggcccgggcccgcccccgcgtgcgccgattggccgaggcggccatccatcgcgggacgttgccgcccgcctcgctccctcgcccgggtagccacgttcggttgagctccaagtagaccagcggcggcggcggcggcggcggcggcagcggtgctggaggcgcagagggcggcgcaggcggagccgggcgggcgcgcgagcgagcggagagcgggcggccgtgcgggcggcggcggcggcacccccaggccgagccggcgcggaaggagttccagggcgatggggccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagtaagccctattttgcaagtggcggccgcgccgccgccgggctgcgggcgggcgggcggtgggaggcaggtgggcgggcgggcgggggccggaggctgctgcgccctcgggtccccgggtccaggcgccgcctgcctggccccttccccgaggccgcggcgggcggcgtgggagagcccattgttgggagccggcggaggttgggggatcggggaaggggcggtggggggagccgccggagggggtacttggtggccgtggcgcgggtcgagcgcgggggcccgcggtgagtggtgggcgaggtcccgccagcgagcctcgacgttctccccagccgggcgctccccgcggtggccgcactttgcccaccgggtgcgggcagggggcgcgtggcttctgcagccccgaagcctccttttgtccgcccgcggcgtgaggagtgcgtgccgggggctttgttcggccgggagcgctctcccttccctgtcctcggcttcgtcaccggctccgcgtcctcggacgccgggctgggcagcgacggtggtgccggcttggccccaggcttggggcacagttgtttggggggaggtgacgagggtggcgctttgctgccctctccagagcgcgccaagcacccggagtccagggccgagtctcctcggacctccaaagctggcgagagcgtagcgagcagtgggtcgggaaaggcaaggtggctgtggggtcgagtggcttgcgagtttgaggaacctaggtgggtttgcccgcgacgccacttggaagttcaagtttgggggctgctctccatccctcaccgcttgaggtaacgcgttccctggtccccaccccctaactgttcgcacctggcggccctgtttggggtgagctagctgcttacctctggtcggggccacaatgggacggcgcagacagggctcaaagcctgctggcaaggtcctggagagcgccggtgggatctgacgcctttccctctctctctttgccccctgtccactttccaggttagctttatacgtctacgaatatttactgcacgtaggagcacagaaatctgcacagaccttcttatcggaggtgagtgggactccccccagcatccaatttcttgacaccccccccccccccactattcttagagcctttgttttcaggagcagccactgtggccaccattttgaatttttatcaccttttggcatttattgttagttggtcttcctagccttttggctctgggaagcccccagcccaccccgtctctgctcctctaagctgcttctgctcttacctttccagattcgatgggaaaaaaacatcacgttgggagaaccgcctgggtttttgcactcgtggtggtggtaagtttgtgtgatagttttgcatgtgtgtttgttttgttgtgagccctgggtccaagtgaacaaagaagggaggcttggagcaggccctccgccctgtggccctctgcgttgcacagagcggggcacctcgaggcactccggcccagctggccaaggaggagaagggcggaagaggatgttacctaaagttttggggggaaaaacgacaaaaccatctgtggtgttggggtagaaactccttacttttacatttcactctggggctctaggcagggggtttgaaaaaacattggaggatttttgtcaattctgcatgttgctttaattagaggagtgggggtggggcggcgtggaggggataccaggtctgttttacaactagcctgtcccttcctttttctcctcgggagctcacaaccttaagagaggacatctaccggggctttttccaggcaccctgagaaagagcaagaaagggctgccacttcctttaaagatactgattcagactgactggtccttcctttcctctgggagctccccgcccccctcccccactaaaaccacaaagtgttgttttacgcagaaccttaactggtcagagtcgacctcgcagtgtctgcagttaggggctcccactctctgtgactctctaaccaggcctctgtgtcctttgggtgtggggccaccgcaggtctggtctctgtgttgggtatatgacagccaggagggagctcagggtcagccggagccagttgccctaggtatatgacccgggtgttttgtgggactgactggtggagtctttgacatccttttgaaaaagaaaagaaagcagagtggcttttgatattttgatggagttcagcaaaacggtgtgtcctgtctcctgtcgttgggatcttagcgggtttatctgccagctcaggttactgttttaagtctcttagaacagcaggaggatgaagtgtctgttctaacttgtgcagagaaaatgagtttttaattacttctgccaacctcggaactgccggtcttggaggcatttgtgtggcggaaggattccacctgtaggagtgggtgataggctttctgtggctgtttttggagggagtgtgtggatggggttggcggctctgatcggcttggatcttgtagaaacttaggtttatgattgaaggttacttaggcttatgagtgaaggggccggggaatttgtagtgttagaaacctttaacgtgtggaggaggtaagcagatgtgtacagttccagaagacagaaaggaatgttctccagcccccctctgcagctagtagaagtcctgattttcctgttatatccagaatctcctgaaacttctccatccttatctcagccgcaggaacgtagagtctgttgtgttaggcccgggcggtggtggctttgagtggctgtggccctgtttggtagaagttggtttgtgcgatttgacactgagcaaatgacccaggctttctccagcgggaggaagcagtggagcttgtctggtgaggggcaggctgcattattcacaccttgagtgagatgcttgtctgatgacttgcagagctggctgtttgtgacgaggacaagagcagtggaccaggagtaggactttggttttggtgcccactttaccctttaagcttgttctgtccctgggcctcgggctcctgatttggagagtttcttaggtcccttgttaatatcactgacaactccgtgtttgaatagggctttattggttgacataggacttgtatgtctgttctcattttaatacagaatgtcggagtgaccatacaaaatctttagtggggggtgaggcaggcatttctaggcctgcttccttctttccctttgctgacaggtgcttctgtgaagagggccctctactgcaatgtgaaaggactggatacttggttgtccatgacctgtcctttgcctaactgatttgtgttttttggtgcatggagggaggagtggttcttgcataagaattccttgagggagggcttgggtgggagtgggggtgaggtgggaagggtggaggtgcgggctctgggattaagagcctgtaaagttcctattgccagagtcttccaaatcgcggcatatatgaatcatagttgtgttctgactttggcacttgaaccttttttaggatatgcagccattttggtttgggtggtaaaaaggaaacagattagaacagtatggattctcgtccacatttgcgttcatcctcctagggcatccatgagtaggttctactaaccccttggagcttcagttgccccctgtgtaaagtggagagaaaattgcctaccttacagtatatggtagacacaagtaatacgggtgtgaagcatccggcatgtagtaggtatttgatatataagaactattactgccattactaatggctggcttgccagaagaagttggacgtgttttgttttctaggctgtttgcccaatgagagctgataaggtgggattgagcctttgggagacctagtactgttagcgccatgcatcgtgcacttgcccttgtgtacacaagtaataattagtaacctgaccttattttattttcctcctcgcagtgtattttgggacctttactgtgcagctcctgaaaggagagacacttgtgaacattcaagtgaagcaaaagcctttcatgattatgtgagtaacatatttttaatcctagcaataattatagggttggatagctctaacttctctagtacgaaaagcaaacacagccagttcgcagtggtctttatttgcttcttgcgtttctttctgttcccctgcccacctctctgcagccctcccaatggtacctttctccagcagtgttctaacttggtgaacggtgtttcataatgttgtaattgtgcaaaattgtgtagatatctatccggagaattaaatggtgttgtacaggactcagaactgtgagacttatgttaagagtggacagttagctgagaggggactaagcctctttagtgttggtttaagaagaaattgtaacaaacaaaagccaataggaaacttgcgttttggagttgagtgagaatttggtggaatggactctcttgctctactttccagagagcgatctttcaaattatgggtgtgtgtgtgtgtgtgtgtgtgtgtttggtgtgggtgggctcatactgtatctgctaagacgatttgtactctgagatcctcagctagttcataatcttgtggccaaaatattcttgtgaagctagttaacatcagattgtagttctttctaccctgttactcactttctacctggatgagtttcttaagatttatgaaattattacgagagggttgtctgccatctattcatctcccatagcagtccccttcaggaaaaacaaacatgggtttcaaacctgggttgcagtcacacttgatgatctgatgaaatgggttaggatctgtcttggggagatggaagaggacgtgtctgaaggtcttccatagcctctgttcagttcttcttgctagccctgtagacagttaagcatgtccatatagcaggtgatctaatggtcttgctcttctgtgtgcagtgggtaggaatgatcctgggaaaccatgggtccttgggagttggtttcttgaacgtcattgggtcccacctgcttggcccagccatctgagttccctgcatgtggaggtggaaattggctaagagaccagacccatctggttatttcacaagtggtcaaatcccatgatcaccaatgtcttcatggtgaaaatttctcctgtaatgtgaggagttagagactcaggtggtggcctactggttttgagaatattcaatgtgatgcagttttgttgtgaatgaaaagttaatgctcttggaatgtaacgctgaggaaattgagcagttcttgttccctcttcagggctgaaaaagagaagctgatgaatggtacttctggtctggtaaacttgcatggtagtgaaagggagaggtcaccaccggttcacttatgatgtggttcttctgggaaaatcccatggtgatgataaggtttcctgacctggatgttcagggaggctaagaggtacacagccatataaaaatagttgatgaatttgacctttctacctagtaaaaatcttgcatggtttttttcctaaacctgtgaacagccaacactgttgctagtttttgactgctatgtaaatagtttcattttagaatctggggatgggtgggtgggtctttcactctcttgatgtagcatatctatgctattttttgcctgtacctttcagagaagttaatgattttaaccaagttcggtgctctacaaatttgagagtctttggcaacttgtggtgtcgtcttccatcctgaaacaatatggcggccatgaaagtttgcacatgggtttgctttcagtaatttgctgaggaatggcagtagaaatgtatagagatcactgaggttggcgttgacatttagaagatgctactaagagatgaggtcaccctaattgaggcctacacttcatatgtgtggggtgtaaaaacctttttttttgaattgggctccacctggtatcatgtggcctgagagtcagagcctgtgggaggagggatggagtgatgaatggggattatgaaggcgttaaggggtagcattgagttggaggggtgacagcagagaagcaagtggaaaactaagaagaacttcagaaaattaggaaaaggagcccacttttctttttgtctttctccagtcttcatctagtctctcccttcttgtggctacagtctagttaaccttcattccttcttgctagaatgattgcagtagcttcttgctgactccttcctcttgcctggaatgcattcctctcttacccattcaaatcctattcatcttttaagacctccttcttggaggacttatgagatagttttctgcattctgtgatcacgccttcatctccatatctataaaaaccacctatacaaagcctctgttggcagctttccgtgtgccaggccactctgctaactgctgtaggttcagtccctcatatcctgccagagacccgatgagagaaggcttgttgttcactccattttgcagatgaagcagctgaggcacacagtggttaattcccagctgggaagtggtagttagaatgcacacacatggagtcatgactgactctggaatgggtgtttctaacaccacctggcttggccctgcaggcccatggcaagtaccatttgttggcactattccacctaacttctcacttagggttgtctttcgggcgacagcctattaattttttccatggtggagaccgtgaactattcatctctgtagctcccacagtaccttccatgtagcaggcacacgtgctgattgtatgaaggagttaggtaagaatgagtaagtcacttgcgggtgagtgagtcttgaatggtgttcttttagagacataattgttgcgggtgctctcgaacaaggtgattttgaagtcaattaactagttgccttaactactttttagaaaatcaagtagagtgtaaataagtgtctgttgactgaccttctgttttctatcaaggagatccaaagattctcagggtgtggggagtttgtgcagcctggataccagacccatcttcggtgggtaggaagtgcttacaggggcaacgggagcattgggggaactcacatctggagtggacttttctgataaattggtttgcattaaatcagaagaggtcccccgggtcatgggaggagggtcacgggaggagggtcacggtcccattgtaatttccttgctgttaccctcaggccagagcagtgcatctcagagtgttgacaaaagcccatgggatcccattggggcatctctttgggttctcttagacactgttgtctgggtcctgaccttttgtagagtggacactttcagctgcatgagtgtctctaactgtgtgcccagaggtgtcctggccaccttctccgctttgactttctccagggtggacctgcagggaagtgtctttggtgccttctcaaacaacaagcaatcctttttctccatgtggtagctaattttgtgttttccttttgatgtcaagaaatgagtggaatttggaaggccaagaaatgagtggcctttgagccaaagagactagagaatagcaatggattcttacactacacatacctgctgtacttttttataacatgttttcatgtgtgtgattgtggctgggctttgcagctgcctcgtcggttgggttttgttacaaaatctcactcccattttacagatgaggaaactgaaccctagagtttaggtggcttgtccaagggcaggcagccaggtgttggcagagctgagactagaaatcctctatctttctagttctgcctctcagcttttattgacacttacttgataaagaatccctgcaaaacagaggggaggtatttgcagttgacctgaagcatacctggcaccgggtatgctggttggtgccccccgacatgttcactgaagaaatgaacttaacagaattgaacggaagcccccgcaaggtgaattgtggagtcactggcagaggcgagacctgaactctgggaagggggtttgttgtggtgcaacggctcttaacttttggcagggaaaatgtgataaaagctatggacagtatttccagaaagccctcataaaggggactttgtgcatggtttcaggaggctcatggacagctgctccaaccccaggcctctctgattcccagtgaagaacttggggagtgaaatggacatggagttccatgaccttgatgaattttccttgcttgcctcagtttcctttctctgaagacctgagttccctttcatcttggctgttgtgtgctccacctcagtgaggctggctccctggccctgtcctcccactccagcaagactctgctctcccaccccaacaagactgctgactcctccctcagcagaggggagactttgccttgaggagggttggttaaagtaggaaagtgccccagagtcatgggcgtgggcaggcactgaggtatttgtggctgtgtggcaggggtccagcgtccttggtgggtttgaaatagcaaagtgatatttgagagggctctccttggatgtgctgagctgaggttcctgccaggcagggagtgtccatgcctgccagaaccctttcgggggagggggacaagagggtggcagtgcaggctggaataggtggagaaggcctgcagctgggctgcaaagagctgggggagtgtgctgccctgtgataagccaggctagctatctgcccagaggtcctggcaagttcacggcgttgcctttggctctgacccttggcacccttgtgtggcagattaaaaacacaaaacatacacacttctttttcccctctcccccattccccttggagcataggctttgggttgcagcccctctttaagctcccgccctgttttctgcaattcctcttaaccccagaggctgccagactcctccatcggtagctaattaaacattaaatgagaaactggagttgcattttgccagcacccgagcagtgcagccaccttaatgggtttcaagtggcggcaagaccccaaattgcaaatccttgccctttatttcaaggcgggaggtggggcggggggagtggtggggacccaaacaaaatttttggcagtggtcacttcatttgaactcccagagcagcagtgtgcaccagtctttcgcataatgccatctttgttagctaagcatttgcaaacttggaccaagagttagctctgtgccagccagcactcagagggagctgggagatacccagctctccccacagttccttaggtcgtctctattttgtgagggaggcagggtctcgagtggggaaccctagtcaagggtgcctggcccccttcccatgacttccctgcctctgtatgtgagtgtgtgtgtgtttaagccttaacagggagaagtggcagggaggtgtgtgtacttggggatctgtcagccaagataacagaaatgtggcactagctgtagcctttataatagtgtctgagggtttagagtatttagaaaaattaatcttttttagcttggtaataattctgaccacggcacaagtgcattagactattcacataaacttctttaatacatgttgctgggagctcttagagcaaatagacaatcatgactgtttgtttttgattcgctggggtaatggggttgttttttttttttttttttttttttttctgagatggagtctcactctgtcacccaggctggagtgcaatggcgcgatcttggctcactgcagcctccgcctcccgggttcaagtgattctcctgcctcagcctcctgagtagctgggattacaggcgcgtgccaccacacccagctaattttttgtatttttagtagagacagggtttcgccatcttggccaggctggtctcgaactcctgacattgtgatctgactgcctcagcctcccaaagtgctgggattgcaggcgtgagccaccgcgcctggccggtaacggggttttttgtagccttggcaaggtgagttttagcagtgtttgtgtctgtgttgtgtatttctttccctgggttttgaatcctctggattttaaaggatttgggttgtgactggtggcttggactcccatgtgaattctagtctccactttgtcatttcttggctggaaatcgtcagggatcctcatttcctggccgggagcctcagttttcccatctgtagaatgggggaatgctgattcctttgcatagtggttgtgagggttaagtaatatagtacagtcatccgtcaatatccagggaggattgattctaaacccccccaccgcccgtccctgctgtcatgtctcacccctgcaccccctcaaggggcagagctggcagtcctgtcacagactggtactgataaatggcgtctctgagatgtctgtgcaccttatctgtattgggcagaatggtcctgtcccactcctgcatatggccactgcatggctaaatggtaaggcccagagggcatgcagcttggcatcagtaggaatctagatttgcatttcagcttcatgtccttgttagctgtggggggccttcatttctcaaggtccatctctttactgtaaaataggctcaagggttgtcctggcacagcccaccatggggacggccttgagagaggcatggaaagctgtccagggaaagttggttgtgctgtgaaatcctgtgtcattgttaacagggatgaaatgaggagtcttgcactgttctctttggtatgtatcctgccctggcaggtgctcagactgtgcctgatttttttttattgtataagggaatccccttttattgtatgtggaaatcccacaaaggcgattcccacatacaataaaaaaaaaaaaaggagtcttagccgggcgcggtggctcacgcctgtaatcccagcactttgggaggccgaggctggcggatcacgagttcaggagatcgagaccatcctggctaacatggtgaaaccccatctctattaaaaatacaaaaaaaatagctgggcatagtggcaggcgcctgtagtcccagctacttgggaggctgaggcaggagaatggtgtgaacccaggaggcggaggttgcagtgagccgagatggcgccattgcactccagcatgggggacagagccagactccgtctcaaaaaaaaaaaaaaaaaaaaaaaaaggagtcttaaggagacagtgagcttgagaagggaagtgtcagccatggcaggtccatgggaagctggttctggccacattggcttctttttcttttgacttcctggggtgaccctgaggccttgatcagtcggcccccagaccaggagaataagacactaccgtattttgaggttaccaagctcctactatgcttactgtctagttgaagagacagatgcagtccaggatgagatgtgggcttaaaaagaattgtgtggaatgatcttgtttttctaagagaccaagatacagtcagtatggagttgggggggcagtggggggaggtaaacagtcccacccctgtgttgtaacgaaatatatatttatcatagatataaatagcaggattgcaggtgatggaactggaggtcacctagtgttctttcaagtagctaaagaaacatgcgcagagggaaaggtgccctgcgtgaagtttccagtagaactcaaacctgcctgcaagcctaatcaatagtccaggatgctttctttcctttgccttgttgcagttacgagctgtgcaaacatggacaccttaagtaacctctgagcctcaacttcctcgggtggaaaatggggttaataaagtataccaggccgggcgcagtggctaactcctgtaatcccaacactttgggaggccgaggcaggcgaatcacttgaggtcaggaattagaaaccagcctggccaacatgatgaaactctgtctttactaagaatagaaaaattagccagacgtggtggtgggcgcctgtagtcccagctactctggaggctgaggcaggagaatagtttgaacccgggaggtggaggttgcagtgagccaaggttgcatcactgcactccagcctaggcaatagagcgagactcagtctcaaaaaaataaaaaaataaagtatgcctttataaggtcataaagattaagtttacacatatacacacaatatataatagtgcctagcacagtgcaagttctgcataaatgtgtgctgtcatttttcttttttaattttatttttaatgttttgtagagacgtggtcttgctttgttgcctaggctggtcttgaatttctggcttcaaaggattctactgtcagggcctctcaaagtgctgggattataggtgtgagccactacacccggcctgtgctgtcatttttcttacctcacctccggcctggtctgagttctggcttcctgatgggcagtgttctcagtgattgataataaggggccagcagaatgacgttggggtgagaggtgtgtgcctgtgaagcgtgaaccatcatgggctagcttccctgttgatcagctctctggatccctgggtttcaggtacccctgggggattgtgggggcaagtcacattatgttctccctgccccagtgattggaggagcaagtcacatatgccgcttccaaaccagccctggtgcttgtgaggatgagaaaacagtggacgcacagatgcttctggcctgtgcctggcctgaagttgccccatcactgtccattttcttctctcctagtgacttctcattttctaggaatctggaacaggtgctttctccagccactttggcctcttcaccatgattcccgcttggtaccataccacctgagagggttttttcctcccctgccaactattcttctgtagagccaatgctagcctggaatgtggctgcctccaccaggcctgccaggacgactcctatgggaagacatccctcttctgttttttccccaggaactaactctgtaactctcctagtcgtttgttaccagctgcctggaaggagagttatttcagttaaggttgtgtctcttccttcccctttctggaatgaaagctccttgaggggaggaactttacttgccctttctgccaccccattcctggggcctattgcaggtcttgaatgcattctggggtctgtgagcaaggctctgagccttgagaagtgagaaggatttgattcctgcccaggcatcaactgtgctaagtactcgttttaatgaagatggacaaggggcacgtggtgaagcactgtttgtaaactgtgagctgtgacccattaatacatcatgaaaccaacttagtgggtcatgactggtaattaccaaaaaagaaacaaccgtattacacagagtaaacacaaatattgtttctggaaatgtctgttttcagtgatttatgtgtgcatataaaagtatgtgtgccctgggtttgtgttgtagtatttgccttttttgggggctcaacgcaaagtcagaaggccactagcccagagacagctgagactgaatcttagttcctacaagttaagtgacttgggtcaagagacaagcaattgctgagcctcagtttccagatctgtactagaaggaaatgatccataccttagagagttctcgggaaattgtttccccaccacatgttgtgctttcagagtggtgcctggcgggcacttggtaccgttgtctctgtggtttgctgccatagtcttagtgcattgaacacacagaaaatcccaacagatgcttgttgaaggcagagtaagtaacagctcccattggagggggtgggactgtggcctggaccactctggagtgggcgcgggaggagagggcctgagagcgcagggacactcttcttaatagcggagtccatgtggctctctaggcaaagctggaggagtttgcagcctgtccctgctggctggctgtggggcagctccttctgcctgtctgtgattgaggtgggtgggtggagggggttccttgccccccgtggagcttgcgtctgaacagggcttaggcagtggcagtagtgagaataggtcgtaaggcatcctgtctgaccgaggttgacccagcctcccaaattccctgtcccctcctggtgacagctgtttgcacagcttccagggcaggttttgtgtcccctgctctttgtgtgtttgggtgaagcgcctgacatttcacttctgtttcacagtcctctgaccttaagaagcacaactgctccctggggccgctgcctgaggttttcctctgatccttctttcccagtcacaaaaggctgtttgagagaggaggcagtggagaggggggagcaggcctctcccacattctgggatactgctgcagcgctttgagctctgagaggggcagagcgtagctttatagaccggatggaaatggcagatggttggtgggcagttattgcccgctgcctgccgggctttgccattagatgcagtgttgtgggctgtacatgggatttggacttggatgaccaaggtacaagatctgattctttcagatggccttgggtaagttgtctggtgtctgcaaaatgataggaaacagtggccggcttttttctgcccctccagctttttggaagttgggtgagagcacgtgaaaatgctttgtgagttgtggtcccctttgagaaggctgtttcagatgtgcaagaagaaggagacactcagtttccagatggggacactgaggctggtgacacagcaagcctggggccaccactgacttgagaaaacctccacctaagaggctggcgcccgtgtctgtgtctgtgccatcctttaggaattttgcagctttctttgggagaggctgagagcttcctgtggcctttggccatccagccggtgctgagggggcagatggcccagtgggcaggcctggtgccgggcgtgtgcgcactgccggtctctgctcgccggcttttagacggcttccagtagaaaatgttctcctctctctggaggctcttcctcttggcagcgctgcccgcctgccggccagatcccactcggagcccgcttgtgttacgggcggcggccctggcccgcagctccgggcagggctctccacgatctccgcgctggtgagccgcttcaaaaggggattttacagcatgacagggaatttcagccaccacgttatctccgaattggccaattgatggtttcagcagagcatttcagcatcggggaagccaatacaatttgagttagttgtgatggctgccactttaaataccgcagtgaatttctgtcagcgagctaatgcgtggaatagggaattgcagaaaacttgatcatcagagtgcttcagtcgattctgaccccaagctacagaaaatgaacttaaatctagttgactgtcgccacatactttctttggtgttattttgctggcagcgtcttcttcagagagagctggaagagaagagactaggaggaaatcaggatgtttgccgcgggtccctgggattttagagagtgacagtcttcatgggaggttgaccattgggagttggggtggtgagttcttggtgagggataaatttctaaacgacagcattatggcttagtaataatgagttttctatttaacaaagcaaaccagtgcttattgagcacttactatgtgttcagacccttaaaaggcattcttaggtatctccctgttggacaatgtaggggacaggcattcctcccatttcgtgacggaagaactgataacaatagcaaacaattattgagtgctaaccgtatgccaggcactgttgtaagtgctttaggttttgtctattgtcatactcaaaacagccctgtgagttaagttctgttattcctattttgtagagaaggaaatgaggcacttagagggattcagtcatgggcaaggtagacttaataggtttgtcttcttaatttaaaaaaaaaaaatttttttttttgagacagggtcttgctgtgttgcccaggctggagtgcagtagcatgatctcggctcactgcagcctcagcttccccaggctcaggtgattctcctggctcagccttcccaagtaactgggactacaggcatgtgccaccatgcccagctaacttttctgtttttttatttttttatttttttttggtagagacagggtttgccatgttgcccaggctggtctcaaactcctggcctcaagcagtctcctgcctcggcctcccaaagtgctgggattacaggtgtaagccactgtgcctggcccagatttggcatcttttctgtctcattaattgatgaccccctgcccagcctggagtggtttgatgctgaggctggcaggaccaggtgggtcctgacggagatgagccagctgaagcctggcctgggctcatagggttcctgactggtgcggtgcttctctgtgggtagagggattgggctggtttttaatgacctcgtccaggaagaaaacatcttggctttgggacctatgtgacttaaagaaaaggtttgctatctcttcactcaaaaggctcccttttattaaatctcctaccaccccctgtggactccaggcttgaaaatattttatttacaaagagattgcatgcattgagtcaccattaattttaatgaagaaatgtggaaaatgagaactatatagctgctgatgagactttctcatcagctcaggggaaccaacgtgagcacaccaggttggtagaacagaattctagtcaacagaaaaacattggaaatttcagttccatttcaattgaggcagacccgattcttctagaacttaaacaatattagcaatgcctcaagagcccccagtgaagttttccagaaacctggttagaatccttaggcaggacccacctagcagtggtgccttctcactttgtcctggcatggccagggttgacctctgtagagggacatccctcgtgtttcccccaggactgaggaaggttagaatgcagagttctctccggagatggctgagctctctttaggcccatccacccctgctctcctggctgtgcatgcaaggcttctctgttagggcagtgcagcttggagggtagacacactgagggtgtaagagcctgtgtgaacagctcccatctgcagagcctcctctccttacagatatatcccaaggcaggggtcccatattccctgcggttctgagctggcattacctgcagcagatggatcactggacagcgagtccggaaatcatccttctccaccaagctttcccacttaatagcttggtaacctttgacagatgatttctttctttcctaatttgtagcatggggacagtgagggatacaacagcagtttctgaaacagcagtgaccaccatttactgcatttaccccaggccaggcactgtgtgtgggcatggcatttaatcccggtaacactctataagataggggctgttatgacctcatttctccgatgaggaagccagggctcagagaagtgaaggcatgagcccgttgttatgaagtcattagatagtagagctgggatttgaacccagagccccactctacctttgagccatgctgctactttgacaaacttttggatgactttgggagatggggaccttggggaaaaatgcactttgaaagaattggatcatttcagtagaaacctgtaaacgtgtgtcttaaaaaaaaatgtcagtgacagtttgcttctcggtgagatgaatgcagataaacctattttgactgttaacttattttgttgcttaaaagccagtgacatgtagtgttgaatttatttttcttcacaacatttaagtgtttgccacttcttgagtgacgtgtgtgaatttgggaattgcctgtactttgggaatggaggccgttgcttgtatgtaaggcttttgccttaagagggacttttgggaaggcttgttctggctcggggccttgctaagaagcgactcgagtgcagcaagggtacctgtgtctgaggatattgatagagctgaagctcactctgaagttggggtcatggtggagagccgatcgcaggagtctttgtgactggaagcctaaatatttattctgttctgtccctaatgaaaacaaattgtcaacagttgttcggtaactgactaaattaaaatctgtaattagtcaattagattaaagagttggcacaacctgattgtatcatgctggttaggttattaagagaaagggtgtgatttttaattactgaatgctaattttgacagtttcaaatagaaacagacgtgtttttcccctctttccctaattctgaatggtttggaaagtaaagacactcaatgtgtaaatgatgtttttttgaagaaaaataatccgagaaggcccttctgtagagtaggagggatttcagcaaagagcccacgttggatttagttgaaagggttagttggaaatccttcctttcttgaagaggcatggcttggtttttggcagcttcgtttttgctgtcaaggagaggttggatttcagctttaagcagtcgaatcattgagttctttttaagggtctccccgattctctcaacttcaggcttttttctggccagtgccctggaaactataagcaatagtaaacgatccagggaggaatcccctgcgaaggaagcccagtgggcgctttgggacactagcacgtgtgagtaatcatacccagtgttgtatgaagtgtcttctcatacactggcatcccaggaagacagacggatggaacggatgttcttacttcatggaataaaagttttgctgactgcctgaggaaagctgagagcagggaatgaggtgccccggtgtggagggtcagggggagaatgtactcggggtgggtgctgacaggcaagaaggaggggactcctgttgagtagtaagtagctggggatgacaggagagaggcctcttgcttgggaggaagatgggatcggaaagtagagccagttcaactgggtgaggtggtgtgcgcctatagtccagctactcaggaggtagaggcaggaggattgcttgagcccaggagttggaggctgcagtgagctatgatcatgcctgtgacaacatagtgaaactccatctcttaaaaaaaaaaaaaaaaaaaaagtaggatcagtttatacattgtggattgaagctagccagagaatttagcacaattagggtagatgggtttgaagatggggcaaatccttcttcccactttgtttttctggcggatgctgtgtcgttgcttcccctgctgacactggaatacgggatatgagcaaccttggaactgggggtgagaacacctgagctgcttccagccaagggccccagtacagtgtggatcccctcattggccagagggaccatcccatctccccatcctccccagctcctgggagttgatgatgtggaccgctccataaggtgctgtgcccgtggggcattttatctgaaggataaaatgtatctgaaggatgtcaatcctaagaataggctcatgggccactgcaggaaggccacccagcccttgcttttccttgcacaaaggaaacccctccttctgtggggagcgaggggttgaagctgtaaccctaggcccctgactgcccactggacagcagcatccctgtcttgagggagagccaccctaaacatctgtgcctctagaactgcactgaaccccacactgcatgttaacacagtctctactttctggatggttttcttgtgggctgagtcttccatgatactttttgaagcatcagttaaaatggcctttagctttcaacatgcaatatttaaagctgtgggtgatccagaatgggtcatttttctttgaaaaaggaagcgactttactttttgtgtctgatgaatatggggtactggggaaccaaggtgcagagaacgagagcttttgaaggttaagcagcctgggttctaatccccacaagagcgcccccatccacagtgtaacctgtgccagttgattaacctctgagcctcagtgtccttatctgtaaaatggggattgtactcagcctgcagtactgctttgagataatgaagcagagcatgttagaagatatttcaggaatgaaagaatgagaggctgaaaggaaggtatctgtgcttagggagtgattctggggcacgtttagaagcacgaataagtaagaggagtggaatgaaaagcaggaagtatttatgaatggtggactggggtatgttctgaatttggaattcctccttcagactcaggatccatagccaaggttaaagaaacccataagaggttgtgtgtgtgtgtgtttggggttgggggcagtggtagatagaagggaagggacagtgctaggagagagaacattttaaaagcttccccactgatagatttgtagccctgggtaaatagggaagcttgtaaaacttgattcattttcttcctgaagtctgtttttggtggggagcaggggtgaggacaaagacagctaagggagccaaatgcttttaggttaggagtgtttatatgtccccagcacaagccatgtccttgagaagggccagggatgtgtttcatcctgctccctgtccccaaacgatctttctcttcctaagtgccagcttccctagtccatctggggagggactgcccactgcctgccatcaggggctgtgctcaggcctcatctagggatctgcgctcaggatgacttcctacttccttcctggcctgcggtttgctcttttcttttggttaggaagtatgtccttccctgtccctgcccaggcctactctggagacgtggacaggcagctggggccaccattagccagagaggagacagggtgtgtcgacaactggaggcccatgtgagctgttcaggaattagaagctactgctcttggaaaactgctgcagaaatggaaaggtggtcaatggggagaggtgagaaggtgatgggccttgtatgttggaaaaaaaaaatttagagggacttaacggaatatttctgtgttttgaaataaaaattatttggggacctaacattaaaaagacatctgtgtatttttctgttagggtggaatgtgaagcctgagattcctgggctgtagttagagaagggccagctctctgccttggggcctttgcacaggctgttctcccagcttggagcacttgctgccattctttctcctctcagggaaccctgtttatttttcatgtctcagtttagacatcacataattctaagatgcttctaataatctttgagcctctgggggcagagcccatggtgggtcttgtaaactgaggccctgacgcttggtggatccccactcaacatttgttggctgaaagagtgatcagggaggatcaggaggctgcccacctcccagggcccctctgtgcagtctgtgcatttgaatggttccctgaagtcttaacgcccttagaacaagtccaagttcgtctgctcagttcgagccctggccttggtgtttgcctttcttttctgaagtaggtctttgacacatcgatggagcttcagatgtgaagtgtcctcagaggtgtgtgggaaaatgctctctgttcagttaacccagccttttgacaacttctgaggcctctcgggctagaagccccgtgactgttctcctgcccagttcttgcttttttttttttttttttttgagatggagtcttgcactgttgcccaggctggagtgcagtggcacgatctctgctcactgcaagctccgcctcctgggttcatgccattctcctgcctcagcctcccaagtagctgggactacaggcgcctgccaccatgcccggctaattttttgtacttttagtagagatggggttttgctgtgttagctgggatggtctcgatctcctgacctcgtgatccgcccgcctcggcctcccaaagtgctgggattacaggcgtgagccaccgtgcccggccggttcttgctttttataaagggggctggggagtgggtggacagggatgtgatcctggaatccagaactccatcactcagcctgtgtcttagtggggtgttaatggaggatgatggaaaatagcccacttctgatttctctctctccctcatagctctgtagaaatattttattattgaacaccctgtaattcagggttggtggcgattttatcaggtcatacaagtctacagttgacctttgcattatctaagaagacttgtgtttgcttagccaaggataaacaagattccagtgtgggtggcttagggcttggagctgtggtctctgtgtgcagggttgcttctaattgtgaatggctcttatctgttcttcagggagggtctagccacactgtagtacagggacttctttatttcttttttctttctttttttttttccttttagagacggagtctcgctctgtcacccaggctggagtgcagtggtgcgatcttggctcactacaacctccgcctgccgggttcaagaaattctcctgcctcagcctcccgagtagctgggactacaggctcacgccaccacgcccggctaattttttttttgtattctaatagagatggggttttactgtgttgcccaggccggtctcaaactcctgagctcagacaatccgcccacctcggcctcccaaagtgctgggattacaggcatgagccactgtgcccagctggggcttctttcttttctttcttttctttctttccttccttccttctctttctttctttcttttctttctttctttctctctctctcttcttttttttttttttttgtcatggagtttcgctcttgttgcccaggctggagtgcaatggcacgatctcggctcaccgcagcctccgcctcctgggttcaagtgattctcctgccttagcctcctgggtagctgggattgcaggcaggcgccaccatgcccagctaattttgtatttttagtagataaggggtttctccaagttggtcaggctggtctcgaactcccgacttcaggtgatccacctgcctcagtctcctaaagtgctgggattataggcatgagccactgtgcctggctgggacttctttatttctaagcctgccatccaggcttttccaagggcctgaaatgcttactgcctttaaacaactactttctgctaaaattgtcctaatagtatcagtttaggaagatattttatccaaaaatccacccataggtcatcaaagatatttgtctttatcagatattcatctaatctgtctagtcttccattcatcaaatatttgatgcctctgccgtttggctacggaagcaaagacaccagcaaatcttttgccctcacagacctcatagactattttcctcccctttatctggggttatgtgttttcaaaatgctaactggctgggtgcagtgggtaacatctgtaattctagcactttgggaggccaaggtgggaggatcgcttgagcctaggagttcaagaccagcctgggcaacatagtgagaccctgtctgtaaaaaataagaaataaaaataaaatgcttactgcacatctgtattttttacttatttattttttgagacagagtctcgctctattgcccaggctggagtgcagtggcacagtctcggctcactgcagcctctgcctcctgggttcaagcaattttccttcctaagcctccagagaagctgggattacaggtgcctgccaccatgctcagctaatttttgtatttttagtagcgatggggtttcaccatgttggccaggctgatctcgaactcctgacttcagatgatccacccacctcggcctcccaaagtgcttggattgcaggcatgagccaccatgcccagcctaactgcacatcttaaaatataagatatatcctgttggttccagctgacttgtcccctaggaaggcacaggaatgcttcccagcatcccctcaggggattgtggggtcacccttccctgggcttgccccagcaccctgtctcactgcgctggccagctctgtcatttttggacttgttgcttggactcacctgagttttgcttcctcctctgtaaagtggtggtaaatgatacctttgtggtcccagcgtgggtgggtgtggacttggttgagccaagtcatttgagggcctcggcaaggtgccccaccgaggtgggggtgagagtttggagaaagtggtgatcaccttggtgagagcacaaactggagatgtagctgaaacaaaaatgtccttataaggctgttattctagcaaaaatgtgttaaaaattggttattggaaacacaaatctacaaggacataaactaaaagaatgaagactctactgacatgctctctctctctttttttttttttttttttttttttgagatggtgtatcactctgtcgcccaggctggagtacagtgtcacgatatcagctcactgcaacctctgcctcccgagtttaagtgattgtcttgcctcagcctcctgagtagctgggactgcaggcgcacgccaccacgcccggctaatttttgtatttttagtagagacggaatttcaccatgttggccaggatggtcttcctcacctgacctcatgatccaccagcctcggcctcccagagtgctgggattacaggcgtgagtcaccacttccagcctctctctcttttttaaaagtattggggtcttaccttgtcacccaggctggagtgcagcctcaaactcctcctgcttcagcctctgagtagctggaattacaggcttgtaccaccatgcccagctaattgtcagattttttttttttgtagagggggtcttgctgtgtttttcccggctggtctcaaacttccggccttaagcagttgtcccgcttcagcctcccaaagtgctaggattacaggtgtgagccatcatgccctgcctaatatactggctttaaggaagctttcaggtgcccacactctgtcagacttgacttaattcttctaggctttaccaacacccccaaccccatggttgggggtggggcattacaaccaggctgtggtcacctctgaggcacaggtgtcagccacaatgccaccttttccggtgagtcagcgagtttgtctggaatacccctccgtaggtgagagccggggtcctgggctgggaccacgatgggccgtagcttctcaggaagccgaagctggccctggccagagctgtcttgcagacttgagatacagatggcttctttccccctcccgttttctttttgaaaatgtttttaactcggagcatgtgtcggcacggcgttctttccacgaggacagaagctgtcactgcacgcagcagagacactggttctgatccaaagccgattgtggcctgcttctgggtctaattatttggcaggtcaggtgctggggtactgtccagggtgtaatcaagactcaagcatttgggcatgggggtgaggaggaaccatggggaggggaaggaaaaaggagggggtgtgtgacttagcctgtccagaccacagagcgagtcaatccccctggaacagtggcgtccgctgctctgcggggagggtctgcccatgacctggtgtgggagccgaggccgccaccaacttgggcgcccagcccagaccctaggagagggaggagcctggagcagcctttccctggcgagattggccacattccattttcctctctgaccagagagccctctcacccctgggtgtacaggctctttccgctaacagaggccctcctccagccccattgtccccactgtgagaccaggagtgcccctttcccagccccaaaaaatgagtgcgctcccagtgtgaggcacagagtgaaagcctcgtgttttagaacggcgggtgggaaggacttgatgcgccgtgttcttgcaggaagggcagggacgataccgccttgtgctttgcctggcacatggtaggggcctaggtatttgggcgaatggagtgatgtccagagaaagcaggactttggctcgggcaaggagtgggtggcagtagggaggactgtggtctgtggaagggtcactgtggctcttggctttctcctactgtccctgccgatggtgacagccagccagcctcctggccgcaccattgtaccgcctctttcttggcttggtcctgggcgtggatgtcagatttgctttgttcatgtaaaatgtggtgggatcatgtctccctcaaatcaaattccaaccaaaatcaaaacaaaacaaatcaagcgtctcagtgaagacagccctgagggttctgttgtctcagcctgggagcctgggagcctggtcgacctcacctgcttttcagattttgccatgtttattgcagacgtccccgtcctggtgctggccactcaccttcattacaggttaattctcacaacctccaggtgtggtatgcagtggttttaaggaaagagaaaacagaaaaaggccacacaggtagggcttcacagcatctgagggcacccagggtggccgaggtgtgctgctggcgaaggccctcctgcagactagaaaacccgcatgtcgctcctgcgtagcaagtgtcatgtctgttactggctgacactttgagggtttttcttttctccaaataaataattctttgtctctcttcagggtggcagatcggggctggagggaggaagccatcaaaagcaacctggctgactatgaacaagtgggttggggcggggacctggccaggcggtggcggggccaggagagccagcgtcttgtgtctggcctgggtggggagggtgtgggagacacctgaagccacctcggaaaatgttcggtggggcatttcttgcccagagctgtgtgagtgaaatatttgactaaatggggagttccttcctcggaggaggataaagcgggctctcttttcctgtccctttgtctcttgtcccctttgtcccagccctccagctctgcggcctcccctcccccagcggttccttcctttgtgcccgccggccactcaccagtgaaacttaactcagccccgggcctcactcccctcgaaacaacagaaggagctagtaggggcaggcctggctgtcagcgccttggactaaaaggaaccaaaccgccgtcccagcccccaatggtggcagttaattttgaagtttggcgttgactgttggcagtcccttccgagggagcagctttggagggggtgttgctgccccagccagagggattgggggctgtggctgaggccaggagacctggccttacacccctttccctggtaaagggccctgggttctccaccacagcccctctttgtcctgctctgagtggtttggagttctttgtgcagtggcccagaaatatggacgcgcaaactgtaacagagccccacccacacctctgggtagcgaagcacccatatttgttacatgattgtcttaatcctctttaagcaaggattagcgataactagggggttaaacaaaaatcagaaggaaaaactgtaagttggggaaaatctatccatgaaagaaagttgatgagaatatgggaaagttgggctggattcagttcatttgttataaaaatgggaactctggcaccttgtttctaagctgatggccagaggtccgagggcatctgctttttggggttgtgtggcctgcacgtcaggagagtgcaggggaccggggcctgtagaggttccgtagacttggtgtggatttgtgctgtgttgaggccgagcagaattgtggtgaatcggcacggcttcattattgctggaagtatttttccttacttaaaatatctaatttatttacccatacatgtttaaaataatatagcagataacatgtaaatttagagatactatgttccaccctaaatttacatgatatattttattctaggtcttcatatgcgtttttgttatcagtgtcttaaatgctgtcatcaaagccagtttttatcttctaacccacctttctaggacgtatcaccaacactccaagttgtttgacatatattatttttcagctttgtgtatgatgcttcctctgggaattttgtcccaagccacaggaatccattagaacatttaaacagtggctttgtaaaaatgtgtcttataggtgtctgtcgctggaaatgctccagcagatctgagatccctgctatgatgctggggggatgggtagggaggcaccacccttcctgagtgttaagagcctggctgctggcgtcctacctcaagccacctgtgtgaccctgctcttttctgcaacctcagtatcctcatctagaagaagcagacaacaatgcctagagctcacttctcaggattcagtgtgtgtgcccagtggcctgtatacactcagcactcagcacactgaggttgggctgttggagcactcctgcccttcgggtttacggagtaaccttgagggcttatcaggcagggcctggaggcagaccttgtggggaaagggaggagcaccgtgggtttcagttttgggttttggagtggggaaaccattccaggggaaaggggtatgctttcagtaatggcgatgaggcctgtggcaccctcaccccatttattgattgcttgcctttaaccgtagtgtctttgccagccctctggcatttccggagtggaatgttttaaatgcccttgactgaggactgtgtgtcctggaggtgagagagggccttacctctctctcattctgtagaaaagctttgtcatttaatgctttttatttcaaagctggtaaaaacttacctggacttgtaacagaggggccaggctctttgtgtgtgagtcatcattgtcatggtcatgacttggtcacagggtgacagatggtagccacacccctaggcctcagttgggacagaaactcctgggatgggcagtggcagaagtgtctgtcaagggtgcccaggttgtcgggacagatttgcatcgccgtttgtaaataagtactgctttgaatatctacctttgatgcgctggtggtggaggagctgggattcccaatttagatgtttgatgtaatttgaaactgaaacaatcaaaagtctatctcatgaagaagaaaaggagggtgaaagcccccctcctagaagttgtcacctggctgagattttaatctgtgtggtttgaaggagtccaggctgaccatatgttgaaggccctgccccaaagacgagtttttccttcacattattgcatttcattgagagaattagcaaaatgaagtcagagcaggcagcgtgtcttgttacttggtggagctgtaagggctgcgtcttcaggttgggagcaccattccttgactcaccattgctggtggccaaagcaagaaatgggtagtgggtttagaggctggcagtgttggcagtggtaacatgcctaaaagtggaattgtgtggactaaagaacttgaggaaaggggtagggtgggggcaggttttttcctgaatgggcaaggcctcagggccactatacctcttagaggtgtgtgagacaaacacacacacacacacacccacgcatgcacgcacacgagtgaacagggtggaggggagaccagagactaagggaggaggagggggtccaggagtggatggctgggcttgggggaggggtccctgtttgcataactgattgttgctcctgggtactgtggagtgggggaagccagcacaaaggctctttcctccccctccctccctgccctgtatccctctacctctcctacttatccctctccttcctcttccctgctctcctccttcccctccctttcctcccagagcctggtcagcaccaccttgtggcccccctgggcagcggatggcactgggctggccttgcctttgcttccctgcaggcagggtttgccaccgccagggccctgtggcaggcagggccaccgcagccgcctgtagcgtcaagataaagtccagtccagaggaaggctctggctgtgggtcaccctttaaaggctgttactttacatagatggcttctatgtgaactctgaggtgctcgcccctcaccatcctttccaccaggcgactggaggcttctggagggggactggctgggggcgcctctcatgaatggtttttctggatcctgtctcctgggcccacaacttgacactcttgaagaagcactggagtcacagtcagctgctggtgtgaaagtggctggcagcaggagtatactgtagcagcttcaagcaggcctcagaatgtggatgaggtggaggtgcctgtggactggcctgtgggaaagagctcagagcagagtcctctggcagaccccagtctggctggtccaccacacatctttgctaaataaataaattgaatgcatgcatgcatgcatgcatgcagtgtgatcccccccaagtaggaatgaataaattcccctaggtggtttgtcatccacgtgtgggcttttctatctgatccttagtttccctgtcagtcccatggtggtgacttttcagcactgtcaggctgtctgatgatggctgttgtgctgcggagccctccaggctctgaccacggggtcctgcccaacacctggggacacagagacagaagcaggccctgtggacagctagtggagaagacgggtagcatgtgcagggccaggggcatatcctggcccagcctcctctactgccttttttggcttgccccaggataaggttacagattgggagccaagactcccacagtgacggggtggggtgttgtgcatcttcccacgggatgctctcgtcccctccccctctctggcccctggcctcctgcccacctgagtggtgcttgtgcttcggctgtatgaccttttcatgaaatgaaaactaaagaatgtttttaagcaagttcatgctctggaagtcagttagctcacgttgatagccctgatatctcacgttggattaggtggggtctgcattttacactctgtctgggttcttggggtcagggttgtgtgtggttagcatggatttgctttgcattctgtcccctgccaggtggggtgggggatggagggagaaagggatggggacagcttgttccacctgaacaggcttcactgattgacttgcttcttcaccttggcttctgtgaaatggggataatgtaagcatccattataggatagttgagggtggtttgtgaacaaatttcatcctggagaatgtgaggtgtttggtgtcagttctcctggaaaggcttggacaggtcaagaacttttagatgggaaggagcagggccagcagggcctcaagaaagtgtgatgcccttttggggcttactgaagagattaatgacaaaggtggtgtgggatgacctgggatgtttgctcagagtcgtcttcccggagcctgtgctccttgtgagtagcggcaggaaccagggctgcaggctgcaggcctcctggctacccagtctctggatccccaacacgccgtgggctgccggccacctgcctccgcacacattcccgcgcacctgcgtcttacctgcccagcctgccttccaaggctcagtgtaagccctaacttctcctaagaaagctgccctgggctactttgccattctcaaagacaggcttccagccagtgcccattgggctctttgagccctttagtcacctcttcccatgatgtccttgtgcacggctctggagaagcctctgtaataacctgcctttcctgtccagcaggaaagagtctagtggggataacgggatgaacttcacactgaccgcagctctggtggtccagacgtgcacaccatgggaaacaactcatgtctcccacggtcagcccagggcactcagctcagacactttcctcaagcagcccctgggtgtgagtagggagttgggggcaattctgagctggtgtgccgagaggcattcctgtttttttttttttttttcttgaaacagggtcttactctgtcacccaggctggagtgcagtggtgcaatctcggctccctgcagcttccacctcccgggctcaagcaatcctcccccatcagcctcccaagtagctgggactacaggcatgcgccgccacatatggctaatttttgtatttttttttatagagatggggtttcaccatgttgtctagtctggtcttgaactcctggtctcaagcaatccacccgcctcagcttcccaaaatgttggggttacagatgtgagccactgcgcccagcctgttgctgtttttttcaaaacaactctttgctgacccttctaaatccatccagggcagccccagaggcccagattggctggattcgtgtaacccttctcaactctgtaactagaatcatgaagggtggcactcgctttttatagaagaggaaaccgagtcccagacagggaagaggccgcttgattgacagaaaggggccccagaggctgttgaaaatttcccttcagccgtcagtggtgggctggtaggtctcaccttgctcccaagactgttgccattagcaaccaacttcccctgttggttctgggggccctggaggggaagagggaagaaggtgaagcaatgctgtcaggtggcagctgagtgtctgtgccaggaggttatgcgggtgacaccaggaagagggcccaggcacacagagtcacgcgtgcacagcccgttggtttgctcttcatcattcccagccatggggaaattatataaagacattgcattttttacaaaaacatctccccctgcctcccaacaaaagaatagaaaaggaagaagattgtagaaaaagaggaggactaggcatagggtctgctggagtcagggaggctttgcccttgtcctggccctaccgttctccagctgtgtggccctgggttaattgcctggcccctggggcctcagtttatccattcataaaagaggggacagggtacaggtatacactagcaatacaggtgtgcagtgctcagccccatgcctgatgctcctgagccctcaggaaaggattgtgggtggaagagcgtcggaaacctgcagtgggtgggtttccagtcacgtggtcaccatttattgagtgtagcctagatcctgccacaggtatggcactagggggatgcagacttgagccaggattgtgttgattgttgtctggaacggcagacagactaattgacaaggtaggtggtggtcagtgctcatggggaacacaggcagagtttgaagggagcccagagaggggagtcgctggctgctttaggggctgggaaggcttcctggagggggtgttgctgctgggcctcaaggagtgagaaagaaagtggaggggaaggggcattccaggcaggtgcagatctttgtcttggaggattatggccagtgaacactgatagtgcctgacatttattgggctctcagtctgtgccagcccctgttctcagtgctttcaacatgaggtagtttaatcctccagaccaaccctgcaaggcaggtattaccccattttgcagttggagaactgagccacagagaagggaagtaatttgtcagggcttacacggcatgtgggactcagtctggaaacctttagagtcaggctcgggagaccaggcacatgcctagcctgccttgcctgacaggaacccaggtctggttgttggagatactcattaactagtggtttgggagagttggtgagtcccttccaactcagtttccttatctgtaaagtgagtataacccatgtccgtgaaaggatgaggttctcgggtggagttggctgtatgagatgtgctcagagagtgcctcatgttgtgggaggcccttccctcggttcctgtaccaggtggtggttgcagggtagaaaggtgtttaatcttaaggtagccactcccccacccctgcccgactgtcttcgtttttgaggccaggagcctgtcagctttggcaggattagataaaacgtgggcacggtgcccagtgcagcaccggcacatgcacagtccctgtacgcagttgtcatttttattattgtgtcttctctctcgatattgatgattgttaactgatggtcctctcatcagtcctatgggtgattttagcctcactttagaagaggcggtagcttgggggtggagagtgcatccagaggcaccatcattgcagacacactgaaacaccaaactgggtgtgtctctctcccattcctgtgcccgtgtcacagtagaggaaggccccagcaggcactccctatgtgttggcaaacaaggcttaaaatcgcccaagccttccccagagccagccttctgaagcaagtcatcatgtaaggtgtgacatgttcatgcacacatggcatccacacacgctttcttccacttgggcgcttgagctcatggtagtgtctactcagtccacaatggagtgttcctcggtgctggagttaatgcgctctaaacctaatcttaactctgagcaacttagtcttgtgagaacatgcagctcctatctgagaatagtgtttgcctgcagggcgacctgatatggctatgaaaataatgcagtggaacaagtgtctgtagctttggggtgtttggagacctttctcgtggcccttcagcatacccccccttgggtggtcttctggcagcagtcttgttgctcctctcccatccagccgccactggagagggggttggccctgtcttttcaatcactgagccctggggtattacagcatttgggtctcaggaccatgtgtgcttacggcacagtgctaagaacatcaggaagaacaccaaagacactgggatcccttgatcttgtatgacgggggaaccgttcccaagtctaaaattgagctgagccatgctgagggctgccaccactcacagccaccacacgcatgctcattctttgttgatttggaagcctcttcaggaacatgtagtgcctgagggccactcttgtggagaagaactgtaatcccttacatataataatcccctgcactggacactttgtagaacaatctcctgtatgtgagctcattggcaccctctagcagtcctggggcagtgacagacaaggcttattaccccgttttgttgataaaaacgcaggtggctttagtgactttctaaagtcacgtgtccagtatatgatgaagcaaagagtaaaaatccaatctgaaggctagtgatggtgcacaggacagatggtaaatgcttggcacatactccggcattcctcccttgctcgtgtcagacattgcaagttgatcacggtaactctttttctgccaacccgggttcagaattattttcagaacacagccttctagtcagccattatcaatcgaatagcatcgccatgcaaggtgagtttgttgtcatcggagtcacagaccaggctggaagttggccagtgatgttgtttcctggtcgtttggatttccagataagtgaaagttggatgcagacggtaaatgaattccatttggaagccctgtacctgcttgacagccagccaccagcttccaggaaggccctggaggatcttagggaggtgcatggtgattgactgaagaaggtttgcttgcattggagtgccaggtggtgaccctgaagaggacggagggttgggacaagctaattgtggagacatgatggaaccctcccagttgaaggaagcttagaggaggaaaacttctcttccaggcatcttgagttctactccacattttgatttctcttgggatgttgcaaggatggtttttcatatcacacaaagcttcatgggacatggggatcccgagagaggcagcagggtaaaaaaaaatggagcaatgttgtgcccaggataccgtcgagggtactaatcttgggaatcccatctcaaccaaagggacagggtcacgttctcagactggttggtgagtctgagtatctgattctgttctgagcgtcctcagactggttggtgagtctgagtatctgattctgttctgagcgtcttcgtacaccaggtttgaggtggaggttgagtttgaagttctcattcaagttgaaccttgaattttgcatctgcccttgtatagccagaccacaagaacagacgactgcaggacttcttcacctccagtctttccttcacgtggagacacagaaaccgtctgccacggtcacctaactagtggttctctttttttttgatcacataactcttcaaacattagccgatttcttgctgtcagcctccacgtggatattcttgaccttggttttcaagatgcctttttatccatccacctagctgcacagtccctctcatctcccccagcaatggtcaccctagctccctgccttcctgcataggcaggcctcccagtttgtgcccccccacccccgtccccccaatcccgtggagcctctgcgggaataagttcacctcaaaccctcgcctttcccagggagcctggcttgggcccccccccccgactcaagaggactttttcccatgtgcaatgcagatttaaagaaaatcaacggtcgcagtttggaaggaccacacaggacataggtttcagtggtttctgacttactttttttcgttttagcagaaagagcttttctttaaatgaagtcttacatggaagtgcaaataataaaacaaaaatggagccatctacttgttttaggggagtgtggtgctgtgaattctgctcactgggtttcccacctttacacctcccctcatgcccccaagggttttacctttgaagagagcacagatctaggtacctctgatttagtcagctcccagttggagaagttgtgtctagaatagagagacgacttgcctgaagattccctagtaagtgagagccacgggggcccccaggcctccctgccatatccagggtgctttttagtctatcagctttcccagctcttcagtgagatgttcaggcacatttcaataaagggtctatagccagctctttgtggggagtggaaagagtgaagcagcttctttagtgtagggcttctcagagtttctagtgtactagggtgcattgcagatctcagaagtggagtagatggatttaaaaaaagacagtaattctcacacctgtttattgcaagaccttatctggttaaataatcctaaaatggtttcagaaatgcttcaggcaggtaatgagttgtgagttggtttctgattttttttttttccctaaatgtggggaactatgggtccagttggcaatccacgaacaagtcccttctccctggctgcagcatagcatctctgtccttgagagcccctgtttttcttcattaagcacctattttgatgttaggtgaagggctcccatgggtccctccatgtcattaaggttttcttttttttttttttttttttgagatggagtctcgttctgctggagtgcagtggcgtgatcttggctcactgcaagctccgcctcccgggttcatgccatttttctgcctcagcctcctgagtagctgggactacaggtgcgcaccaccatggctaacttttgtatttttagtagagacagggtttcaccatgttggccaggctggtctcgaactcctgacctcaagtgttccaccctcctgggtctcccaaagtgttgggattacaggtgtgagccactgtgcccggcctaggttttctatctttttaaatgagtatatgttatgcttcttggatgtggcataattcaccagttccttactattgcttgtttccagttttccagttaagaattcttttgcattaagattcttttcagctttctcataatgtaaatagtaatgtgatgaacatccttatggctaaatgtttgtgcacataaacacaatggtattcttatgtgtaaagttgttggtccagtggtacacagagcacactttagaaacaaaaatccatcagaattgccagcacattgcttaagagtgatttgagttttacttcctagtgttgctcctagcaaaggtggggacccgccgcagaggcagcctttggcccaggtaaccagtctctgggacatcagagaaggacctcatgtagcttgccgtgctgccttatctggctagtctggcaccagagtgctgggactctgcccctcgtcctttctccactcattcttccaacactgcttgagcagtgggccctgtagggacttaatacatattaattgacagattcagatgcttttccctgtgtaagagctcagtagtggagacccatttgtctgaatgctttttacgtccctgaaaccttgcatgagaggcacagattggactacagagacaatggggcatcagggaccttgttcgcaagaaggtttctgtctctgcttttattgcctggatcatgcctgactccaaaacgatggctggtattctcagaaggtgagtatcagggcgggggtttatgggcaagagcgattggtggcattctcccccgcacctatcttttgcccaagtagatcattttggaaaagaactggcttatggaggtagactaggattaacccttaaaaaccagctcagactccagcagcaaaggaaagaggcagccctacttctggcctctggtatgcgtggcactgtatcagatctttgcatgctacttcaggtgatccccatgagaacccgcagggtaaataatagcacagttccctttccagcacgagggattcggaggctctgagaggcttagtgccatgaacagtgtcactcagttgtaaatgggagggggaagtactgagactggaagccaggtttgtctgaatccaaagccacttcttaccaagctttcggtccaggaagattgaacgcttctaaagttttattagaattcaatcagaatggtttcaaagtcttttgtaggaggtaagtttaacatgattctttatactaagccatttatttttaattattcaagtaatacctaagtacttcttttgttaaaaattgctaaaatatagaggtatataaaataagaagtgaagcaaaactccctgcccttcactgtcctcctgtgcatcctggtaccaggtataactagttggaggatgtccttctagacctttttctgtgtgttcacatgaattgatacctgtcttgattcagccctgaaagccatttcagttctgaatgaaggcccctagtttactttaatttcagcaaaccagaatttaatagcagcatactagtctgtaactttgggtaagttgcttatcctagagagatcaagcatcacattcctcatctgtatacttggggtgatagtcctagagtatcttaggactgttgagaggtaactatgtaatggcccagtatatggtgcaaatatactgtaccaggtactcaggaaagggactggggactccgcctccatgctgcaggaatgggtatagttagtactctgccttcagagtcgtgtgggcaacaatgatgaaaataggcatgagtaaagataagctataaatgccatcagaggggtgttagcagcagctggagctccaggctccactggggagcagttaactcacagagggaattaaggaagactttctggaaaaagtaccctccaaggaggggtggggaccttaatgatactaattcagccctgcctttgtgccaggcagtgttctgagtggtctgtgtaaactaatttagcccatatcagtaactccgtgaggtcagaactgcgattagtttcccagatgagtaaacttaggcagagagaggttaaggaacctgcccaagtttatacagctagtaagtggctgagacaggatttgagcataggcaaactagttcttctagagtcagtgctcttaacagttaggttgtgcagcccaccagatttcaaggaaagaagtgggccagagaagcacaggaaccagtgtgagcaaggtgcagggtgtgcagaagctgttggcagatccagggagaaggcaggctttccaggtgagggggtatggccgttcatgacggagctgggtagggtgactgcggcagacaagggagtacctaggatcaccaatatctgatggttgggccacgcccacccagttctgtgacttgagtgggagggcatgtgccttccctcacatcgtgccagctcctaacctgctcaggccacttagtagctcataggcagcttcgtgcttttctgcgccccacttgttgcctttcacttaggctctcaaatagtagagtattactgtcaatgttttggttactgcatttttgaaattaatttaagaaagtcttaacactgacacttcttaaccactagccttccaacacacacacacacacgcacacctttcttcagggaaccaggttggtgacacgatagagcatgtcctcaccctgtcgtacctgtggctgccaagggcctttcgacattgtgtgtgatgccctcgctcttagattgcttcaccgcatggcacaatggagcctctgtcaatacggcagctaattaattttaactttgggatgttgcttcatctccatgcaccattcacattgtctggtgttttcctggtgcgggtgcaaaaaaagctcttcggcgcctttgtcttgttgctgaccctccttctcagcccctcttccctccctcctgcccctctgtgcaggcctggggcctctccatctgcatttccctctcagcctgattttccacagctgttttgggggaagtgctgggcattccttttgggagaggtcttaattattgaaatgttaaaatgtagcacaaaccccgctagtttggactattcacgggcagagttgtgtgagaagcagaaaagctgacgttgcaggtaatggggagagaaaggctgtttgggttcgatactgccaagttcaccatcattgctgagaggaggagtggccatagtctgggcagggagagaggcaggattgatcattagcacacgtgcttttgggtgtgtggaatgggtatttagaaagggctgaagataggctgcccttgggatattagtttgcttagaccatcccatgtgctcttcttcccctccccatttttcacatttctcatgttaagcttgagccaagcattaatgtttatttgtgggacttgatattctatttatattttcccctgctgctggtgttttgttttgagaagcctcaccccttcctctttgttaaacagagtgctaggttgggaggcaggtgggacctcagtccttctagcagactggctctggcaggtcatctccccttctctgggtctcagtaagcatttacaaagtagaggtgctgaactagctgtctttattctttggaacctgtctattacggcagcctttgtgatggaatgtacttgacactagagtagggtttggccaactttttctataaaggaccagagagtaaatatttcaggctttgtgggttgtgcagtctctcttgcaactactcagctctgccattgtagcatagaaatcagccatagacaggacagaaatgaatgggtgtggttgtgtcccaataaaactttatttacaaatacaggtggtataagtaaggcccttgggccttactggtttgccaacctaagctctagagtgttctctttggctgccatgatgtcttctcatacactaggctagtctgtaaaggaagaagttcttctttgaattagggaccaacacctgaaccctcctgaggcctggccttgccatgaatctggtctgccccctttgtttcccctctggttgctggggaggtggcctgtccaggcctctctagggagccaggtgtgcctagctctatgcaaatcaccctgttcctgaagagttgtaagatttggtaaatcctattttaagtccgattaaggaaagtctctaccacaaaacaatatacctttccctatacatttcttctgcagtatacctttatggtggaaagaaaataaacaatggttgctttttaaaatttggttttttgttttgttttgtttttgggggacttttatttttacattaaaaaaatgatggtgcagggggtggtttcaggggtaatagtgttgttctccctcccatataacttatttttcagtctatttctttgagggccagagaagattgtggttggtgtgagagtaaggggcgtagagtataaatgaagggtaaatttgttgacttgtctaatttataactgtccgatgtggcatcagattgctgatttggtagcatagtcatctgtcataattttgaattgtgctaaatacttttgaattgtgctaagtactttttctccaggtgaagaaatactcatgattcacaccattgctgagagctgtgtgggtcttcccttttgagatggctggtagggagagggtacccttgtccccatttcccagattggtgaaacaaggcactgtgtggttaggaggtttgcagttctggattgaaagttcatgtggctgtgatgagcagtgtctgtcattttcccttggaaactgagatgtgactcagcaaacagtatccagctgttcaggggctgtgctagagtgggcttcttaatgcctggtgcctttcatcccaggaatgacctctagacagcattctatccacactgatggaggctgggaggactgcaccctctttccaagactccctgtgtaaatatggagtcttagtaagacaacagtgtctaagtatccctctgccccgccccccgtgagacagttcatctcccaggcctccatccagtcagattgcaactcctgggcagcacccagctcttataaatgcctgtcctcgccgttatctgggagagaaaacgaggggtaaaacaacaacaacagcccaccactgaaagcaggactaatccccagggcagtctagcgtgtggctcagatgctcagacaaatgtttagacagcttaagaaggtaaactagaacttacatgaataaaaccatctgcctggtctaagaaaaaggttagatttgggggcctgctattttcagatgctttcaaggccgggagcttatagggtgggggatataccactgagtgttccttcctggtctaatatcttgcgcctatgtaggggctgcccggaggagcccaggtcgggtagaggcttccgccttctgggtccttactcaccaagtagactatctgtggccataaagaggatttgacctgggtacctctgatcccatttgctcactaagtcagtctttccacaaagcaacccctgggggcccttcactctttgccaggccctttcttggggaagagaggatggtttgtggagagagagaccctggggactgctctgtctcaaaggatgctggctgatgccacatattgggcatgtggagatttgctcttagttgagcagctgcttgctgccaggatggtccactgctggcagggttactgagctcgctcttgggagctctgggtctagcatgaggagatgaatgaatactgagaaaagggagagatctttcttgctgagatgtttgtgtgggtgtgtttatttgtggtctcctacgcttgtccttaccatgatggtaaagatgggcatgaagataattaagatggcaggctgggaatgaaaagatacaaattctgaattttgccttaaaccacccaagaaatctttgccaggtctttaatacctctccttcctgaacttttaaaattacgcctccagtctctttctgggagagctttctgtggttgcaccctctttcagtgaggaagggagaactgaacccatggcggaaggacgatgacaacacctcccagtcagggacagttaaaaattagggcttttgccattaaatgagaatccacattgaccagtagtatcatcgtggtggtggggaggttgagtgtatctggcatgtctggaaaggccacttgtcttgattttggttgtcacatctgtctgctgcttgtagatgctctgttgatagataccactgatggtggccttgcttgttcagctcgctgccgggctttggggagcgcaaggggatatcccacgttctgcgagaacaggttccgcacctcctctctgaggccccctgctcaggaccagagttatccaagaggctctgtgaattccgttcagcctgggagggccttgctctattgggggcagtgtttctctgcttatcccacactcagcgggagtgcgtgtggggttcatctgcagcttcggaagggctcttttctttttagggttgttcggttttccacgtttccccatttctgctttaaacctctatctgtttaatttcctgagaagggagcaaaaaactctagatgaattaggttttatgaaaatttacctctttatagttagcacaggccaggttacaggatgtgaattttcataaaacgttatcttgtgaactggtcttgattatcctttgtcctgaattagcatctcccttctagggtagaagtaattgtaaggtttagagctggaaatgaagtaggtccctctgtgagtgagggattgtggaggctcactctctatgcaaactgcttttacatgcattatcttagttagttcttttttttgagacagggtctcattttgtttcccaggctggaatgcagtggtacagtcatagctcactgcagcctcaacctcctgggctcaagcagtcctcccacctcagcctccaacgtagctgggactacaggcatgtaccccttgccacatctggcagattttttttttttttttttaagtagagacaaggtcttactatgttgtccaggctggtctcaaactcccggcctcaagtggtcctcctgcctcagcctcccaaaatgttgggattacaggagtgagccactgtgcctggccacatgtattatcttacaatccaggctatgacctggggcatggtcccccattttgcaggtgaggaaattgagactcgaggaggttcagtaacttccccaagttcatgtgtcctaagcaaagctgttacctaaacattttgggctttaaatttgggttcttttttttatggcaccacactgcctcctagtttctttggtggaaacacttggggggacccatgcaggctttctgtgatcaaagccattcccaggccagtttacctgggtcacaggctttcagatacattagaactggctggggacccctgagccccttccagcgctgttattctgtagttgagaagagatgttttagagagtgaagtgattgccaagattggacagagaatttgtttgctaattcttttaggtatttgttgagtgcctatcgtgtgccagtattagaacacatgataaagcaatgaacaaaagacaaacattctgatcttcggggagctcaagtggaggtttccatatttctgtgctctaactttcctcttcctccctaagcttctagacagctcttttgtccctctgtggactcagggaatgcaaagtaattttagtataatgttttttgggttgaactgaaggagataggtgaatcagcagaggaagagaagttatgtaattgattccaaaaccgagagaaaagatacttggttggcttatttgtttttaatatgtattctttttatttctttgagcacatggtatatgtcaggtactgttctaggtcctaagaattttgcaagtgaacaagactctgaaggtgttggcggttgagtcacacacccagtagtggtgggaggtcatggtttgactccttggtgattatcaacccatgatctgaacatttcttcaaggtaggtgagtgttaactggtcacggtggtccccatttatcctcagcctgtcaggccagtggtgttgctgtggggtaccaagatggcatcgcaccctcctgaaatgatgaatgctcacctgctccatttctgctctctgaaacgtattttctgattctttgctccacggaagtgccctaaacattggagtttttacataacagcttttcttacttatccagcatttctgtcaccacctgcagcttttgccacaaaaacacagtgacctctacagccgggaagaagagtaggtggagtctggccaaggatgccagggaaaccttatgtttataaaaagctctctgtaggtcagtgagggcatgcaaaacctttccatgtcctctgtaggaatcctaggtgcttttttaaaggaaagactgttttaaagcgtgaagggctttgagttattttcccattagcattttatcagtcgataacctctaaaatcccttctgactatgagagtctccctggccctggtttcttctgcagcctctgctttaccttcagtgatggggaactcactaccagacagggtagcccatttctgttttagacagagcagctataatctgtgttccaggtattaccatcaccaactgggaagacttcttcctatgacagcttttttttttttttttttttttgaggggagggtaattatagcaactcatatatgtctctgttcttcccataaaactctccccacctccaccagtgggtttacgtttaaaatagcctctgttctgttttggaaggcatctccctggcttctggtttgccaatgttcttctgataatgtgacttccacaactgacctccaacccccactttttggcctggcccctttgaagcgcctggagttggcagagggagaagtgtggcgggtggaagacgctcttgagtcaggagctggcggtgatccgctttgctctgtggtaggtattaactgcgttcccaggcctgtttcctgctcccaaatgccaacatccctgcctcttaagtgaggtttagcttaatccccaaccttacctaaatgttatttctttgattattcagagctgtgggcggaatttccctgtgtcgttgagagcgtaggtggggacacactgctgggatgccctccccacttgcaatcctctcttgcatccatcgtccccacagcgctgtccagctaggatggtactggtctcccagtgttgttcgttcggatgtcttcagaggtcagactgggcatcctcctcactttaccagcaggggatactgaggcccaggggatggaggttatgccatctccccttctcctgtcaagcagctggaagccctggagcaaggtgtgagctgcaaccctggagaaatggtctgtagtttagcagttgtggagttgctcacgaagcttccagttggtcatccagtcagccggcactgggatttgcacagaagccctgagactctgcccttgccctcctggcctcctgagctgggtgggctggttcagcttcaggggaacacctgataagcccccaagagtccaccgtatctaaatactgagggtctgttgcacacaaggtagaaatggagcccggtcagagtatggcattgagttgccagttaagaggtactccttgaggttaggcaggcgtgttagtcttcattttgtatgtgcagtgcctggcacatagttaagtgcccaatgaagataagcttggtggcagcctgcccatctggtgggttaaaatggaaaaagctccttcctttttagctcgaaaatgttcttagagctcctgtcctgtcccagatgctgcagagggctattgaggtgctgtctcagccctgcccacgagtggattaaggaaggagacccttctgtaagaacactgcaccctcatgcctggatggtatagtgtaggtgtggaagtgctgtttgtccatcttcctttactttggagagtccacctttgatgggtcctctggaacctgatgactgctgtgcatgtggaaagactgggaggcaggtgaacatgctagcaaaaatcatccctgctccctgggtgccaggccatttgtggtgtgtcttattacttggcaaagaagacattaggacttcatttattttgtgagagaaaaggtcttgctatgttaaccaggctggcctggaactcctgggctcaagtgatcctctggcctcagcctcctgaatagctgggactacaggtgtgcactgctgtgcgcagcttaggacattaggactttaattcactggactggatttcaccccatgggtcccctgtggatgggggagaggtggaggtggtggggctggctggggagcaggaggatgaggtggcaaggatgtgcagggttgaattttctctcttttcttcacaaatagtgctagcacccttatggtacaccctacccccagcccccaaaaaacttactgaagcactgcccacccccacattgacctaccttccttctcctgcctgcctgactttgtaagtgagcccctagctttttgtcaggagtgggggtgtggatctgtgtgtagcagggtggcctcatttgtcgagtgcccaccctgggccactgtgttaggcagtcacgattgctgcaaagcctttaattagcgtcccaggttgcctggctgccttcctcactcgcactgcctttttccttttctcccttcccctcctagcccctttggccttctgtctcctctcactggggactcagacctctcttcctgtcttccctccctcccttcctaggggcctttccttgattctctggggaaaccagataggcctctgttacccctgtgagccctgttccctccacccagaagatgtggagtgaggtgaggggctctacccccagcggtgagactgtgtcaggcctttctctgcgtctgtgtgattttatgaagtctgtcttgtcaaaaccaagaggctgaggaaagtccctacatttattctttgaagatctcttgaacgctggttgctgagcacaaagcaggtggggcgggtggaggaagacttcctgaaatggagagaaggcgagtggacacccgatgacttgtagatatgtgggtagaatgctggagggagaagcggctcctggggcacccgtgcttggccccctttggatgtcggctccctttgcagctcctaagctctgtgtttggggtgggagcggctgcgaggcggtggggggcttgtttggcagacggcgcccatcagacaactggaaagtgccagtgcctgcgtggccatctgtccccgccgcctagctcccggccgccttctgcttcccacagaagggcccgcgctgttctgtagcacaagggcacggggcctggccgggaggggcaggcacagttccattttgccattgtttattcccatctcctttgcagctcctgcgcttgggagttgccaggtgcgtgaaaagtttgctgcgccgtggccgatcaggttgtttggtggggcgctggcgggaaggaaaggtggaagtgtgcggcgtttcctttgcaccgtgtctgtttgttcaactgtggactttcacccctccccctggctgctggttttcttttttcttgctttaatttgtaaaaacgcacctagagcaggccagctccccgggatttgggctcatctgcacgctaccctctccgagctagttaaagggttaaaaattatggggaagttcagccggcacttgcaagatatggttgccgtagcaacaggccttctaatctggtaggtgacctgagagactggagaagatgtaggggttggtttggcatttcattatttcatgaggctgcctctccagctggtttctctgctgagcttaaagcttgctgttcctgccactagaattactggcacattccaaaacaacagtgttgatggcacgagcactgcgttaatggggtctggccaggcagggtgggcggaggagagggagctgggttccaggagccctcacgtgggatcgtgtcccctcgcacaaagcgggaggtgtggatagagggatgtacgcaggggtttgccctcctgcatacaatagccgccttcttgaaacaccacctcacgtaaagagggactggctttttaggaggactttaagataactcctttagttttccaagaagcctccttaaatttgggaggcaggggagctctctgaatttgggggagaggctggacgcggtggctcaacacctgtaatcccagcacttcgggaggctgagccgggtggatcacttgaggccaggagttccagaccagcctggccaacatggtgaaaccctgtttctactaaaaatacaaaaattagtcacgcatggtggcacgtgcctgtactcccagctacttgggaagttgaggcgggagaatcgcttgaaccagaaggcagaggttacagtgagccaagattgtgccactgtactccagcctgggcgacagagtgagaccctgtctcaaaaaataaataagtaaaataaatttgggggagatctccctgtaatgtctgtggttggtgccctcctcttgtatttatctccagatagatattgtccagaaattcggcttagttgagcacagtagcctcatgtctgctgtgtgcccagcacagagaggaacaggacagagagtgcctggtctcattcattctctcatcagacgtttgttggacgccgcatgtggcaggcattgcagagaaggggcaggtcacaccgttgtcctggcctgagagcctcccattgtgtgagggaccttcaaagcaagagcaggagaggaggaggaaacaacccagcctcaccctccccttccttttagagggaccttgtgtcgagggcagtaagcagtcttctggccttggaaaggcatgaggcattcatgatttttcattcacctttctcttttctacccctttgctcttggctgtaattactgggaagtccacaggctgggtagatggcatgtacagatgatgtgttctgaagtccactcctccctaaggcaccgtgtcttaacacagagttgtgtgttacattaggcccaggttcacagggatctccgattggttggcttcctgggtttcttgttttttgaatttctttcccctggagaggttagtgttcctgggatttgtgagggagcggggagtgggctggagaggagcttagagtacttactgggacttcaggtggctcactccccctccccatctcggttgtaagctcctgggggagaggtctgtgtgttagaggcccagcaggtctttgtggaagttccttgctcccacgttagatgtgaacgccgagaaccacatgacaagagtggtagtgtgtaccctcctggggctctaggatccagcagggccacctccccacttcacccactgcctcgtgtctctcctgtagttctcgggtttgccgttcagtggggtgaccctcagagtccattgagggtcccagcattggcttatgttttgtgggattgggtggaaagacttgcctcactgtaccgtgtcattgctggtctgtccacctgccctgcatgtggcaggtgcctgggaaaggctggcatgtggttttgatgggtaggagtttgaggggctgggaggtgcactgatgctgcagaaagcagagcagacaggcagccttgtaaggctgtagagtctgcagacagtggtatgcgctggctccaggctttctagataagatcaggttgcagatagtgaaatgggagtcccatcttttgttgggcatcctggtgcagcattgggatgtaggagtgctcttgctgagccgggggagtggtcagtcactgacagccctggatctgggtccagttcggtttctagtccctgtatgatttggggagtcagtcccctctgtgctgcagtctcctcctcatctgtagaatgaaggtgctgacctgatcatctgcagtccctctcagtccctcagcccatgtctggatggaaagagagatctcagcagagtctatgcattgctggacctcagactggtttcttggtatagaaggtggctttagggtttatctggcttgtgtgaattttgccccattcagtgtagttccacagggtttgctgaatgccactccccttgccctgggctgcagcatgagtaggatggggcaggccagccctcgagagcagcctctgaccctgcctgtttttctctgacttccatggagcatgtgagagggtggccagaattgggatctgacaatgcacctgggtcacctggatacttgaaaacactcccattccccttctgggagaaatcttgacttggtggggccagcatagagggtgcacagggtttttcagagtggatacatctcagaggagcaaagggaaaaatctttaaggctgaagcttctgaggatggcctggccacatgtgtgtaagtcacagggcaggagcgggggtgttgagctgaagattttctggaacctgtaggatctgaaagtagaggtgatcttccagtttaccctttcagcttggattttggcctgcagtttttcccctcgcaatgggcctgatttcgacggaaagaatgggtctgccctattccaattagagtgtcagggccttgttagatgcaaaataaataaaacaaacttgtgtatccagctctaaaactggctggggccctctgagagttgtcctccctgtggcaggggtgtgtggggacctgtccagggagcgcctgcagctggagcccccgtgcaggcgaggaaaccaaggggatggcatgacggtctgaggacacggcgctgtccggtcgggccgcctccccgcgtcacctactgcctcctgtctctcctgcagttctcgggtttgccattcagaatccgttgaggggcccggcgtcggctcacattttttgggactgggtggcttttgtgctctgttgagagggatctggcttgagccccatggattgtgttgaggttcctctgtcattagtcatcctgttttagagtgggaaaaacatgacagtttactctcagattgaagtttccgagcagttgattgagatgggagttctgaggttttgtgttgtctgcacgtttctgttagcattgatgatggcagtgagcacagtgctgatcacgctagatgctcgcatggtcaaacggcaagacgcagcttcttcctgctgcacatcctgcaaggtgaggctcatgagatgacggccatcccgccctccccttgccttgttccattaacattactatagtaagaccccatatggatgactttctcttctggaggctgggaggtgaaggcaggggaggaaggggtttgaagctgagatgaagcctcataggaagtgggatgacccagtggggaccgtttctgacagaaggttcctcaggggtgttttatggagaagtcacttgaagaagccaccttaccagtcagccaagaagtttggatccatttggcctctctggagattgccacttagtaggataacaaggtaattccctgctaggtgaagtaggacttgaatcagttctatcaagcttcctaaggcaccttgtgctgcttccgaagttttaggcttttggtccttttatgtaccctgagccgtgtctagcccaaggctcttcagactgaggggactgttttttttggggggcgggggtggggtttggttgttgttgttgtttgttttgtagagatagggtctcactatattgcccagttaggtcttaaactcctggcttcaagggatcctcctgcctcgacctcccaagtagctgggactacaggcatgcgccaccaggcctggccaagatcgggggtcttcatgtgttttgccttccatgctgtggaagcctgttggtttgctggagttcacactgctctttagctcaccaggagctccttctggagaataaacatacagatgtttggatgggtgggtggatggatagataggcagcgtgctgagctgggccagatcgagtcaggagtccttcccagatggcactggggatgtttctacagctggtgtacaggcagcaagccggtcccaaaacaggggctcccataaaggcccagcgaggtcactccgtgggagtaatctgctagaggttcatccctgctagcttggcctgttgaggaaccctgtcttaggtgaatatcccacacgccagaggaacatgaaaagatgaaggaagattgttgttaaagtttcatttatatttagattatcataacattactcttgagatctgtgacttttagcatttgtggcctcaacaattcataagtgactggagtcatttataaccttcctgagcataacttgaattttggcccaggaggtaggtgggcccgtgagtcactgatatggtgggtcagcctttctggcacccccggctcttcaggctctgcctgtttcatacataatctaatttcatccttccggtaaccttgggaatggggtataattgctgccattttatacctgagagaacagaagaagttatgtgttctgtactcgttcattttgaaaagtaggaggaaggaagaaaagaaagtcacccaccaccaggactaactttgtgctaacttttcgagtatttcttttcaggctgttttcctacttttactttacttttttcacatcatcttcttctggtcagaaaattctcattataaaaaatagcatttaaggctgggcacggtggctcacacttgttatgccagcactttgggaggccgaggtgggcagattgcttgagctaggagttcgagaccagcctgggcaacatagcgagacccccatctctacaaaaaatacaaaaagattagctgggcttggcggcacgtgcctgtagtctcacctactcaggaggctgaggttggaggattgctgagtccaggaggttgaggctatgattgcaccactgcactccagcattggtgacagaatgagaccctgtctcaaaaaaaaaagcatctgagaagctgtgcgggttctatttctgtgtccagactcttgagtttatttacacgttgatatgatttttggatggtcatggtgtgggttctcctgcctgtccctgggctgctgctgcccccagggcaagaatggtttattcagctcagcttcccaggctgagacattcagacccaagcaaggcctttgtgtctaaagtagtagttgattggagtgctaatgaatcaattagaaaattacttgctgctgagctcctcagccaaacccgggttgtgcacatgtcttagaaaaccatctgaaggccatacgcgtataaatctctcttggctgtggccctcgtaaatctcaccacagcctttcttggacctgttaatcacttgagaaaaacaggactacttctgctttgcagggctgccttgtgcttggcacagttttctagcttgtacctcttccacggatgagaaaggagactagagttcctagtaacagcgcttgttccgcactttcaaaaagaagcattcaggggctgctcttgtgttttgtctctacagcaaccctgttgggaggcactattattattttgcccatttttatggatggcacagttggggctcagaaagtgtaagcaacctgttctcaggtcaccacctaaaaggaagcagcggtgaaggcttcagcttcccagatcttcacactgtcactctgctgagatgccttttcacgtggatgctcctacttaatatatcttggtgggttttcatagtcccaggttggcgtggcaggtgaggcacagccaatagaggtggaaatggtagaggcatttctggttaagtacccagggttggggtttagagcggtttaatttggggcagaagggttcaaatgacagccaacagcagaggctaaagggaccccaggtgggagatgtaccaggggctccagattgccagcaatttgtgttatgtattccaggacactcgccaggtaaggttgaacctaaaatggaaatgaggagaggagaggaaagttaaaagatgaaatggctatgaatcccagctgaagcgggaggcatttcttgaaaaagatatctgtaaaataatgattttgattttttttttttttggcccatccacactgtttcctcattggatacccacctcttgtgacccccagccatcatttcatgagcgaaactaaggtggcatggctaaacccttacctgcttcctgtaaaagccaacatgccttttcaaggctgaagcctgagggagctctgtgctggtctcctctttgattttggcttcatttggggggaaccagtagccttttgttcccaggatatgggccaaggctgcttgtttcataacttcatagtatgctcttctgtccccaagatggtcagtgtatcatgcagttttgatatttctgcatctaaccttaagggcattggatgcccggcagttgttttgctcacataacaaacaaacatttgggtgcctactgtgtgccaggcaccgctgtaggtgctgggaatgccgcagggaacagcagaggaatatccctgcctaccttgtggagctgacatgctggtggatggtacagagacctggttgggtctcaagctctgggttggaagatatgaccctaataattctaatctctcctccatagtggctctttttgatgtgcccaacattatgctgggtgttttatatttgttaatcatgttccatcctcagaagagctttgttcagacaggtaattgtcatcttatctttgcagacgaggctgctgagaacacataatgggtaggtgcttacctgtttcttgtcgaatgggtgaagagcagcagcttgctggtcatcgggctgggtttttagcctggttctggctctcaacaagacactaggctacctctcccaggctttaccggcctaattttgtgacttgccttgagtgtaggtgagtgccagagcaaggagaggaggtgagatttagaggccactcacttccgcagccctgtgaactcacttccaaggccttggccttgctcttccaggcacattggtgcctccatctgagctgtatctatggtggggaagtgagtgggatgcatctgccccgctgccccatgaccacagaccctaagctggcacaggtgaggcagcgtgtagaaccttgcaccacatctatctgcccagccatctccttggccttccagtattgacttggccccagcaagtccccggtattggaaatccaaaacaaataaagcccaacccctggacggaagtgggctggtattctcactgtgggagcttgaagtgcggcagctgtgtgggtagccagtgctctgggtgtcacctgtttggcaggctgttggaggctgtcccaggcagacctcaggtgtgtgagggagaaagttagaagcatgtgactggctgagggggcaaggcaggaggatgtctacttcctgttgttgcttgtgtgtcctcttgacccgcaggctcctttttgaaccttttcctttttctctttctttctgcccactctctgctaatttccacctgtcctcacccgccccccccccccgccccccatgccttctatttcccaaaccttgtgggttacctcagactttccttggcggttctcagttggcggactgaggggcagagtccgccacccgataaagatgactttgtgtctctgtccccagatggatatggggactctgacctctccggatggtgtttgcagaaggtcgtggttggttgcacggagtcatataatcctgaagtggcaacagtgcacacagtgaggaaaggggtgggtgattgggtggctgagagtgttgagagccttggagtgaatgatttccagacctgttagttttctagacgcagtaacaaagtaccacaaactaggtggctttaaacaacagaaacttagtctcaatgttctggaggctgaaagttcacgaggaaggtgcccgcagggccatgccctctgaaggttctagaggagcatctgcccatgcctttctcttatcttccagcgttgctgcaatccttggcattccttggcccctaggactccaatctctgcctctgccatcacatggcacctccctgtgcatctcattttatattcccctcatttcatatggataccagtcattgcatcaggacccaccctaatccaatatcacctcatttttgctaagtgatacttgcaaaaggatgtagaatcggccttccacatctgcaggttcagccagcatttgcggattcagtaatcaaaaatattcaggggaaacaaaccaacaaaaagaatacaggcctggtgtagtgactaatgcctgtaatcccagcactgtgggaggctaaggtgggaggattgtttgaggctagtagttcaagaccagcctgggcaatatagcaagaccccatcttttttttttttttttaaaaaggggacaaattaaaaaacagcctaacaactatttacctagtatttatattgtattagatattataagtaacccagagatgatttaaagtatataggagggctgggcacggtggctcacacctctaaccccagtactttgggaggccaaggtgggagggttgcttgaagtcaggaattcaagactggcttggttaacatagtgagaccccatctctatgtaaaaattaaataaataaattagctgggtgtggtggtgtatgcctgcagtcccagttacttgggaggctgaggcaggaggattgcttgatcccaggagtccaaggatgcagtgagctgtgatcactccactgcactccagcctggtgcagtgtctgaaaaaaattttaaaatgtatatgggaggatgtgtgtgcactctgccattttatgtaaaggactcaagcatccgaggattttggtatctgtgaggtggggttggggagtaagggcctggacccaatcccccaaggctgccataggagactgtatttctatttttttttttttttccttgagatggagtctcactctattgcccaggctagagtgcagtggtgcaatctcggctcactgcaagctccgcctcccgggttcacgccattctcctgcctcagcctcccaagtagctgggactacaggtgcccacgaccatgcccggccaatttttttgtatttttagtagagatggggtttcaccgtgtcagtcaggatggtctcgatctcctgacctcgtgatccacccgccttggcctcccaaagtgttgggattacaggtgtgagccaccgcgcctagccaggagactgtatttctaaataagagcccattcacaggtactgggggtaggagttgagcatatcttttggaggtacacaattcaacccccagcatagggtgacagtgccaggccccaaatcaaaattcaaattcctgttacaaggggacctaaagatcttaatctactctgtaactttagtcagtacagtaattttttttttttttttggagatggagtctagctgtgtcacccaggctggagtgcagtggcccgatctaggctcactgcaacttctgcctcccaggttcaagcaattctcctgccttagcctcctgagtagatggtactacaagcacatggtgccgcgcctggctaattttttttttttttgagatgaagtcttactctgtcacacggctggagtgcaatggcacgatctcagctcactgcaacctctgcctcttgagttcaagcgattctcctgtctcagcctcctgagtagatgggagtacaggcgtgtgctgccacacttggctaattgtttttgttttgtttttttttttttgtatttttgtggagacggggtttcaccatgttggccaggctggtctcgaactcctgacctcaagtgatccacccgcgtcggcctcccaaagtgctggaattacaggcgtgagccaccgtgcccagcctaattttttgtattttggtagagacagggtttcaccgtgttgcccaggctggtctcaaactcctgagctcaggcaatctgcccgcctcagcctccaggattacaggtgtaagccaccgcgcccagcctcagtacagtaatcttctgttaggaatctgctctgtgccatggtcagggcttggtcaggcacagagactttgcttggcgtttggggtgagacgctagttacttctgtggaaaccaaggattttaaaggaaatcttaaaaggagatgttcatgcaagcacttcagagagggcctttgaaatgcggaaggcttttcttttctgccctattacttttgaggccagctggctcaggtgagattactcttccttctctctgaaggaaggtgtggggaaaggagctgggaccatgggcttagaggttcttccagtgccttggtcttttccctggatgggagggctgagactcgggtggtttttagagtgcggctcttggtgtcctctcttccaggctgccttggtagctgggaactgttttattggaagggcaaatattgcgtagtgtcaataaggatgttttttatgggggctcctgtgtttctgcagtggataagcatgaagaagccaagtgtaagttagtttctaacggctgggttcagccctttttcttcccttgcagaagtttcccatccgagcagagagaactgagactgagcctgctggccacgcacgagaactcttgtaactttctagtctccccgtgtatcaggagaatttccgcacagatgacaggagtggagtagaaagcatttgtagccattgtattggaggaaacaagtgtaatataaataggaagtctgaattatacgtctcctcagtgctgtgaggaaaaaccacacgcaccaaatgcaatttacagctgtacgcacgtggactaatgggcactgtctgccagcgacgcgctcaagcagtgggagaccttgttgtgttaatttctttctttttaatttgagacaatgtcttgctgtattgcctaggctggtctcgaactcctgagctgaagtgatcctcctgctttggcctcccaaagcattgggattacaagtgtgaaccacccaacctgagaacctgttctctgttgctatctctcatctctttgctcctttcttcccacccacaaaaacagaaaaaaagattgatcggatgtttcccccaattctttcctctctttacaaggccttgcctgtactgacgacaccgagtgtgttaagaggtgatgggattagctgccccagcagtcatcacggggaagcagagcccatctttatgcccctaaatgaatcacccacagaagtgtcttgaacatattcgaatcaccccattctctattcccaaaatgataccttttctgggagtggcttgaatcattcattctcaaaagggggcttcaagagcctactttgggcagaagcacaagtatttattatgccaagactgtgtgcagtgcatagctgtctttgtaagtagattggttttgtgtcttctttccagtggatgtatatgatatatgttcactgtgaaggaaattagataataaacgtaaacaaaactctggtaattccacttctcaaagattaatattgttcatatcctgattcatgtcttggtgtgactttttttttcctcaacgtttctctgcccttacaagctcaagtccagtagggtaatgtcagtccactggagtgactgagcccaggtgtctaatcaggggcacctcttggccatcatgccccgcacccccaggtgctacctcagttgccaggtactgagcttcccaccatctcttctttttctccttcgggtcttcttggatcccatggaagtacagactactcttcctcagtttcttgagttgcatgtcctcttctaaaattccggaacctgtgttaacacacttccctgctagtggctctcctagccccttctcctggtccaaagctttttgtgattgatgttgccaagaaccaatgtctttcctttgggtagacggggtggggtgtaatccttgctccagatcctagagttcaggactgctgtgccagggtgaccttatgtgtgtcaagtagatatagttatatgaagccatggtttgtaacctttatggggccgtagatacctgggagactgaaattcattgccctcctctctgaacactgcacattcacatgtattcaaataattgtgcgccataaggccaggggttggggtttgcaaaccctctgaagcccatccctgatccccttcagaggcagacctgctcccctgccactgggtggcctggacagctggcatggcctcttagtgtccgttttaccttcagtaggatagctacagtgatagtcaccgtgtggtttgattatagcagcagttcatgtctactgagctctgatgttgttcacccagtccccaccctggccccatgaggggaaggtactaccacccctgttcacagatgagcaaagtgaagctcagagagatgaagtgacttgtccagggccgtacagttagatccaggatggggacctaggcagggtggcttcagaacacatgccaaacacctgacacgcagcgaggaatgtatcacgtgttcaatacataaatggtagtagcaatatgaaaagcggcagagggttagggcacagcctcccctcttccccccacctgtcctaagtatccccctggtacaggatccgggctatggagctcgcaggcgggtggaggcgagcgcagatccgccaatcctgggaaatgtgtaaaatcctgttcctgaaaaccggccgggttctcaaagtgtcccggctggcgtgttttgctagtcacgaaacatgatccatacgctgtattttaggactccccatctgtcggcatcggggagcgttttcccttgaggaagctcaaagcgtgtcagctcactgggaggggaggcagcagaagggtctgtgataacagagtggatccagagggctggggtgtgggagactcggggaagggtcctgcccagggtgtgccaggtgcctttccgcatgacctcacataatttttacacagatccccacgttttacttaagaatactgaggttcagggaggttagcttctttcttgtccaaggtttcaaggctgctaagaggctgagcagcagagattgaacttgggtttttagattgcccagtgttctctgccttcccccagtctgtcccttttgttcctgggctttaccacggtaggtggtgaaggacagggtgtgggaggccttgcctgggaatgggagggggtggggagggaaggcataaatgcctggctctcaggcccactttgcagagagcccacacctgccctggccccacccactgctctggtcactgctggtggtagaggaagagctaagagggctattgatccacccatctcctcccagggagggagggccacacattcagggctttctttttaaaaatgcattaacctgaccgtaagaaggccctggtttaaaaacaaataaaaataagaagtgaaacaagtgggcgtgggggcaggagtggagcaaaccctttggaaaatggaaagggcatttgaggagggcactttgcgaagtaccttccagttccagacctggatgcctggactctgcagcctgggctgcgctgctttcctgtgccttgggccatcagtacctctcctggtgctctccgcagggaaactttgcccagatccagacattccaggaaatccctctgcgcgtggccttacacagtgtggtgtcagtccgcattttgaaagcctgccttcgtagccctgacttggacaactttgccctccagcctcctccctctttgccctccagccacattgggcttcttttggtttctcagaagtgccaggtactggcctttgcacatgctgttccttctgcgtggaaggtgcttctctccccctctctctctccctgctctccaggttagtacctgctcatttttcagacctcagcctacagggtacttcctagggaccctgtccggcccgctggctgggtcaggcctcctgtcatgtacccacttggctcccaggacttctttttttttttttcaatcattatactttaagttttagggtacatgtttcctccacaaccataataaaggaattaacatattttacggcaggtagcaattaagctctgggaaggtaaggactgggctatcctctttactgtcctgttcacttttgcccttggtcatccttgcccagcacagcacttactaccatgggagctcagtaaatccttgtggaatgaatggatggcaggtcggcatctattctctttggcccatggatgcagtttgggtgaaggcaaggaaataaacattataatcagaaatcactgtaattttttaaggtttctcaaggtatgggcccactgtgaggtcaggatatggcttcagagtggagcccccaacacattaaaggggagacgtctggccagcagtccacaaggccagggtgcttagcagcatcccagaacaggcagggaccttgaaaggtctctgccaacatgttgtcttggtaggtggaaagacgtggagcctagagaacagaaagcactttgccaagaccacacaacagtagggccttgggagacctctacttgagcctcagtttaattgcggaaagagagttaatccagcaccaggtgccagccggcttactatgcagacattgtttcactggcctggagagcgactcagtttggcagcaccgatttacagaggagggaatggaggcttgaggaacttaagttgctggtctcaaaacacagcagaggtgggattgaaattcagatgttcctgattccatagcctggttctttccactgccctgctttccagcagggtggagtggaatgacagccttgtttcttggattggctctggtggggaccttctgcctcctcttagccagtggggctgtacctacttgtaggagcctgcagccctctgggctggtatgggagtgtcctgggtgttcatggagtccattttttctccccaaccttgttttacgtcgtttctgtctcctgcctctccacctctgaaagaacctcagaaattcctttgtccccttatcagtcatttccctgggaagccactgaggatcctggaaaggtaccgagggtgatgaagcaaaatttgcaccattcccagagtaactttccatcatgcgtggctaaaaataaagtgtgtactcatttctccttgctgtgcgtggacttgcttttggggtttcacgggagccacttggcccttttgtccctccctccctgccacccctggacaggcatatgcccacaacttggggagatgggtgggcttgaagctgctcacatctctggagagcagaacccctgagcctctacaaggaagcacctctggctctcaatggcagcaaacaccacattggtgggttggcactttggcatatgcggggataccgactccctttgcaaatattactgcagccgaaaagagacaagctacctttagaggactttctttgtgcagggtgtttctttttgatatctggaatgcacagaggcaagagagataaaattaatttgttcaattaattttgtaaatattgactgaaccaaagttttatgccaagtcacatgtcagggacctgagagcttaccaaaaagcaaatgccttccttgaaggcgcttatcctctaggtgggggaagaaaggtgtgttaagaaagaagtagagccagagaagcatggggtcctgctcctaccccaccctcccttccagcattagtatatgatgctgaagtttatgtttgacctttccgcctttcccctttcgttctttcttttctttctttctttgatggagttttgcttttttgcccgtgctggagtgaagtggcacgatctcagctcactgcaacctccgcccctttggttcaagcaattctcctaccctcagcctcccaagtagctggaattacaggcgcccgccaacatgcccggctaatttttgtatttttagtagagatggggtttcgccatcttggccaggctggtctcgaactcctgacctcaggtgaactacctgcctcagcctcccaaagtgctaggattataggtgtgagccaccatgcccggctgatctttcccctttcttaaggcactagagattcccctctcctgcaatgatgtttttttttttagtggttactatgtgctagggctaggctagtattttactcgcatttatttcatgaactccgcaagagcctgtgaagtaattactgctatcattcctgttttctggttgatgaaactgaggcccaaggccccatagctaaaatgttgcagacaggattcaaatctaagcagattaatttcagagctcacgcttctaaccattagctgtatagacacatccacactgagaatgtgtgtctgccaagaatctgctatctgtccagcatcaattatcctcaataagtgctttctctttaaaaatcttaactatgctttccatttaatccttaacattcctagtaacccatgggataagataagacccccttctcccccatttcctattctttttctttttctttttttttctgttacagattgcaccaaatggtgataggtgaagggtctctggagagggcaggatactttggaggctggaattgaaccatgttgtcttaatccagagcctgtgggagagagaaggcccatgaaagcactctgcagactgtaaagtgctacatgaaataaaaggcatgtgagaaaaggtgtgtgtttagaagactagctttaacttggacctcgtgcatcctatttggggatttcttgcaccgtcgtcatgatctggtttcaggtacctgtgaaaaattatggtaattaaagtataatttagaataccctgttggctcacagcagctggtccagatgtaggaggctggggctgtttgttaggggtgtcactctcttctgccctttgtgttgttggggagaagggtgggggcaaagagatacaggagctatttttacgttgttcacgtcatattcagaattactggatgcttgtggttgggtccctgtttagcctcggctgggaagagagaactcccttggctgcctgggtatgtatggaaacttgagctcataccctttagtatatatattgccgtaaaggcaaatggacgcagagtgaccggacagttaccctgaatagttggctgagattttccattctcttcagaatgcttctagcgggtggagaaagtggggttaggggtcgggagtgagagggcgggaagcataggcgggcagccatgtgctcatcactttggttatttattcaacagatggtttttcagtgtgagatacatgctagatcttttcccaggtatttgcaaagtaaagtagaataaggtattgtccctcaaggattttacagtctagttggggaaatggaaaaataaacattcgctttagcatatgcaaggcaagcatatcagcccgccctgccgtaggtgccggctatgcagccccattgcagtaggggcaccgaggctgtgaacacaggagagggacacctggaccacaggggcagtcacaggcaacttcctggagcaggcagtgagtgcagaagctggcttcacaaactggagaagcacttccggtttagttgctgttgagtgtaatatacacacatgatgtcatggatggttacaatcattatatctcattttatttctcagtcggcctgggactttattctcattatttttcaaaaataaattaaaagatagagatgggggtctcattatgttgtccaggttggtcttgaactactgggctcaagtgatccccctgccttggcctcccagagttttggggttacagacgtgagccaccatgctcagccagattttattttttatgcccaaaaaactcactgtcttcaaaaagtttgaggaggccgggcatggtggcccacgcctatcatcccagccctttgggaggccaaggcaggtgatcacctgaggtcaggagttcaagaccagcctggccaacatggtgaaactctgtctctactaaaaatacaaaaattagtcgggtgtggtggtggatgcctgtagtcccagctactcatgaggcaagggaatcgctggaacccgggagacggagggaggttgcagtgagcggagatggtgccactgcactccagcctgggcaacagactgagactccatctcaaaaaaaaaaaaaaaaaaaaaaaaaaaaaagcttgaggaaaacaaaatgctttggttcagccaaccttttgctgcttgaagtcagagactggagcgagaacagcctcagcagcacaaagcctgccctaagatccctgcgcctcttccttgagagggcaggccagggtgggttattgcaaagcaagggttaaaccagcttctgcaacaccaggtcctggcctggctcatgcactgtgccacctgagtgtgtgtgaggctgggatggtcatgaggcctgcctgtgtgccctgtgaaccgttggggtgggtggaggtgtgtggccagagtgaagaggttgctggccgattccactgtgaaggtcaactggggagccagtaactgtcacaaagtggaaggaagagaagacagcggaagcccagagaagcagtgtgtctcacctgcggcagcgcactttgcttggttggcttggggcagaggctgacattgagagctgtcaagataccagttgcacatgctttccccctccacctctgtgtgcattcctccatccagagtagattctgcgcgggacctcccctctgtcacaccctgggcatgatgttgaggaagccagtgaattgggctcagccctgtccttggggagctggctattcagggtggttaccacgcacgtggctgaggggcctgacctaacgtgtgccttctgggaccctctgcatatagctcgagtgtccccagcatccttgtgagccacgtgctgatgctgcagcacgccaaagccctgtccttggtgtgggattatttgcagttagtattccaaatgtcaagttccccttgacttgcgctgagcagacaaaacaaaatggcagacagattagaagaggcttgagaagccttttaggatttgaaaaccttactctgttgactttgaaaagctgctgaaccaggcccatctgtacagggcctgggggcatctgcttggagcccattggctccgtgggcttgggaggctctggacagtgctggctctcccctccccacctgcgtgtgcatgggagccagggatgctcaccgagaatgggcaggaattgaatgcagtccctcccaattagtgttgtgagggaaggagaaaaggagggaaggaggagaggcagtcgggggctggggcctctgagggcttcaggaagatttccggtgagtcccccaacgtggggggccatgttagtcagcatccatttaatcccatctcatatttgccctgcttactgcagagacccagtgggtaaaaggaaacaggatagcccactggattatagtctttctggaatggatagttagaagtttaagaagttatgcccatcagaggtacagaagtccctggctaagaatccagagtgccagtgctagaagaactttagagatggttctgtttattcccttctttctgcagatgtagtagctgaagctcagagaggttaagtaatcggtcgaagccacacaggaagcggtaaagctggaattggcgcccatctctctggctccagtgcccatgcttgtcctgtgacatcatcttggctcctgctcttaatcctcccttgcgagacttatttctcctgcccttcccccagctacttccttttcctgcctggattccccaggaattcctctgcgttgctgccttgtccagcctgggagaagcgacaagagctgaccatttgagtgagaacccagccccttgctgtttctctgacaccttccagggatcagagtgcttgtcttacgggattgtgcgtgcctccctggctcctgaggacaggcagaaatgagccttgcgcctttttgggcctctcggtctcagggaggtttccttgaatcgatgtgtttgggcaccggggagatagactttaaatgttgtgaaactctggggcccatggcagcctgtggtaagtctggccggacacatgatcttcagccctagccttaaatcagcctctgtctcctgctgtctctgccagccatgcagggcagattgcatgagggttcttgacatggatcacagttgccggggcccagagtctggaaggtggtttttgtctcttgtctcctttttctttgcacacttatgcacaagtgccttttgttcccagaaatgcagctttctcagtccccatcctagaaacattgtcggaatgtaataaatctgattctgtttatgttgaagaaatgaaacatattgctctccaaggaggaatgcagcggaggccttgaacagggctatgtttatgacaacagtttgcacatgtggctttatttttgaaagcgtagtgctttgcccttcttgatgggattctggtaacaagagctgattcttgtgtccgggtgttgggcaaacaaagggcagagctggctgaggccctcacagctgtggctgtcaccttagttctgagagcctggctcctctaggcccttgtcctttcctgggggttgcagctcttcccggggcagtgcctctgtgctgcttgagtcagagcttattagttcagcctcctattcccatttccaggtccaaaacaacaggatgaaatttaataggcataaatgtaaagtcctacaatgtgggttcaaaaaaatcaacttcacaggcacaggatgaagaagattcatttgaacggcaagtgagaaagtggcccttgaatgtagctgccagtcggctctgtgtggcagcagttggccatcactgaaagagagtaatacaggctcactgcacaggtatcatgtccgcaaggagaaagatgatgttgttattgttaataattcatcctaatagctaggtactttacatgcattattcttccattcttaaaaccatcctttgaggtaggtcatatgatcctcctattttggaagaggagaccctggcttggagaggttaagttacttgaccaatgttaaactgcaagaaagtggcgggaccaactgtaatccaggtcagactcagagcctgtgccatttggagctaatgagtgggtccgtagatggtagagatttggaatggagaaacactgaaggaaatgacagcatttagcttgctggcagagtctttataacatctgacttgtattttatttgtttatttttgaaatttatttatttatttatttattgagagggagtcttgctctgttgcccaggctggagtgcagtggcccaatctcagctcacttcaacctccgcctcccgggttcaagtgattctcctgcctcagcctcctgagtagctggaactacaggcacgcaccaccacgcccagctaatttttgtatttttagtagagacagggtttcaccatgttggccaggatggtctcaatagcttgacctcgtgatccgcccgcctcggcctcccaaagtgctgggattatgggcataagccaccacgccaggcctattttatttatttttgagagagggtcttgctctgtctcccaagctggagtgcagtggtatgattagaactcactgcagcctcaaactcctgggctcaagtgatccttccatctcagtctctgagtagcagacaacacatcaccatgcctgcctagttttaaaatactttatatagataggatcttgctttgttgcccaggctggtctcaaactcctgggctcaggtgatcctcttgcctcagctgccgtagaagctgggattacaggtgcaaggctctgtgcctggctacatttgacttttatatggccctcactgtgtaccaggcaccattctaaacagttacatgtatcacctccattattatctctgttttacagatgagaaaactgagacacagagagggtaagtcagttgcccaagatgatacagcttatacgtggcagagctgggatttaaacccagatagcctgtcttggagttctttgattttggttttgttatgtagaaacggggtctcactatgttccctcagcctcccaaagtgctgggatttacaggcgtgggccaccatgcctggcctgttgaagtttttaattaccaggccatgcagccttacggagagtcaggtgggttggggtggtgagaaatctgacggtgttttttggcaggatgatggctgtcctgtttggatccagggcagagctacagcctgagcatggctgtataaatgggagaggcatctgctctcctgactctgcacaccaaatggccaggaataggcagaggaggcgggaggatgcaggagaccatcttctctcccgagagtctatgaggttatgaaaatcctttccgtattctgtggggtatgcaaggtctccaggcacacccacgtagctggctggctcccagggctttgttgaggacaaggtcagctttcctggacattccccacccccaagcagtggtgtgttcagtggtgatggtccctgcggaccacaggaggggaagtgaccaggtgtttgccaggtccagcctggccctattaggaagccctggttgtcaagcgcagcagaactgctgacagtgacacaggggaacaatgctgcgtgggaggaggcgcacgcgtgtgtgtgtgctcgcgcgtgtgtgtgcgtgcatgtttgcttactcccctcctgacccgagtgccagcagtgacacactttacttgtcccctctggtcccctgtgggcactgaatctgactctctgatgcgcttgacgccctctcagggcccttgttgagtggcagctttggctgtgggacaagggagcaagtccgttttttttatctttctccctaagccagggcagacagagggatgccttaggcttatgtggcctttttggagctcttgtcaaggacccctgggagcgtgtcacttccttggctctggttagggagtggaggcacaggaaggtgaagtgacttcttagaggccacatagctagcaaatgtgggccaaagctatagtcaggccctagtgactggggccaggggggtttggaaagatgatctcttctgcccagccctttcatttacagatgaaacaatgcagccagatgggcagcttgacctggctgaggcattcaaggtggctgggactagactcaggtctcctggctccagatcccacatcatcctctccacactcccacccctcccagcagctccctgctccacttttagtttccttgcatctcacttactgttgctgcctctcctgcagggctgatgcgtgtatctgtgactgccatgtgggagtcctttcacctactgctcctgccaccttccttggttgccagtatctgattattctatttgccaccccccttgcctcctgggagctaatagcaacagctggaactgaggggaaggctcacaggctttggctaggcagcctggaatccactctcagcccttcacttaggagctgtgcgaccttgggcaagtccttcaacctttctgagccctggtttctcatctgggagataagatgattcggacttgataacctccagtgaccttgcagccctgcacaggtctgtggctggtgattttcatgaaagggagcaagagccacactgacctgttgttggaagctgttgggaagggcagatgacatggactggtgggaaagaccctgtgttaggaggctcaggcatgcatttccagctctgccttcaccagagaacagttgccttggctgtgggtgctggcgggcagttggggcaaggcaccaccctccttgttgcttctctgccacttcctttgcaccaatgctgggggcacagacattgctcttcctttttggtgaccatccagggtagagaagttgctggtgagtgtgtgagcagcaggcttctccagctgaccagcgtgttgcagggcaggagtgatagcccggcacaggcaaatgccaaatcctgtgtcacgtaagaggaactccagctctgttattgggcctgtgagatcctatgcacagtagatcacaggtgtggtgtggagggagaggcatcagagcagaaccagaaaactctctttgtcactgtcttcagtcttgctattgtgttggctgtatacatggttttcattcttgggtttttgtcttggctgtgaagtggcacgattttctgaactaatcctgtttcatgtaacccgaacccaagtatctggacgtgaagggcgagctttttcttcctcttccttaaccaaggatatccgagactgtagcatctggaagtggttgggcatctggtctgagggagtgtgtgtgtgcatgcacacacttctgtaatactgagtgactgtgtccagacaatgcgcctttgtctctccagccaggcatatacctgtgcttctttctatatagaggacgttacatgcggaggttattatatcggggcatatgtttatgtggcatacacatgtataaacctttatttctacttagaagaaggaaattttgaagggctttctgtgtactaaagtgtttgcaatgatggatgttgatgtatttttctttacaaaatgtaataagccatttaacagtgccttcagtggctgtcattagccatttcttcattacttccaggctctgccgaatcatgcattgggggatccctgctccctggcaccaggagcagtgatctgcacccacggtggtgtgctcaggaggtagcacggacttcagggtggcctgcgttggcgatctgttaagggtgtctctttgctgcctggttttgacgtgggtgggatcctgtcctgggagatttctgggctggttgtgtccttgagagttaggctctgaaagggatttttttttgactgcacaaggttggagcgttgagatttgggctgtgtcagcaggtagagcccgtgtcctcaccttgcaggtgacaggcagacagtgctgggtacctccatcagagggatgtgcatgaggaacctagggtgtactggtggtggggagggactcctgtgaacaaagcggtcgcccttgctctggtttgcccccagggactgctaggcggtggattcatagtagaattttacactcaatgccagaaagaacttggtatagccataaggatgaataaaatgggaatggatggccgtggaggtgtagggggccaggccaggtgactccctgggcacagtatttgctcctccctgaaccactacttgagcctctgttaagggaagccattcatgcctccctcttggtcaccagcagtcctcatgtgcccggaaccagtgccctttgggctggtcctccctccttgctggtggtaatcacgttgattgatgtttgcgtttttttcagtttggcccagatttccttctggctcaggttgattttcaggcctgccttctctgctttgggggctgcctgtgcgggggatccatgcaggtccgttttgttcttgggctcaaggctcttgtgtgtatgtattaggggaccatataatatcccaaccaggatacttttataaccaggcagtgctattcatcagtatggtggggcgccaggtgtgaacgtgcaaagtctgggatgcgtggtctccttggtgttatgttggaagctctccttccagctactgggtattgaccaaaatctacccaaaagcagtccagtgttcctctcccctccgtactccagccctagcagcccaagatgaattgtggggtgagaaggacagccaaccaggcttgtcccctcccccatttctcagggaggggagcggctgggccgctgttttgtattgaacatttgctgccatggcatccagattcccaagaagctgggggctccctgcctgtgattgtgtaacttggaacagttgatggggagggagatccctgaattagatcaggaaaatgtccttttctggtgacccttgcagagcctatagtctccttgaggcttgctcacctcccctgtagcctggggccctggaccaagcacaggcaggtggcagaggcctgacagtgggccctcttgttgttgcaagccccagcctggcaggccatcctgcctcctcccagtacacaatcagtattgattgtgcaggaggctgggactgtcacatgcagtaatccttgcttcacagcaggcatgctccttgaaggaagaaaggaagaggttttgtccctgatctaacatgcctttaaaaatgcaccttgatttaagattcagctttttgcagcatattttagaatgtcagaaagataaatgtgcagccttcttaatgtgtctgccttgaacagccccttaaaaaaagtatatcattcatcctcagggtcacaggctgtttgcctccctccccgcctccctccctgcctttgatggtctatccacctcttctatgagctgagtttgggtgggggcagggggatagactcaaacccccttccttccagaagtccaggagatgcatttcttttctctgttttgaggctagtcaagaaagccatacagagtttctagaatattatttggaactttgcaaaacaggcaggatctaggtacccttcaggggcatccttctcatttcccacaaaaacccactagccagagatgaagaggaggagaatgcacacgccagcccctgccctcctggacaggcaagcactggctccccgttccaccgtcatgtggaggaagtagggcctggtgcgttcctgatgcagtgcctgtggccagagcttcatttccaaggttggggtagtggccccttctcagcttctttaaggtcccggtaggtattgggttacaggtaagggagatgccactggagagggaatcagtctgtggggttgtcattgtgtgatggctttttataaaggcgccttggcaacatggctgtagctgcttctcccagaaggaactggaggaaccccagcgtttttcaagatgtgagtgaagatgtcaaaacactgttaggctgattcaggaactcagaaactctggtggacaaggcagcatggagcctgagcgagagctgctgggattgctggtgtgatgaggcagtcacacatggtgaggcctgggctagcctctgcaagtatgtagacaaggacctggaggcccagagagggtggtgacttggccaaggtcacacagcagatcagcagtagagccaggaccagagccctgccaggtagttcttctgaccagaagcttttggtcacctcagcctcctgcctcaggtgggtcgtgctggcgactcagcagtcctgatttcagcacatgaacacctcgctcaggcagggtcgtgcgtgtgttccttgttgtgaacacactggacgatgtggtccttgcctctgactcattgttcgctgcgggccctgttgcttgcaaggagagaggatgggagatgaggagtgccgccctgcatgtgatctgcctgggtacgaggtcaagacggctgtggagtgactccagggtacaagccctcattctccctcccactccctagagtcgcccgtcctcttccctatcaaccattttgaggatcataacatttatcatgagctttattatgggagactcttcttcgtgtttaaaaataaacgctggcttacggaactatatttggtatatggaagtcgtttgcatgtaaatgtgcttaaaggacaactgctttatttaagatgcagagtgagccccagctagagcgtgcctgggatgggggaggggacaggacccaggggtctgcctggctctggacagatgagtgtagcccacagtcctgttgaatctgttgtccttttccctggggacagttgcagaacaggataactcgtacttaaaaattcatagaaaatgtttcttattataacgtcataattgttatgactcagaaaagtagaattgcctttccactatgcctgtctgccctcacttttgttgcctaccgagtccccagcagcagctgcagaatcattaaaaaagagagagagaaagggaaagaaagaaagaaatccagggcgatgctttatttatgttaacggctacatttgacttgaaaattctgtcccctgagccttgaggtcagcacattacagagtgattgatggctgtcaggagcaggcagggcggcagattgcagagggggaagtggacagatgatgccatggctttcccggggcttagcagatcccaggccttgaaaggaacgtgatggaaaacaaaagcagatggagaactctgccttggcccttacctgtttttttggggggttttttgttgttgttcttgttgttgttttccttccttccttccttccttccttccttccttttccctctctttcctgctgagcattaggaagcgggagaagggcattctgcaccctcagtagcaccccagaatgtgtcacttttgggtgtggcactggggtaagatcctagagaggctgggcccaagatgaggcacccctaatcccaagtgcctgagttactgcttagaaaccaggaggcccggctctgccctggcgttgcctgtccttgaaatccccagaaacatcttgggcaccccccacccaccaccaccaccaccttctccttggccccgtttcctaggtccacaaaccaaacaggaggaccaactctgggctcttgtaaattgttcctgccttatggcctgcgctacttaggattatgtttccacagggctttctggctaatccttgtgtattttcagtggtggaaacaaatggtatcagacccacaggcctgtttacagatggggagacacggaaatgatggaagagctttgaattttaaacattagctaatgaaattgcagacaagggcaatgggtggaacggcctgggtattcccatgaaacagttattagagtcagaatgctctggggtcggccatgagggagaaaggcaggcctggctcgcgtgtgtgtgccacaaacatttatggagccctttcccagtgccaggagctgcgtcaaggaagagctttgagtcctgcccagggtgtcccagcctggtggctaaatagaataagcttggggcagagaagcagcttgactggcaggacctttctgcacagaggagctggtatctgcagagttggaggagataccaaaccaggcttggaaggaaaaggaggctgacctggctgcaaagaggaagggatgcgggagggtattccgggcagatgctggagaagctggaggtgaggctggagttccggtgtcccccggaatgggcatgacggtgggggctggaattcgtcatttcccctgcttctgcctccccctcttgttgctgcgccttgtgcagttgtgtcagagatgggactggctgttcattcatccgctaattgttttgataagagactctaattacccactgcgatcatcagattaccctgagctccaggagggagatttgagagtttgagctgcggctgctgctgccatcagcaccgccatccctgctaaaaggaacctgctcctatacctcggcccctgtgcctgcctctggccggtgctcactaagccatcacatgaaggtgtgacaggctgctgggtggggggtggcgggggggagctgcctgtgaaatccacccgagagtacaatcccctgatgtcaagcaggattttccctttgattatctttgccactgtgttaagtccgcagataagaggtttggttctagggatttcaaaataaggagaggagtgtggaggaaaccagagaaaaacagtagcgcctctaatgaattgacatcggcagtcgagacaaattcaaaatccttttcgaactgtttgattaagttctacttacatgtgattttagtataaagagagcaataggcaaaaaaacaaccaggaaggcagattataaattaatccaataattgaatcccccagcaaaggtaatggggaatgatggtgtcgtaatctgatacagaattttacatcagcaggagttacaaaataagggagtatttcatcttgggagggctgattgtgattggatgtattgcatcttaaagccttggcccttggaaagctttggtatggcatgtctgacctttttcccaccttccactcctgtcttcattcattcagccacgtctgtagatccagaagagctggtgaatcccatgatgcttgggcctagagaagtaagattctgttcctgccttttcctagtgagatcagaggctcacaaatcatcttgttggttaacatggttctcagagaaaggggcagctaggctgtggggtctggctgggatttagaggagtgggcagaaatggagctacaataccgaaaggcactgggcgctcagtgctggagtgactcgtgctgggatgaggtcctgggcccagatgctcggctgctccatttttccgtttataaaatggaactgcagtagatgatatcaaagttcccttttggctctactctcttagtttgtttattcttagaccccattctcccgccaaagcagaaagccagagaacataggtccagctctctgctccccagtgctggctgctgcaggctgtgccttctcctcttggtagagcagagcggctttctgcctggctccctcccattgtcttcacatttggggctcagctagccgggaagtttggcaacatgtcaggccgtgtatcttgaaaaccaccctccagaaaccacctcgtttagcagatttaccgacatattggacctgcctgttctcaggggccagcgtactaaatcacagcggggccactggatgccttgacgcagaacttttcaaaaaatttcaagcaggatatatcaccaccccattaactccctgccattaatctactcctaaaaacctggagttttcccaaaaggaactggaacggggtgaaaaacggacccatttggtaaattctgtaaatcaggctggccttctctcctcggcctctccagccttggtgatgggttgctgcgtgggagggtagatctgcagccttccaggctttcgagggagtgtccccaggatggatgtcagtcttaaggggctgctgtactttatcctgctctggcctatggggtcactgagtgaagtgttctgtaggggtgtgggggtgggggactgtcgtcaggaagagctgcagagaatgcagccggcttctcgatggcacagaagccgagcctcatgctggggctgtgccaaggactgtctggaagggaccaaccccttgcctgacttttctgattgccaagagggattttgttgtaaaggggctttgtctgcagccctgaagactgtcgaaagagtccatccccacttctgatttctgtggccggaaggctttctccttttggaagaagatcctgtccaggagctggttggagcctgacaaacctgggtttgaaatgccagcattccttgctcactaacctcaggaacgcaggcaacacgcttaacctctgggctccttaattccgcacctataaaatggggataaaacacattcttcaaggatgcttgaggattaaatgagataattcttgtaaaatgcttaggataatacttagtgcgatgctggcattctataaatgatactcagttaatcttctctggggggacacataggatacctgctgcattctgcttgtacatcctgctcaggtgggcctgtgctagcttgaaaaaggaagaccgtcttttttgctagttcctatctccctctaccacaacccagtctttgcagcctcacttttgggttagagtcagacagtctctggggcagagccttcctctgctccttctgggtcagtcctttccacctccagataggtgggaattcagctgtcattggaatccaggcttttgcaatccaaggctgagctttgcccccaagcacccgcatccacccacacatctgctggccttctctcggcccttccttcacttgcctgaaggcagatagcgtggtgaggtgaggccaagagcagtccttacctgcctgttgggacagggtctgatgagcaggccaggacaggaggctggagcaacacctcctcccaggaagatggggagcctccttccagcaggacgcctggcgtcctgccctgctggaggaactggtttccagggcctgactcccagccccacctgctggaggggtcttgggattcgagaggcctgagagcagagatcttgcctctgtttcctggagtagtttacttttctccccacttatggtaaaagtatctgttatcttgtgcatcttctggcctttacaacactgattaagccctggaagcagaatttgggggcttaaattttttttctttccccactgaagagtagtcaaatgctctgggagcttcattgacttgcttaagggctgtccattggttctgtgagctgggaagtgggagattgaagggccctgtacctctcctcaccccaggaagttccaaataactcaaaaaggttcttctgccttgtctttgttctggaagtttggagtctcctcctgagttcccttgaaaatcataggtcagagttcagtgaacgaaacccatggagtacgagttattatttgtcagttttgtcctgggacaattacggctttttattcccagcccccctgtaagtgcctggggcagtttgagggcaaccagtgattgtatgggttcctgttttatgttgggtgctgtgttgggactttcaaaggccacctggtaatgccagctgacttaacacctgacgcataagtggatggatggttttgcttgaacctaggttggttggttgaggtgccggggttggggggtagggagacaggtgagttgttgcttggagaggagagagtgggtattccctttttttttttccttttcttttgtccttcctgcaggggaggatcttgcttcctacatctctttagcatacataatgtagatcccatgttcctgcttgactttgggcattttcacatggtatttgataggtgtcatcttgagtttatgtggccaggtgcattatcagatgtggcagtaagaatgagctatatcctagatcccggaggggattgcctcctggcccaagaactcccaaaaagttctgatgtgtggtgggcacacatcagagaaggctagccattgtctgtgctggtggctattggccatggctgttcacctctcctgcacctcaacccactgaagcctctgcttccccgtgctacaaaacttcaccagcagtgctgcgatgaatctctgatgcctcaaatccacaggtgtctttagtccttgtcagccctgtttactgcctgattctgtgtcttcctttctcctgcctggtcagcctgtcccagcagccaggaagggacaagagaaattgtggagacttgtgagaagccagatccttcttgtacagtggtgtcataaatgacatggaaaggctggaagcggggccaccactgtgcccctcccacttcccacctgcagcctttgaggtctggtagacctattcattttccagtcctgaagctttggaagggcagggttgagcagagtgcatcctattttccagcccttcttccaaccagctttcagtttttatctccaggcaatcaagcagtactcaaaacatcatgcctctactcatgctcactgaacctccttactttgtaggccagtgggctgagaccccacctccttctcatgggggacattctatcttgagcctggtcgacttcagctcccttttcctcattctgctcttaatttccagaatagcacatggaagacactccagtatgcttgcgtgagtgatgctagtcggttgtcctttgagggcttaccatctgcaagtcagtgagctgaagctgtgcgtgcattcttcgtttgacttgcacgggaactctaggtttcatatcgatttcccagttttccatggagaaaaccgaagtgcagtcaggttaaggccttcccaggcctctggcctgagagttgccctacttgtttgtgcagactcacctagaagagcctttgttgcgtttgtggaatattgaggtaatgcagtgagagctttcgggatggtagcagggtgtggtaaaaggagccctgggacagaagctagggatggataccacccagccacttgacctcgggcaaatgacagccccactcaagtccacagtttcttcatccagaaactgagggcactgagatgaatacagcctgctgccagagttctctctctgaaacacatctggccacgctgcaccagtgcctgcagtcttgagggcattctcctgttcttcagggtgaagcccgagttccctggctgggcccccaaggccctgtgggtcaacgcctttgtcacagcatctcctgtctctccagggtcagtgcctttgtcacagcatcctctgtctctccagcatgaacagaagggcttcttgggagttcttggctataccatgttcccttaggccactgtgcctttgcctgtgcattttcttctgcctgacatgccccttgctgcttttgcttgctagggggcaagcttccccttgcaactgagctccaggttattttcccagcaaagctttcctgcctcccagagcggaataaactacaccctttttttgtactcttgttcattcattccacaaattcattggttgaatgcgtaccgtatgccaggcactgttctagttgctgcagtttccgagaaagccccagaagcttccgtgtgtggattgaagctatctgcttatctgctctccttctctttctcctggtttccttgaagtcaaggcctgtgcctctgtgtctgcccccagttcctagcacctggatgatgttcagcagctacttcctgacctccttcccacctctcaggactctggcattaacttaaaacttttctggtgggcgagcagtggctcacacctattgtaatcccagcactttgggaggctgaggtgggcggatcacgaggtcaggagatcaagaccatccttgctaacacggtgaaaacctgtatctactaaaaatacaaaaaaaattagccagcatggtggcgggcacctgtagtcccatctactcgggaggctgagggaggagaattgcttgaacccaggaggcggaggttgcaaagagccaagatcgcgtcattgcactccagacagagtaagactctgtctcaaaaacaaaacaaaacaaaaaaacctttttggtataatctgcctttgcctgtctttggcttctttgaagccagatgtcttccctctgtggtccatttctttttttgaaaaaggccagtgtcaccccatttctcatctctgaaactggcttccctttcacttttgttcagtgcttttccaccctggaagtcactggcatttgactcttctgctagattggaagtccctagagggcagggaggcctctgattcacctctgaagattcacctccctctccagcctggcatgaagcaggtacctgggacaggaatggatggcaagctgcctcctgttggtgcatttcagaggggtctggacactgagggagccttccttctgtcaaatcttgaaaaatcgtgaagtctgtctagacagtgagtttgaagccagtttctccagcattagtctttgtggttgcttcattcctcagatgcttcccaggccacctgcgtccttcaaagagaagaggccaacaaaagaataatacaaattttctggaaataccatgtcttagctgctgctttttcttcaggacttttttttttctttaaacctaataaattgatgcagaacctgcctctggccatttttcctgcaggtggtcattgtccccttggaaggctcgcgccagcctggaaggttgatcattaacaaattcagggagggtctgtgtggtacaagcaggagcacagaaagttggcttgcgtggaggtaggggatgctgaggaccttcccacctgtggggctgaaagtgacactgagtgggtaaggctgagtcctgaggctcctgctgcttctgtgtttggaaatttcccttataaaggggtttctgcttcccgtccttcccccagcacaggcagatgtcttatgtacctacatagtgccaggtgtnnnnnnnnnnnnnnnnnnnnctgcatcctcccgcctcctctgcctattcctggccatttggtgtgcagagtcaggagagcagatgcctctcccatttatacagccatgctcaggctgtagctctgccctggatccaaacaggacagccatcatcctgccaaaaaacacctccccattcacgtctacattgtcagaggagctttccatttaatggtgagggtggggagaaggtgaccgtcactgtgcaaggggacatgggccctagctcttaagtctatctggctcatcatttagaagctgtttgagaaggatgttagctcttcgctgagcctcagttttctcatctgtaggctgcggataaggatacttcctcacttctctaggttattagaaggattagaaagaacacatgtagaagcacctgcaggtccccagtgctcagggctggttggttctttgcccttctactccattgagcgtggtctgctgcagctggtgtggtgtggacagcctagaacactaaggattcggccaaagaattgcagtgtttccaagcctcaattcgctcatccatagaatgggaattgccattcactgggttgctgcgggggatagatgaaatcatagcagggaaaggtgccggatacatcctgggaaaggacgaccccttccctcctgttactctctcactaagttttaaggatattgtaactggcataggtaaggctggtacagtgatataatagtctggaatatctttgtagtgggaggagggggaagattcccggcttggggtgggggatgtggagaggctcctgagaggtgatgccacttcctgcatctgaaggggacctgggagagcaggctatggacacattcctctcctggcagtcctgttccttacagcctgtgcctccagctcctccaccaggaggtgagactcggcagagagctgcttggaaagctttatcctcccccagccccccaaactctggggtgtgaagatgaactggtgtaactatagcttggtgttttggtgtctgtgaggaaagcagaattggctcaagctgctttctcagttaaggggatttaagaagaaaaaaaaaacttaatcctaccctggtgatcaatctgacaccttccctttgagccccagatggctggttggggtagaaagttggccactgctgctgttagggaacggaatggtatagctgtatctctatattgaaaattatggctctctgtacgcacatgcacattgcatatataaagcctgcatgcctggtttggttttttggagggtattgaaatactcccagaaggttcctgttggttaaatgtcatccttggaggtgtcatgtgaacactacctggaaccatgttcatttgccttggttcaaagtctttacccacctctcctcgctcccaccccaagcctggagatgaggtagatggcatagaaagaggatggagaggccgggcgcagtggctcacgcctttaatcccaccaatttgggaggccaaagcaggtggatcacctgaggtcaggagttcgagaccagtctggccaacatggtgaaaccctgtctctactaaaaatacaaaaaaattagccaggcgtggtggcaggcagctgtaatcccagctactcaggaggctgaggcaggagaatcactcgaacccaggaggtggagattgcagtgagccaaaatcgcaccattgcactccagcctgggtgacaagaacaagatttcatcttaaaaaaacaaaaacaaacaaaaacacagaggatggagacatgacctcactgtcttccctccttgagtacagcaccccatctcttgtagacaactttggacacgttttggaaagtgaaagggaaacatttactattatcctgagtgacttctagacttggaaaaaaggctgcccaggtctacacatttttttgtggtttgatgcttttttgtttgataaacatgtttatcaaattatgattttttttttttgagagtctcgctctatcacccaggctggagtgcagtggtgcaacctctgctcactgcaacctctgcctcttgggctcaggtgatcctcccacctcagcctccccagtagctgggatcacaggcgcctgccaccacacccggctcatttttgtattttttgtagagacaagttttcactgtgttgcccagactggtctcaaactcctgtgctcaagcgatctgcccgccttggcctccaaagtgctgagatgacaggtgtgagtcaccacggttggccgatgctttttcttttgataaatagtatattatcattacagtttaatggcctcatatgctttattgaatcattcccttaattggcgattccttcctgtcctccatctctccaccctgccattgtacataacactgcagtgaacatctttgccttccattgtggatgatttttgctgtgatctgaatactgagtctccccaaaattcacattgttgaagcataattttcagtgtgatagtagtgaaaggtgggtcgtttggggaatgtgattaggtcatgagggctccatcgtcatgaatggaatgagtgccctcctaaaagaggctgaagggatgccgtgtgaggatgcagcaagaaggtgccatttttgaagcagagctcaagccctcaccagacaccaaatttgcgagtgccttgatctcagacttccccagctctggaactgtgagcaatacatttctattatttataaagtacccacgcgaaggtattttcttatagtagcaagaacagactaagacatttttattttattttattttattttatttatttatttatttatttatttatttatttatttatttatttattttattttttttttttgagacggagtctcgctctgtcgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctatttatttatttttgagacagagtctcgctctgtcgtccaggctggagtgcggtggcgcgatcttggctcactgcaagctccacttcccgagttcataccatcctcctccctcagcctcccgagctgggaccacaggtgcctgccaccacacccagctgattttttgtatttttaatagagttggggtttcactgtgtgctagccaggatggtcttgatcttctgaccttgtgatcttcccgcctcagcctcccaaagtgctgggattacaggcgtgagccaccgcgcccagttagaataaattcccagaagtgcaattactgggtcagaaaataaggaccctcctgctaaaacccttgaatcctttgccaaattattttcgggagggttgtcttggccaggtgcaatggctcatgcctgtaatcccagtactttgggaggctgaggcaggaggattccttgagaccaggagtccgagaccaatctgggcaatatggcgcgaccctgtctctaccaaagaaaaaaaaatcagctgggcatagtagcgtgagcctgtagtctcagctactcaggaggcagaggcaggaggattgcttgagcttgggggtttgaggctgcagtgagctgtgattgtggaactgcagcccagcctgggtgacagagcaagagaccctgtctttagaaaaattaaagacagagatcacactactgtactccagcctgggcgatagagcaagaccttttttttttttttttaaattaaaaaaaagttgtcttaatttatactgaggctagcaatagataaatgggtactctaactgcattttaacttgcactggaagttattaaacattgaagaatctctttttttgcttgctctagatgaaaaatgttataactccgacttttctactttctgtaccaaacaccaagtccatctgctgtgtgcttctcatagtaccaagtggtgtgtggtgagttctttcttttccttgactgccagggacttgcagctatgtaagagaggagggacaggcggcggctggaaacagaggtagaccaggcatggtcttgtgctattgtgtgcagttatgagctgcaggctgtctcacaagttaaggagagagagttatgtggcccagagagccttggccttgaggaatgggtacagacagtgcttgatctgtacagggaggctccggtagtagccttgattcaacattttgttcagtaatgtttatgggggcctcctgggcaccaagctcagtgggaatagggagatggataagagccagcagcctctccaggcagacagaatcacacgcggggaatttctatatgctgtgacagatggctggatagggtgccatggatgatcagggccgagtgacaagctctgccgttcttttgttcttaggattttcagctcccttccccctttcctgcttatcaaggaaggttggccagatcaacaagtatcccctccctgtccagcgtctgtacccaggtggctttgacttcatactgggaggggacactggaagcctcctcattcacctcctttgctgggacactgccagttgaccgggtgctcactgtcttaactaggcagctcactctccaattctggtgagaccagttccacaaaaagaacaactcttttccttaagagccctttgaggtcccttttaggcaggatctaaggaaatatttaagttcatagaatctttgtctagggaagcatgttcaaggtatcagacccaactaactgctcatccatttaacagtctatttcacaaatctttttaaagaaaatgttgaggctttgtgagtgccaggtagggagcttttgctgtccccaccaatgttggtgaaactgcactagccaggtgtaggcacaactgcaggccacagcctttggtgacatgtgtgatataaaagggttgctgtgcccttcttctggatctcacagctctgtgaagtggaggagtccttcgccctttttgcttccctctggagtttgcgctacatggtaggtcctcagaactgcttatttgaatgtgtgcccgcatacacttccttggtgtgtcttgtcagtatgtggtcttcctcccctacccctgccagacaatcaggtaatcctgtctccccttggagactgggtctacgttttaccttgggtgctggccccaactctgctccttagtaactgtttggctaagccccccttggctggctcccattttccatctcagccactctgatacctcatagatctgaaaagtgaaaatctggctgggagcagtggctcatgcctgtaatcccagcactttgggaggccgaggcgggtggatcacctgatgtcaggactttgagaccagcctggataacatggtgaaaccccgtctctactaaaaatacaaaaattagccaggtgtggtgggcacctgcaatcccagctacttgggagactgaggcaggagaatcgcttgaacctgggaggcggaggttgcagtgagctgagatcccaccactgcactccagcctgggcgacagagtgagactcttgtctcaaaaaaaaaaaaagtaaaaatcctagtctccctccttaccagctgccctaatatttgggaaagcttagctatcttgactctgagtagcatctgcttacgagcactgcacagaagtgatgggcagcctacggctgcagggcaggaacactccaggcccccgtgcttttgtgcaagaccttaggcattgaccccagagtacttgactgttgatgtcaaaaagcataggcatagctactcgggaggctgaggtgggaagattgtttgagcccaggagttttaacccagcctcggcaacatagtgagaccccagctctttaaaaagaaaaaaaaaaaaaaaaaaaaaaaaaagcacaggcacacagcttcggtgtgagcccccctagttcctggctgaggagcagggaagccttgagacagaagagaaagcaggagccctagactgtatcagaaagaagggttatagactgtgctcccagctgccttccattgtctggcgaggcagaggctgcagccccctcccccaggttcttctttggagaacaaacatatcaacaggattgattaccccgattggtccctgggcagctgtctctggcctgcatctggagctgatttctctgccgttgtacacccattgtcttggattgttcacttctacaaatcagagctggctccaccgccctaaccctagcacgaccccagatgcttgtttgtcggtggaatgaacacttcctgctcaatggaaaaaaaaaaaaaaaaaaaagctccaggcacacgtgggcaggctcagggccacctcccctgctctgatgcagacaggatgttccttcccatcccaccccctcctggcctccctcctgggcctgcctttctgaagtggattcaaagtggaagagacatttccaggaagctggaccaatcaacccccactggagggggagctcagaggggagagacacccaaaggctgcagtatggcactgtgctgtgggctctggctcccaggtgggacccaagcttgtgaggcctggtagccccctgacatggctgtggtggtcttgtctgaacactggcctcaggacttgtgacatcagaatgggtgggagccttaaggatacagagaggggtcatctctttcctttgggcccatagtagaggctgtgaaggaaggagtgtacaggacatgttctctggtcctctatgtaatcctgcaaatttttttttttttaagtgcagtggcgtgatttcagctcactgcaacctctgcctcccgggttcaagcagttcttctgcctcagcctcccaagtagctgggattacaggcacccgccaccacacccggctaatttatatttttaatagagacgaggtttcaccatgttggccaggctggtctcgaactcctgacctgaggtgatccacccacctcagcctcccaaagtgctgggattacaggtgtgagccaccttgtccggcctcttttttttttttttaaagagagagtatctcaccctgtcacctaggctggagtgcagtggtgcgatccatatctcactgtaacctcaaactcctgacctccactgatcccccgcctcccaaagcactgggattacaggcatgagccattgtgcctggccactgcatattctttaacacacatcccaagctgcaccctccttgagaagggaagccctctttggccacttgcccccagcaagactttcttttgaaatactacagagctcagagctggtgctatgtgctggagccccttttctgtggaggcaaatcagccggtggatgctggagagaggcagtcttgggtttaggcttagatggatctgagagtctccccagctgtgagtgcgctgggcaggggccttggctgctgtagatggtcaaggagtccccagaactgtggctccggggaacaacacagagcttgctttgggtagagtcatacaaggactatttctacatgccacctccttgcttttttatagtgatgatggtttggctcattctccagccaaaaaccttagaaattggagactctgactcggcacgggtgcagggtaggacaggagggctgctgctcagtgtggtcaggctgccctcctgagtctgccgcccctccgagtgacggtggtgatgctgcagctatgggtgtcttacccttgggggctgtggggctggctcacatgctctcaatgggccccatgaggtaggcagggttgtctcgattttgacatcttgtgggtaggtcctttaatagtttttcaagctcttttacctccattgtccctggaggagcctcacgacaggtcctgcaagtcaggcaggcagggtgattgtcttcactttgcctggaaagtttcccagggcctgggggcccagtagggcttggacccactttgacatgacagaccctccacactgctgcctctctccttcttggcttctgttccgaagcagggaacactccatctcagcccttcctatggtgttctcagcagttggtgcattaagtcagggaggaccctggtcttcactggtggtggatttccgtcttgagcccagaggctgcccagcgccagaccttccctctgctgcccccttctgggatggccagttctctccccatgatgtgtcccccaccttgttttcccatcaaagaatcggctctggtcagcaggctaaagaagtcagccatcgattagggtccgcgaaatagacccaagcatgtgtggcttggaagacatcaagccacagatttcttattgcccaagagttctagagagattgtgggtggggacctgcggtccttccaggtgatgtcagcccccacacggagacccagacccaaaagcattcatgctcaccactgccaatctgcatgctcccagtgagtcagctcagctccctcactgcataaagcgggggtggttctccccccaccctcacaggtggtataggtatttcagttgtttgaaaagaccagcaagtggaaatactgtacttgaatctgtaaaatagtggtgagtggaagcacagagttggaactctctaggcccacccacccagccccactattccacttagctcttgctcttgccctggtctgggctggtgctttgcagattgcatcagggagccacttaccccaattaaaactgtgagggtgggggagggaggaagtgggttggggtgtgttgggaatggtttagctaatgcaggtagtgctttttaaaaggcgggtagaaaactttcttctctttgtagatcaattaaaaacccttcttaaaattaacccctgggaaggtgtgtccgtgggctctcttttcttatgtgtacccaactctgcattttcccccagcccaccccccagtagaaaaaccatgctctcaatgcctttagaaatctctatggaaggtgaccaggtgttttttaaaagagctctcctcctgtgaaaaatgctaggtagtgacggagcctgcggcccctggggagagagaagaaagcctggctgagagttgaagaatcatcccagagagggtgttgaggttggctgcgcctccccgaggtccacacggcctgctggcagcagcaggcactaagacgggcatcttgtcagccgggcagatggtgttcacctgctcgggacatgctccctggtgctggggcccttggagttgctgggataataacagacagctgccagctctggaccgagatctgcgggtattcaaaggcttggaagtgtgcagggagaaggagcctgcccgggcttccctacatgctgtgtctcgccttttgttttgagatttgtgctccccccaccccttcccgcaccaacatccgagcaacaagagcattttaatagaggacagttctgttttggaaacgacaagaaagcgccttgtcgagtgtgacctggcctcttctttgtcctgccttcccccgctttgtgtgtgcctgcaatgggttttgttccaaggggcaaaggagttggacatggatttggtgtgttcctggggttttctttcttttcccttttttggcagcagctaaagcttttggttatttctgagtacagggcaaccggggagttagggatttttcaggaccaaactccagggtctttgagttaccaagtggtgtcaggaacaagtgagtggcacagaagccaactttctgactgcctggcgttgtctaagctcattgactgtgtgcaaaggacaaatgatttctcacggtgcagtctgccttgaatcctaaggggaatgtttccctagatatcagtccaaagcaaggctggctgtttgagaaccagcttcatttccctttgctgcgcagagaagggatgccgatgttgtcttggttatcctgttactgcagcttgactaaaaacttcactcgccaatgtcaacttgggctggcccgactcagtatcatcagctctcattaggctacttggaaaacttgtgtgttttttgggggtggctcagtttgaaatttataactggcctcagggcagggctcatgcctcagtccttcagtccaagaccagagggcaggtttgtcaagcaaatgagtggtgttaataagatgtgggaaggttacaaaacctgcttgataatcttaaactgcctgaaattggtgtgttccgtttgcttgtccgcatgggatgcaccagtgacagatgaccccattgagtctctaaagctgtatgcacatatgccccagttcatcagatgagcattatgattttgttgcagtgttaaggtagaccatctttttgtctcttgtccctgattattctaaatcagtgagatttttctgcagagattgcctttttcttaggtatttttttttttgcaggggaggtggggtcactgacttgaagctcaggtattcttaaagagtcctagttttcagagctaaccttggaaaaatctctgctttccttggtgatcaatggcttatcctattcttcttcttcttcttctttttttttgagactgagtctcgctctgtcacccaggctgaagtgcagtggtgcagtcttggcttactgcagcctctgccttctgggttcgagtgattctcctgcctcagcctcctgtgtgacagggattacaggtgtgcgccaccacgcccggctaattttttttttttttttttgagatggagtctcgctctgtcggccaggctggagtgcagtggcgcaatcttggctcactgcaagctccgcctcccgggttcacgccattctcctgcctcagcctcctaagtagctgagattacaggtacccgccaccgcgcctggctaattttttgtatttttagtagagacggggtttcaccatgttagccaggatggtctcgatctcctgacctcatgatccacccaccttggcctcccaaagtgctgggattacaggcatgagccaccgtgcccggccacgcccggctaatttttgtatttttagtagagacgggatttcaccatgttggccaggctggtctcaaactccagctgacctcaagtgatctgcctgcctctgcctcccaaagtgctggaactacagatgtcagcacccggcctcttctttgttattttaattattgaagagcatctctggtaaggggtttggaggttgtttcaggggaagttgtgctttaaaacatgacttaatggattctataagcactagggatgttacaggaaaggggtcccaatccagaccccaagagagggttcttggatctcgcacaagaaagaattcagggcgagttcacagtacaaagtaaaagcaagtttattaagaaagtaaaggaataaaagaatggttactctatagacagagcagccccgagggctgctgattgctcatttttatggttatttcttgatcatctgctaaataaggggtgggttattcatgcctcccctttttagaccatatagggtaacttgctgacgttgccattgcatttgtaaactgtcacggcgcaggtgggagtgtagcagtgaggacgaccagaggtcactcttgtcgccatcttggttttggtaggttttggccggcttctttactgcaacctattttatcagcaaagtctttatgacctgtattttgtgctgacctcctgtctcatcctgtgacttagaatgcagctcagtaggtttcagcctcatcttacccagctccttttcaagatggagttgctctggttcacacacccctgacggatatgaagatcaattaagacaaggtccctgccctcaaggagcccaagtctagtagagccagaggaagtgttaaacacagcatagtaagggagtgtagattctgtgctgggcccagaccagcattaagtcctggcccgggctaggggagacagggagaggttggttctccctggatcagggggtgcctgggagtggatgtaaaggttgatagagaaggtgacctggagctgttttgggagtagagagtagagcgggtgtttgctggaggaccatagtgtaagatgatgggaccatagtgggggcgtgaccatagtgggggtgtggccataactgggggcagctggttcctttagaggaggccctgggccctgggctctagggccggaaggcagaagaagtagagggagcacagtctgactgagtaatgggattttagggtgcccaggtagtagggccttggtgatgtgttgaggcctggccttcctcctggaggctgtgggcagggaacagctggaatgctgcttgagtcttcatagtttggcctttagaatctcaaggttgaaagtcaaggtaagcagtagttggagggtcctggtggaaagttgtagtaaaaagagcctcgtgttaggcgcatgccacctctgtccactacctcaggtgatcctgggcagtctagcctcagtttcctgctctgtgaagtgcttttttatttaaaaaaatttttttattgtggagatcaggtctcgctatgttgcccaggttcgtttcgaactcctggaattatacgtgtgtgccactaggcctggcctgtgaggtggtttttatatttatatcttggggttggtataaaggtagattaagagaggcaatcacacgaagcgctcagcacacagaaataccaaaaaatgtttagtattattatcttctttctaatgataataccagtggcagctcctaagaaatgcagggtcctggccctggtgtacccagctagtggctttcccactcagccaagggatgaccgaggtaagagttgaagatggcctcaggtgaggctgcagtgtggccgggctttttacttctgttgcacagtctggtttcagataacccagtctttgccagtaatgagcctggtgtcctggactgaaactgtactcctgtttggacttgtagctgtcccctgttctccaatggatgtgttttttgacacacggctgacaccagcctggggcttatcacaccaagctgtgcgttatcatattcctctcattctttcacttagcaagtgtgtaatatccactcactccttgggagggacccagtgcgttctgtgctgtgctgccggcaagactggatcctgggggataggggatagtaggggtgcttacagtccaggaggaggaataagaaatgaacccaggagctgccagtctggctagaagtgtgcaaggagttggggataggatgggagagggagaaccttcagctgggggaagtctgggaagggctaccgaggaatgtggtgtttcccctggaccctcaaagttagtagtacttttacaaatgaggactggggaagggtatcatggtagaagacaacatcataggaaacagcttgcagataagagtgactgggcttggggtgaaactgacagcagggagagacggctgctagatagaaagcaagataatagtgaccatctttgagccccaaatccaagcgagagtttctttccacctatggcgtgtcttttataataaatccaaactcagccggacgcagtggctcactcctgtaatcctagcactttgggaggccaaggtgggaggatcacatgagctcagaagtaccagcctgggcaacataatgagacctcgtctctctctctctctttttttttttttttttaaagaaaaataactaaatgatggcatccaaactcaagttccctggcttctccatagctcccaattgcccagtctggcaaaggaagccagtggcctggagcctgaaactttcttccattttgaaaatgttccctggctctgtgattgctcagttaggtgaactttctgctctcctaaactccaactccagccatagatggatctaagttggtatttcctcagctgtgatgtctcatcatagaaaatggtgctatttatcgaaaccctaccatgtgctggccggtgtgctaggcaggtgctgtgaaaagggaaaggaggcatttggaggaccagtgatattgggaagggcagggcctgggtctgtgctgagaaactcacagctactgaatgtctttattcctcgtcataggccctgggcagtaaagggtggtggtttccatcttacttagttaagaaagagcccagagttgctcagctagcgatggcaaagctgaagttagttacccctggcctggcctcccacgccacgcctcccgccaggcatacatggtctctgctcggcctttctctggttatggtaaatctcagctggcgtggaggacagcctcagccatgctggtggagtgcacatgctccactaagagccgctccgggtcccacgcatcctcgcttcctcatggtgtcggtgggggtggtggtggtggtcttccaggctctgagaatgtgtttctctgtttatctgtgattgccttctcagcagctaccctgcgtaggccaactcatctcagcagaggacagctgagaggctttttacaaggccctgggttgtttccactggtgaggcacctgtctgttctctgacagcatccacaaactcaaccctcagccttgcaccagcagtgttccttgtctagcaaaacattctggggtctggctccagtgaccccgctggactgtgctttgttcctcctctgcctgtggctgtccttttaccacctgctccccatgcagcctttgcaggaactggaccttctgccagagttatctgttcttccacactccagcctgctgtgtccttttcccaccatcacctgcaactccctactcagcctcacctggcttctcttccctggggagccccttcactcctgctgcgtgcagctagccctgtgcccagaagacgccctggtccttggaggagagcccccctccccacccccatccccccaagagctctttaattcaggaaattgaggcattgttgtcatgttctggaaggacactaggtgactggttccaggccactgttgtctcatggaggcatcattcccagctcccttttcagcatggtaaacagcctcgccgcctgttcacattgccaaagactctaggtcgaaggctgccctgctgtcctcatcctgtgtcgtttggttccaacatgcccgacccaagtgctccccagttgtgttcagaactcgtcatggctcccttgtcctgcacaggctcaggagtaccccctttgccacatcttggttcaagtttccccttgtctgaaacttgacaagggccaccttctccggtctcctgtcctctgtctccgtgctacccatcattcgttctgcaaacacgtggaggcagtgctgtgtggagcagcgctgtctggtagaaatgtactgagggccttgcaggttatttcagagctccttgtagccacataacaaagtaaaaagaaataggcgaaattagttacagtaatatactttaattatgaccaaatatattcaaaatagcactgtaagatgtcatcagtgtaaaaatcattaatgacatcttttatatttttttcccccaaactgcctttgcagtctggtacgtattttatgcttatggtgcgtctctgaaccgcccacatttcaagtacttggtagctgcttgtggctagggcttccatgcaggaccgtgtgagtgtaaagatttaagagcacgagatttgtagcatggtggacctgtttaatgcagtttcttgactgctgtttatgggcattgtggccttgggtgggtgacttccccctccgagcttatgtgcacctcatagagttgtcgtcaggattgaacgggatgagtgcaaggaagggctcagcatggaacccagtgcatagtgaggggaaatgcgggtgattgtttacattgaagtaatgagccagaggctggcttggtgccagggcctgccccctgccccctgggctgactgtctaggcggggttgataacaaactgcccgaacaagggcagcgaggcatcagaagtgtcaaaagggatcatctagcacagggactggtagcaggagcaccaaggaggagggagaggtagtcaggagaggctgcatggcagaggcgcccccaccccaagctcatctctgctctcttggcctccagagctttctgtggcagcaccagcaccccatggctcccgtgagctcaccctttgtgctgtgtaattagcgcggtgtgcctcgctcttgtctctaattgtgttgtacagcgtgtactttattatatcaggatataataccgctagcctggcagttatcttgttcactaattgtttcacgtgtctgtctcgtctgccccgctagatcacctgcttctcctaagcagcaggcaccatcttttgtgtcttttgtctcccccagtagggcctagcactgccagggcatggctgggtgtcaggagcctggcatcagggcctgggttcgagtcctgcattgaccgcactgacttggtctgcagctgcaaacaagtcatactccctcctgtcataaatgagcaggtggtttctgagcccccatgcagccttaacatcctctaatgtggtggagattcctccactggttgatatcacgtcagtgttctcgaagcggtgagttgttattcctttgctcaacaaatgtttattgagcgcccactaagtgtcagttactggggaggcaatgatggataagacaggtggtatttctgcccttagggtgcttaaaagctagagaaagaaacaaatattaaaggaataaacacatcaacattatgctaagatgagaccaacctggccaacatgatgaaaccccatctctactaaaaaatacaaaattagccaggtgtggtggtgtgtgcctgtaatcctagctacttgggaggctgaggcaggagaatcacttgaaccgggagatggaagttgcagtaatcacgccactgcattccagcctgggtgacagagtaaaactccttctcaggaaaaaaaaaaaaaaaattatgctcagagtcgtgagctacattcattgagcaggtattagaatacattttgcacagccttgcctgcactaactaagcaccgggggcagggggtaggtgctacagtgaggaagagaggttgtcctgttcctgtcctcctgcttacaggctggaggggaagacacacaaacagacacagaatgaaggtgtccttgcgcacatgggacgatggtatgagtgggagtggcaggcaccaggctggaaagaatgggggtacccccccacccccacccagccgccctctggagctgtaggagaatccagagaggattgcatagttcgtgcctccgtcttcctctttcccagggattggtgccatagggctggggtgtttgtgttcctcttgcctttgcacacataatttgggggaggcttgggtaggattctaaacccaaaccagatgaaggcagagcctgtgggtgcctgggagcaggggtggccccgggagcatgtggctgggtcaccctttgtaattgtagcactgtggtgaaggccccggaacctagggtggtggtggcggccgggcaggtgggtgggggatgcctggcttcccatctgctcagcctcgcttggctctgaatggattagttctgtttgggttggagcttactgttgtgtgtgtttttcatcccccttcccgtttgttcttctctccctggcctgagcgcctcttcagggttatgtgccttaggagccgcgagggtccccgcgtgggagggagagttgtgaagtggccattatccaaacaagaaagggagtaattggagtttgcattcttctgggcctctatggaaacagggatgtggctgggcatgggtagggggtgttgagacctcacaaaagtggggcacagtctgcagaaactcagggtacagcacagtccggatgagtgagcaccacctggtacagtgtgccccttaggttagcttgtgctgttgaaccaaagttggcgtgctgctgctgctggtcttcaacaccgctttattgttgatgagattctgaatgggcattaattccttcctgccaaatggtccaggtgaggcttctgttgcggaaaactgttggcagagaattaatattatgggcattgtgatgtggtaaaagatgagatgcaggtcttctcctaaccttgccgagtgacctctctgagccccagttttcccaagcaagtggggatgttgattcctgtcctgcagggttgttgaagggggaaatagataagctgtctaggagacccagtgccacctgtcagatgtgggaagcattcaggagatcctaagagtgtccatctcttaaatgccacaccaggggcacagagcatttgggatgttggaaatgcccgtggatatcagtggatttcctgatggggttcagggaacttcttcaaggtaacgcagatttgtgggaaaacaactttttgctttgcccttctctctgaaataaaaaaaatggggtccattgctctttttggagttctttcagtatccactgagagcccatccatggaatggacattttggagacagagtaggtgaaggcagagaaagcagctatggtcttggccctctcagagtctatgttctagcttgagaatcaaaatttcacacatgtggaacaattagagaaaaataacagatggtgtctgatcagatgtcaccgctctgtgaagccccaccctccggcagaaataatccttcctttctttgggatcctggagctgagtacaggcctgtgcggtactctgtgttgcactggtttgtcattggccatttgtgtcattaatgtgtgcaacagcaaatgttgaccgagtgtctccgtgtgccaggtaccattcttggtcgttctgcacatcctccccgagcacctgctctgggcccctgagctgaactgacatgatgatactctccactctctgggcttccaggcccaagcatgcatctcgtttctgctggcctcctgagaccccaggccagctcttcctgtgctgcctctagaactccctaagggccctctttcttggatatttggtcctcagtggccctctcctgggtttgatcttgctgtagggctgttgagttggagagggtctttgagggcttttggagtcaatgaagactctggccagccacgagtccagcactgctaaccttatcttctgtggcgctcccttaccctctctcggccttccattttcttgtctttaaatagctaggattggatggtatcactgattattgagttctggtattggtgactgagaaggaagactgtgataggagcattccagtgtctgggaagtctgtacaaatgcatagaagcttaaaaagacatgcagtgttcagggaaggaggaattatgtcggtggagctgggaatgagggttggttcaggccaggtcctgaaggcctcggctgagctggtgtgtggcaaggagcagaaaatcctcaggttgtgagcctgccgtgtgagcgatctgggtttgatctgtttggagaaagaagtagattaaggctaataaactaatgaggggcctgatgtagtggtccaggcctcatgtccgtgtctagatggcagatggagaaggcagacactggggtggttgtgtggaacctgagaaagtgggccggcctgctgagagctggcatgatttgggggattgcccatagcccctttgactctcattttcctaataatttgtttccctgtgcccacaagggtgggcttgggggtgattgtgaatagcctagatgtgtgtaatgcattaaaaaaaaaaaagccacctctatccaaattatcgacagcgtggtggagtaagagggaccctggccaggttctgggcatgtctgtcttctgctttgggccttagtttcccctttagtgaaaatggcagtgggtaggggaacatcggaccagtgcctgaggtgtgctagcacgcccccgtgactgccgcctttgtttccaggagtttgaggatcaagcatgcagggcagggtggctccattcttggcaagtggagcggaaaataccagtgtcttgcagcaagtcccggagggtgtgggatgggtgtgtgtgtgtacttggctaggcgtgcccccttaacatctcccttggacagggcatctatgctagcctggcctgcaacctgcacagagtcctgtctcttctaaaatattgtcttccctattaaatattaataacaaccaagcacgaaccctcagtgggactgaacccccagcacaccctgggtggctgttccttgtgagtgtttgtatctccatgcctatcctcagctcagcgtggcaccttgaacagagctcgtgtgtgtgtgtgtgtgtgtgtgtgtgtgttttgtttttgttactttggagcctctgcagaatttctcaccactgccaagttatttccttgggatatatttagataaagcgagatgatggagaagtgggcgacgcgtatttgctcagggctgtttgcacacgctgaccatggtgtttttgaagctgacgtccaggagctggatcggagaagagccgcagtgtagctccttgtggaggtggaaggggtcagggagagagtgagtggcaagacaagtcctctcttctagagatggaaagcaggtgtttgggccccacaccacacccctctgctgcctcctttccatctgaatgaagtagagctctaaagctacgaaaagaagttggagaggtaattgtgagtcccacgctctgcctagaagggcagctttctcctggagccgggtggcctctggcactgcacactgataagataggaaatcagattactctgtggtttgtatttactgaaaatcctggggacagcactggctccccagagtggtgggagtaggcaggtctggtaccacacccttgctgggactgcttcgctgaacttccttcctgctgccccctcgtcagtgtgcccctcttcgtgagtctgggttcgtgccttccgtgtgaccgtacggcatggtagtgcagagaggggtccgagctaggcctccccagacctaatcagcttacagtggggcagggcagcgctcttctgtgattcaattcagagcctcggtctgcttgatggaggcagctttaatgagattagaaagcttaaccaagaggccaattaaatctgggcccatacctgtttgggcagctgttgaagccctgacctgcacccggaggcttcctgcaggcctcctaggagactggttggggagcatgagggggcagaagaggcctgcgcatctggcccagccatccccagaacctgggatctgtttcccctgctggggtcagggtagagacagaactgaggagggatctgatggaacatctggtccaggagctcccagaagctggatccctgccccctcaggaagacaggcagcttagttgttgcaaagctcactacatgattttgatgtgcaaccaggcttggaaaccaggaagtgaatccattccctttgttttatgggtacagggaagggccttctgggggcagccagccaagcctgactcctcacccagtgctcttgtgtggcatctttgttcccagctcctttgattatccagggtgatggggatggtggcgttgcccttctgttctcagacagttttttgtttgttttttgagacaaagtctcactctgtctcccaggctggagtgcagtggcatgatctcggctcactgcaacctctgcctcccaagttcaagcgattctcctgcctcagcttcccaaggagctgagattacaggcaggcaccaccacgcccggctaatttttgtatttttagtagagaggggggtttcaccatgttggccaggctggtctcgaattcctgacctcaagtgatccgcccgccttggcctcccaaagtgccgggattacaggcgtgagccaccacacccagccttgagacagtttttatgtctgtttcttcatttgtgcttcatgccactgttgtgaggtaggccaggcagggaatggtgacttctctttttacagataggcaaattcaggttggactcctgtcccaaattggtaccagacccaaaggacctgattcagggttaaggtctttcccttccattacttaaatcttccttctggttcccactggaggtggtggtgggtggtatgtgagtttgtgatgtctggatccagccaggaagaaaatcccagcatccattaactgtgaccttgtgcaagacccttaactgttcgtgtcaccagcaagataggtcggatataaaataaatgagtggattcactcacctcaggagattgttgggaggattaagtgagatcagcctcctttggtgcctacatagagtcttaggatgtgggggcttattattgttcctgggacagagagccaggaggctttgggggcagggatggcaaggctctgggagtctggtctgccggagagtgatacccagctggtccccaggggacaggccacccttggggaaaacaggtagagagggtttagaatgaatacccatttggcaagtatttctggagcacctgatggatgcgtgccaggcactgttccaggggatgcagcagaaacttgaccctcacaagtcgtgtgaggcaggcagtgcttattgtcctcgttttctagatgacacagccaaggcacagacatcttgggaaaaccggattccagacctttgccacccttgacgctggtgtatggaccggaggccacatctgtccagcctggctgtgggactccttcctgtactatgttgtagattcaaagttaccgaaggcccaaatttaaattaataattcctgtcttggccagagaggaccatggcaatggccttaaatggagttagacaaaaatagaagaaaaacagactgccttaggccagatttgcagcaaagtagggaccttgtcaagaatggtcctgctatctctgacttgcaagtttcaggctaggaacggaaccagcattcacattcagatctctccagaggttttcatgtttgtctcttccaacagttgtttgaggagaagagagacatgaaaacctttgggagttaaggctgctttttgcaccttttgacatttgggcttaccaaaatctggtctgttccttaaagttacatctttataaagcagacaaataaggaagaagggagaaatgtcccagaagaaccaggcctagctttgtccagaaagctcctttgcagtctccaatcatttgatgtttattgatagtaggcattacaaatatttggattccacttttttggaaccaacagtcctgcagggagataacctttgtctatataataagaccaggtagaaaaatgctggaagagtcaaggtagagtctcatataggattggagggtgaataaatcatcctgccttgtgtccagggtagcctaagggatatgttagaatggcagaaactagcagggaggtgggcattccagatggaggggaggagggcatgtgcaaaggctggggaccagctagtgtcccctgtggctgaagcttagagtacgagaaaagggggaggttggaatgggaggcagagaagaaaggctgagatgagatcacagccctttcattatctccttgtttttttaaaatctcttgtcaacccagagattgtcctatattacagggtgcagctcaagtcagaggtgaattgcctgcctctctgaattggtcagggagcccaagagctggagctcctgccctaaatccagtgctgtgtcggcttggttaggaggccattggtattgcatgctccgtgggatgcctcatgaaagggacacgggtggaaactggtaacttctagtattgagttccagctcatgaacctacttgggactttagtacccacttggactaggaagcagggggcatttgagctgggcattgatggataactgggagttctctaggtagatacatggaccgggatggagggagtggtgagggacctgagacttgatctgttaggggctggagccattcccaggacgtgatcagcacaggggtggggcagagtagggatgcggccggggggccctagtgagctgcagggatcctggtctctctgctctccccttctctctgcccctctcaagtttcatttcatgtcaagtgagggactgaggaagggacggggaggggaggctgggggtgatggattcctcccgcatgagctcagggcttgctctgtggtttgtctctgattgcaaaaaccatgtctgctataaatctgtggcttggagggtctagctgtaagggacagtccctagtttggtggaggagcctctgcttgtgggatgcattttcagggaagtggaggaaggtatcgcagggtggtaccctacaccctgctgttctcagcttttgtccaagcccctttttcctctgctgtccttgggccccacaagtggtgggcagccaaagcctatgggaaagtggctccctgggccagtggagcagacactcgtcttcagagaggccagggaatccaacctgtctgagaagaaatagcaggcttcatcttggagatggaagggaggctggccgagaggactgggagaggccactaggtctcagtaacccacagaggccacttgaaccccttcctgcacccagctcactgggctggtcttgtcttcttccactgtgggaatgagaacagggccccagctctgtgaggccaccccactccctctcattgcttttgtccttccttggagctacaaatgctttccccagacactagctgaagttgtctttcccattgtcttgggagggggtgatacaagggtgatttccattttaatgaccaatggatctgggagatgtggcctgcccaagttgtttgtgagggctttacgggcagaaggaacagtgtgtggcagggtgtgtgttttgtttgttgttatttggaggggaggggcgagttgttaggatgtagccaaatggtaagttaatggaaggtgatggagatagctagtcttagagtttgaccttttagatttggtgactactcttgaaaagcaggatttcttttttcttttctttctttctttctttctttttttttttttttttttttttttgagatggagtctcactctgtcaccccagctggagtgcagtggcgtgatctcggctcactgctgcaacctccgcctcctgggttcaagggattctcccacttcagcctcccgagtagctgggattacaggcgcccaccaccacgcctggctaattttttttgtatttttagtagagatggggtttcaccatgttggtcagggtggtctcaaactcctgacctcaggtaatccacccgcctcagcctcccagagtgctgggattacaggcgagagccaccatgcctggccgaaaagcaggatttctgcaagaattttatttatccaaaaaatatttactgagccagcatcttccctgtgctgtgcacaccattcctgctcccatccctggaagatagctggctaatttaataaggaattaacagtcaggtgtgacaaacactgtgctgagaaacacataaatgacgaaagggtatcacccaggcctgagtagagaggagaagagtgttgcagagagaggaacctgcctgtgcagagggtggttgctgtattcatcaaggaaatatgtgtgaaagaaaggcctttgtaagctggtactaggtactaaatatgtgtaagtaataataggttattcttctctgaatgggaccccaataaatgttttgtaaagaccttcctttgtgttttcaataccatatcgatgggtggcatgactaggggatggaccacctctatgagaagtcccgtgtttgtttcagaagctgagtttgggtcagaattctcagtggatgaactcccatgtcccttcagaagcctctgaccagcccgcgtgcctccgatcctcccaggccccacccccttagcagatctctcaccgggatcctaagcaatgtgtgtgttcttgggtgctctggccttcttcttggtgggtgcaaacaagaaagccctgctgtgtgcacctggtagatgcccaacaaataatctgtagtgagctccgaagtggcagccccgccttgccctttagctttgtggctcccaccagactttagcaggccacagactggggtcgcaggctggggctgtgtcttggtcagaagcaggttggttcttggtgggtacctgaaccatctcttcatcccctctgtattacttttggagcaaaccatccagtcaccatcctccaagagtctcctctgaaagcatgccaggctctgttctagaaggccacttggcagggtagggatgtgatgcctcgtggaggggctgataactgtgatgccagaatctgagttatctagaatggctgtttttggttcctaggggtatcaggtaccagagatattacccttcctgccccagagacagacacatgtacatacacacacacggaattcatgtcctggtgaattctcctgttggaggcattagcattcccttgctttggcaccactccctctcgtttgttcagagccctgagggctgggattggggtgggatgagggtcaccgctgtctggtctgagtgcgacaaaccttcctggacctgcgccctggagtctggggtttgaagggcagcaggggtcctcagagggcttgtgcagggcctcgctcacaacacaggagtgttcttgggggaactgacatgaggcttcacagtggccagggcagctggggccgtagaggacatggcctggactctcatcccttcctgtagcttgggggctcacccaccctgtcatttgtacatgaggcatctggggctctgagaagggaaggggttgccttgcttttggttacctagctagtttctgtcagggttttcgttaaggccaagctatagtcctctcttgtgtcagtctgaagaattcggtagaggggaattaattgtggatgttgaagtcaggtagacctgggtttgaatcccaggactgccatttcctggcatgcaccaactgttgcattcctcccactcccttaggcagtgcaggggagaaagagggagggcctagctggagcttgtcacctccaggggagtagagtcttggctgaagggtctgtccttggcttcctagagcactggagggcccagctgcaggcccagccattgctactcagcacccacctagtgggtaagggggtcagtgtgggcctctctcccttccttctcagctgtatctagcaggtgcccgagagcagccttccaggggctccagacaaggttccccattggcagcactggtgcctgagcaggatgcgggctcgcacctggatttcaggcaggagaaccatctatgctattccttgcctgacagctgggcgtggagggctgcctgaatggacagcagcagacactcgaataagtgcccagcgcttcgtagtgttgttgggtccaatttcctttgctttgtgacctacatcattctttatttgctaaaccctctgagcaggcagcagtaataaatcaattaatgactctgatgaatcgtttaatggctgacaaaataacactaaagccaacagcttgcatctctccagcagtaccaaaggacgctggttgactcagagtgggggacgaaacagagactgttagctaaattagcgcaattagtgcatgctttaaaggcttagacggcatctgctcagcgccgaacccgtgtggcaactgtgcgctggggtggctgtgcagaccacggtggtccactgctcactgccttccctcctggccaaggagctcaagggctcccgactgttcatttacacagaagaggcagtgttgggtttgaattatgcgccccttccctggcattgggggacccgggtgaacttgtcagactgtgtacattttgtcctgtcacagcagaggaggtgagggaaagtgacttggtccccactaaatttgatgctcactgaggagagtgtgggctcccatccttgaaagatgttctgagggccctgcctttaatgatttattttaaacttaaaaaaaaaaagtttctagaagcgggtggttttctgttctctgcacacctcggtcctggcaggattaagttgtcattggaactgagcgtgtgcgcgggtccacgccagggaattttccactttgcagaagcaactgccagtgttcttgttaaggagctgtcactggcctactatgacatgtttgtggttgtaagtagctcctttaagacagtgggaaatgtgtgtgtgtgcgtgtgtgtgtgttttgctaatggtgtaaactagggcctgaagctcatttctctttaagaagaaaatcaacgttgtacaaataccgagctgttgatccactctgcagtgttcatctaggggggatcctctagcccttaatcttccttgtcttgcatgcacatgcctgggacctgcgtcctgtgccatggggcccagatgggaggtatctgcctgtggaggagggtgcactggctgggatccactccctcaccaggtactaattattaaatacatggggctccacctcttaccaaacagtgacctttgatccagtccccagaagaagccgggtgcttcctgggatgaatgggcagggcccggcagtatggtggcctcagacttcccagcccagggaattcacttcctcctaaggtggccactaagaagagagaggccccttctcagaagaccaagtctttccacagctttcagcccctttttgtctccccatccccagcctgctgtggtcagggaatcttaggacgtcagcacgtggtcctttacctggagctgtgtctctggctctgggccgccggttgctgaacccgtaccttggctgagtctggctgggcaccttacctaagggtcatgtttaagttccctatgccccccacagagggtagggggctcccttccttagcaaatgatgaggggtgcagaaggtaaagtgaggtgcctgaggacttggcccctggtgaatggaaggactgggccctgacctgtttccaggtgaccacttttaagtgtcgattctgaaatttgtatcagagaagctgaggtgtggccaagagctggggctgtggttttagcagatctgggcttgacttctggttctgcccatttccagccatgtgaccttggacaagtgcctttactcctcagagcctctgagttctggtagtgactgtggattgttggaaggatggagggagagagactggatgagccacaccatgagctgggtcacaagggaccgcctggggacagtgagccttctctgactaggtggctggctcctcgcctgtgggggagcccccctatcctgggggagggaaagcgaacaagccccacacccaccccctaccctggagatggtgcagggggcgggtggcgtcctagagggatttgctctctaaggaaaggctgtcaggaggccctgtgcccagggagggttaaaatgacagcataatctctcacccctgtatcacctcctgcatcctcgagtcctgccgtcctttaaggccccagctcaagtaccatctcttccacaaagcctccctgatccccctaatccccgctcacagcgcctgcccagagcaccttgcctgtccctcagttctctgtcaccacaactccttgcatcctcctgacctgcagggcagacctgcaacctgtcatctgctctggtgagcacagcgcagtctgggtggccccagaagcgagtgtttgctgatgcatctgatgtgtaaaaagcactaggaacctttttacagccccccaccccaccccccaccttgtttctcctcctctcagggtaatttgccagttagatccaacagactcttcagtgggatcttgcattccttgacacacatgtgtgtgcagacacacacatacacaccccttggtgaatgccaactcattgaagtatttgtcagaaagagcagagctagaaggtcagcctacttggggaagcacaaaaacatatagacagtctcaaacacgggaatggattgtgcttctctcatgtgtttaatgaagtgccggctatttcttttcataagagtcaaagcacacagaactcttcctgggaactacaggggtgagtgggacattactgttttttttttttgtttttttgttttttttttttttttggagacagagtctagctctgtcgcccaggctggagtgcagtggcacgatctcggctcactgcaagctccacctcccgggttcacgcgagtctcctgcctcagcctcctgagtagctggcactacaggcacccgccaccacacccagctgattttttttggtatttttagtagagacttggtttcacgtgttagccaggatggtctcgatctcctgaccttgtgatccgcccaccttggcctcccagagtggactgtggttttgttttttgaacccaagataaaaggtggaggcacagagggactaatgttagagccacttagctgcctgaccttgagatagtacagctctctgtgcctcagtttccttaccaggaaaacagaaatgacatcttcccagcgatgttggggaataaatactaccctccccccccccacccctgctgatgtatgggatcaaaatgaaaaggcaggcacttctccagcccctcttgcattccagggtcatacccaggtggcagacatgagctgggacttagtaaaataagctcaggtatcaagaccaccctcatttgggtctgatggcctggccctgacaggttgaggcttttgttgtctatacgtggcccttttcaggtcgcttgctgaagagctccttggacatccacagtgtcactggagcagcaggacatcagctgccttgtgtggagtccagggcccggggcaggaaggcctgatcagatcacacagtaggtggtttgccgccagagctggaatcctgatcctgggaccctcagtgcaggactcttttgtcttaataatccccaggcccaggcggtggtgggtcctatggcagtccttttttaatatggtttgtgccatgtctccgctgggagcgaccccaaattatcacagcccgcccccttctgaggcagccaagaagctttttgtagcttggggcatctactgttggacccagggccgtccattggtgccgggagacacatccatccctcctcccacacgatggccccctgactatttgaaggcagggatcttgtgtcactcctgtgtgtcatccaaacctatttttaacgtcagctggttctgcctcttcacgtagcaacagctctgttttctctaaactgcacaattagagcccctgttctccaaaactgattctgttctgtggtctgcatatgaaaccaggaatcctcttcctgtccccttcccttctttgaaccccagttctgtctgtcttggcctttccatctgggtgatgacattcccccggtcgcttccattcctgatttatatctttagtttgttgttgctgctgaaattccctctgggaaacctggccccagagggacccgggttactccatagtttgcacagaagcccctgtcttgctgaaaccagtgccagcatccctccctccctccttccccaggccaccagacaggcgtcacttggaggcttcctgtctcacttgccctctgtatgtagtcatcacaggagtgccccaagctcccttgagtgacctccatttcccagctttgagcacatggctccaccctcagcacacacctcccaccccctggtgttttgggccctgggccacgcagcctgtgttgagtttcagtcaaggaagtcgtctgcacatgcggttctgcatgtggcccccaagctgctgcacgccaaggcctgagtattagggcggggcaaggaggggaggggatttgcagaacaaagtaccattttgcagccttgtaaatcagtcaggaggggttggccgacctggcaggagtcccacatttccctctgagcatttgtttttattcagttttccaggagcttcctgtgcctagaactaattttaaagagagggttggagcgggggtctcaggctagtttgtgagtgaggatagctggggttcttgaaatgaggccagaagatagtatcttgcagggaatgcccctggaccattgcttcttgaaggaaaagcatcaacactgttgcctactctgagatgcttctctctcagggtgggatgagaggcctctgggaatgtggggactcgtcaagtccacttgctcctggaatttggggtactctggtggtattgggatttgttgagtgagcatgaaaggtccctatgcccggcacagggtgaggtggggcagtagatgtccccccgctccgccattgcccagagcagaaagttccattccttagcctggcttccaaggcgctttctcttggaagcaccgctctgaggccccctgtttgaaccctgcttctccaccctggaggttagagggggaatatccatctcctagggtgggactggtggtgaggttttcaggtgtccttacggagtgggattgctgaggatctctggttgcagtggcatgtgtctgtcccgttggagcatggatagggcagaggcaggggtagtccctgagccccatggctgtgtacccatcctgggatcatcaagaaaccctgctctttagagatggagctgtgggatcagtcctcttcacaagtctccctggctgtgaacggcaaacttcaggcagtgctctgggaaagcacttcgggcttttcaagttgactgtaggtttagaggaggcacctggctggaatgggcctcatcaccctgtttaaggcctgtttgctgtttagaaaagaattttaaattagctttatttgttgtttttgttgttgttttttaaagtgcatgttaccaaactgcatgggtggtttgagttggctttcttgagtccaaaaagtggataagcattggtgaggaaggaaggcctgggcggttagaacccaatgtcacccactgttatctgtgggctcagataacaggtctctcggtagtgtttaatctttgatcacaaaatggcctataatgaacagagaagagttaaaacccaggtgccctggaaagagggttgctgtcctgttcatggaagagctgctgtttccagacctagctccccttggtgtgtagacttagctggggagagcagcttggaagaagagccttagtggtcatctcctctaacaccatcattggacacatggggaaactgagtcccagaacgagaaaggggcctgtccgtgggctcccagctaggagatctctagcttctgaatccagtgttcttttctctcttcttccgtgggggacttctagcccatgcacccactgcagccctggcatgctgtaggcctcagtgaataatgggggttttcaggggttttggttttgtgttgttagggaaaactcatgagacgctttgctgagcgccttaatggagctccagctcaaagttggaaaccacagagggaggccgattcctagcagtctggaaaggcctggctctggacggtcagctttgagcaggtctctgaattatacacgtagtaatcatgattgggccactgcattccagcctggggaccaggtctctaattataataataataattttaaagttttttttttaaaaagtataacttacccgtattctagatcctgctaatacacctgctgtatgcctcacgttgtgctgggtctcagagacaggagaaacagcccctgctgccgttgagctgcaggagggttggtgcagggattcagcgtaatgttcatagatgtggttggggggagggtaccttggtttagattttgtgagcaagttatttctgagcctttcccaacctcttaactcttttgttgccctataccactggttgctgcttttcgttttcttcttcacacttttctgccctttttaaagttttttgttatgagcacatgtttgcttcataatcaaagaagaacagcaataactatcaaaattcaaggcacaaatttaagcactgcaggacgacttagttttgctgcttgagaagctttaaatgataaaggcgtctcctcagcttcctgccccttagtcaatgctaacatggtcttggttttttgtcctccttcattggagaacagcaaaactccatcttccaccccacatttcagagaattacaccgtgcatttactagaaccatggtgaccctggccgttgcattcaaagaactgtggaccatccactaccttcagttcctagaaccattgactcactcctgatctcataggaaaacatcttagagtgaagagcctcataaataaggcgacaaagtacttgtaggttcaagttttcatttaattttttttttaggccagacacgatggttcacacctgtaatgctagcacttttgggggctgaggtggcaggattgcttgagggcaggagttcaagaccagcctgggcaacatagtgagacctaatctctacaaaaaattttaaaaattagctgggtatggtggtgtgcacatgtattcccagctacctgagaagctgaggcaggaggatcccttgagcctaggagtttggggccatagtaagcaatgatcgggccactgcactccagcctggggactaggtctctaattataataataataattttaattttttttttaaattataacttacccttagtctagatcctcaatatataaaaaatcaaatacccaaatagcaaaggacatgaatgatttgccataaaattagatctacaagtggccaatgcaaaccatttcaaaaggtaatgacctaagaggtaactcagaataccgaataccaaagggatactaactgccacattagcagacactgagatttaatgcctgttatttcgttggttaataggcggggggtggtggctcatgcctgtaattccagcactttgggaagctgaggtgggaggatcacatgaagccagcctgggcaacatagtaagaccctgtgtcttaaaaaaaaaaaaaaaaaaaaaaaaaagtggttaaataatggtacataagaagaatgaaattgttaaatgtaacaccagtctctgaaagaacctgaagaaaaatgtagatggatgtttaccttaccccatttttaaaaaaagttttttgctcttgctgctgaggagtaattgttggctgttaatcacaaaattgccattttcacagaaccactgaccacagaaaaacagtaatgcagccagcagtaatgcagctaatggataagctggcgattccctcacgaggccccatctcagatagtgccgggcaggggcaaggcaggggcctgtgacctcagacctgggggatggggagatctacaatcctaatttttggagatgcttgaaacttgtacacattacaggatggttagcaggatagctcttgcagagagggctgtttttctgtaggcagaatcattttgaaaagtaacgtgcggcttgcccattctcttcatctggggtctgctcaacacccactgtattccctgtatttctttgttgctagattcacagagctgtcccagcttacaaaacacagcccattctgtcactttatcccccacaaccctggtgaggatgtgggacaacagctatctcattttttacaggaagcaaattcagaaagtccgagtggcttgcccacagtcatcccacttagtagtagaggtgacagtgctgaaaaccaggtgcatttgttcccaggtctgttcgtttattttgttgcatgcagtatattagtgagatttgcacattacctcatttcctttcatcaaagttggaagttagagattctggttccttttttttttttttttatgagatggggagttttgcttttgtcatccaggctggagtgcagtggtgcaatcttggctcactgcaacctctgcctcctgagttcaagtgaattctcctgcctcagcctcccgagtagctgggattgcaggcgcccaccaccacatccagctaatttttgtatttttagttgagatggggttttgccattttggccaggctggtctcaaactcctgacctcaggtgatccgcccaccttggcctcccaaagtgtcggggttacaggagtgagccaccacgcccagcctctggttcctattttactgccaatgaaaggaaagagagtgacttcttgaaggtggtgatgggaggctgtgtttctaagaggaaaaaaggcgttctgtttcctgaccccaaggggctcattcctctttcagagaatcagaaccctgggagatgattgatgaccaagtttcactttctcagtcatggtggggtttggggaccaccaaggttggaggtgggcttcctgtagaaggagcccctgaaggcctagaatcagtgggaaggagcagggcccggttccaggtaggactgtcagacctgtggcttcctcagggctggggcccagatgtctcagcctcgccccgccccgcctgtgtgagcacggggccaggcacagacgcgccgaccacctgaataggttgcacacagatcctttggaaggaggccaggctggggagagcaatgtctgctcacccctgggaggcatttgttgaggcagatataccaggcaaatgccagaacagcagtgtttaaagagaaaaggaatgacggtccccccacttcgcgaggcccctctctctcatgagacacctaggaccctgcagggccaagaacacgctctgccctccgtcaccctctccagcagtgtttcccagttggtctgttcatttattcgttgagtcatggatatttattgatcttttgctctatatgacatgccagccacttgcagagggcacagaaatttataaatcactggcctgccaagagcttctcagagtagctgggcagacacggcccagggccatataatgccaggagcagcacattggccatgcacccctgctctgcaccgcaggaagtacctttggcactttgtctcaggctgtccttgcaacctccctgaatggtggacattgtccccccatttttttattattattattattattattattattatttgagatagggctgaaccttttgggctcaagcgatcctctgacctcaacctcccgagtaagtggaactacaggcgtatgccactgcacccagctaattttttattttttgtagggacggggtctccctatgttgcccgcgccggtctcgaactcctgggctcaagcgattctccagcctcaacctcccaaagtgctgggattttagttgtgagccaccacatccggccctcccattttagagatgaggaaaaagagcctcggaattcgttgcttgctcagtgggggccggacctgggaattgagtccaggtctgagtgtataagccctacttgtgtcctgtcagtgggaacatgacacttccctgggacgctaggagggctttaagtagaaagtggcctgtgaggaaggtccacggggaatgtggacggacagggagagccaagtccaggggtcagaactctgtgtctctggttgtgggtttggccactaactctctgccttgttgtctccacagagtgcagcagctgccccgagccccgtgcttggcaacattccccccaacgatgggatgccgggaggccccatcccgccaggtttctttcaggtacgtgcggggcccgtgggtcttgtgctccaccttgtattccaggccgaggccctgggcaggtgggagggcgggagagaagtaagtagctcagtttgccatggtctaaatacagttgctttatgctggttcaaatccttcccttcccatccctttcaacagtccttctaaaagctgagagggagaaaaagatgggaaagcagaaacctcctgcattgcctgcacttctgctggagtttgctttcttcatgccagcttcgtaggcgcgacacagtctgcccctggccagggaggtggtgggggctacttccaggccactgtggagctttcttttaacaaaaggctttaaaaaaaatcagtaaattgttctttgtttctgttttgttgctgctgcttttgtcattgtttactttacttgtccaaatgacaaaccttaggcgtaatcttaaaaaaacacaaaaacccaccatcctggcaggtctcagaatcctttccctctggttaaccacttgattttttccgagtgtgatcacagacagcatcccacaagcatctgtgcccgtgctctgcccgccacaggcaggaacagatcccacgtgggtcgagagtctggccttctccaagagacaccttgtttggctttttctggggtgtgtgaaattgggctttctgttttgccaggttgggcgcggctgccaccctctctgcgccgcctcctctgtctctaccttctcctcggcggttcatgtgatttaagccaacttgagactggggaatgccatcttagagaggtacagcgtgcagggctgtaaggaacttttatgatgacactctcgatcataacatctctcgttctttcaagcctgtcggcagctgagtttgagaatccgcccgagttctccacaccttttgaaagattggcactcccagataagaacatggaaagagctgttgtgtggaaaaggaggcagaaatttcctctgtacagccctagaattcagaactaggaccagtgaggcaaagtccaaggacacttttgcttggtataggccagaatttagcacctgtgctcacaccacatcaaggcagggggctctctggccctagagatgtctaagcaaagacctgacaaacgtctcctagggatgttaaaggggtttccctctaggtgagagatgatctggaagatgattctagttggcaagattttgtatttcggttggtgttaactcctgagagaagagggctgggacatgctgctcaccagctaagaaggacggcagtgaaattcaggtgttccccaaaaacagaagtggtaggtcacatgatggtggtgggaggagagagagggatgcaggatggccatccggggcattggatggccacatgtggatctgtatgcattcccagaacactgccaaaactggagccttgtccaaggggtggagatgagtgtagccccagaaataggtgtgtgagctccaggttggactggaccaggcattgctagggtctcagcttggggcaaggctgcagacatattaaagatgggttgagagttagaccttaaaatactggaaactcatggacccaagaaaggcagtagccagaggggctgctgtccttctcccagggaggaaatccaagaggccagcgtgtgagaggttcatcctcaccaaggcaggcatcttcctggctgctgcagatggcgccctgcacccatcagcgggcctttcccactggcgttctgtccagttgggaattctttctaggctcacatgccatggatgttcttgagacagtgcagatgtggcttccgtgtctggtggacccaccgaggtaccatgcttcatctgtgtgcctcctgattgaggctgcttgccggcatctgggtgtccggtgcagattagaccactgtggtagaaagaggtagacaatacctagttgtatgttttaaaaataggccattggcttctattttggcctgggtctaggacaaggctcaggtctgcctgatctgtgggcagctcccaacttcctgctttggtataatcgtccatggctaaggcctaattccagacatacttcttgggccctcccctgtgacgtttggggtgtgtggtcagaaagccaagactgattcctgtccttatttagccattactagccaccatcaaacagaggtaacttttggaccttcttgacttgaggtcacctctgttttcccaggcacggcgagccatcaagagctgacgtggtcatccagtagacagcagagagcaatgtcttggcctctctgcttcctgggtgacgttgggtgattcctttctctcacttcccggcatcatttccccatcagtcagatgcagggggatgggctaggccaggtacctggcctgatccttcctggccatgatgctgaaccgctcaggctgggacactgccaaggggaaagggtatctctctggaaggaggtactggctgcccatttccggagtaggcctgcttacaacaggaatattagctattgattgctggccctgcccttcactagtattgcagccggccactctgatattagaagggaaatagagatggtatcgaggattttatctgttaccaacaattgcactccttcccctgcttggccaaggcctgggtaggaagctctgctgcagaaaggctttgcaccagggagtcggcttgggatggctgagccagctatggccagaccctggcctagggtggccagcccagttttcaggtcaggacttcacccctagcctggtcctaaatgtagaagccccaggcctccagggttgggtgggagagagcagctgcccacctccatcccagcccctcggtaagcaacacagggccttgcttctgcaggcctctgactgccaggcttcagctcctggggtcagaagttttggccacccacaatgagggttggccatcagctttctcttcttccacgtccaggtttccaaggcgggcagtacctgtctggtcccgtggcatgagatgtctctggtagcaagttaagggctggcagggagatggcttggaaactgacctgaccacacctcacctttaaaaaaaaaaaaagccctaatattggcatccccagcacctggcatatactaaggacctagtaaatgtttgaactgagtttatttgtattgctcacattacagaacaggagcccaggcagccccaaagcactagatccaacattctgatcagggagggcctaacaggaagccagcttgggagttcaggagtggtgttctggtgttttgcagcagggaaggacagagaggacttggccgcatacttgctgagtgaccttgggcaagttgctccccatctctggaccctagttttctcaccagtagatggagcaggctggaccaggtggtctctgagggcccttccaactttgattttctgctttggatccagatggattttacataatcaagcagtggcattttttttttccacgcagcttagctcggttgggctgcacatctggcaaacccagcttggctttggccagcctcactgatctgggtgggttccctagttcccccttaagggggacactgtccagtaagaatttctaagttccttggccctaaggtggtcctaaggagggcactgtccagtaaggatttctaagtccaaaacgggactcacaagagggcaggggtcatagagaactgagcattgggtacaggctgtttttcttcttgttttgtttttaaattccaatagttgttttcagttacatagtgtttttaaacatgcaacttactttcattttcatcacagtgtttctgcagagaaggcatgcagattgggaaagtgagactcagaaaggtgaatgacttgccccaagttaaccaggggctgtaatcagagtctaaacccagctttcctggttcctcatggggtgctcttccacaaacactccaaagtccaaatgtggatacacatctgattggatggcggaagcagggagagtagagaattagataaaaggagggagagaccgaaaggagatagagaaaccataactcttatctaaagaagtagcaaagaagtccccattcaaatgccagctctgcttgatgtgtggtggctgctgagaacaccgtgagaatgattctgaagctgtgtgtccaggctcaacagatagtgactggcaatgtctaccatgaacgtgaatgtgtcggtggtggtacatatcctctttgccatccctgatgtagtccaagcttctcatttatagatggggagatgaagtcacagaaggagaaaggactgtggttatgactgtcattgaccgtctctgatatgcaaggcatggggcttggttccaggctcgaactgaatcaaccatagtctgcccacaggagcagccagcctagcagagagactgacaggtaacccatcccctgtggcaggacacaggagaggcctgcctgccaagctgagaaatcaggagggcattcctggaggcagtgcagccctggctgagatggtgtctagaatgaggtggttgacaggtgctcagcgggagatgaggctggagaggttgccgggcaattgttgaaggaccttgttgagtgtgggcttgatccagtgggcagtgggaagccagggcagcactctgggctggataatgtcttggccagatctgtgttccacaacagttactctgcagttgttccagtggcttcgtggagacggggacttgagcactgtggccaatgctcagaaagtagctgacacctttttttttttttttttttttttttttttgagacagagtctcactctgtcacccaggctggagggcagtggcgatctcggctcactgcaacctccgcctcccgggttcaagtgattctcctgccaaagcctcctgagtagctgggattacaggcgctcaccaccatgcccggctaatttttgtatttttagtagagatggggtttcaccatgctggccaggccggtctcgaactcctgacctcaagtgatccgcccacctcagcctcctcaggctgggattacaggcctgagccaccacgcccggccaggaagtagctgaccatcttgatgatggatgctgcgtgacagagacccagcagaggtcacagggttaaagactgccttctctggaaaagtcctggaggaggggtcccagctcctgttgccaaaagcttagctcatcctgctttgaacatctagatacttgccatcttggtgaaggatagcagggactttccaccttggtgaaggatagtagggagtatttgacacatcccctttccattgagtcctcattcctgccagccaggcccaccagccttagaaagatgttgaggtccctagagaactcttcccattggttatggggagagaacgagaaagagcaaacaatgtgtgtagcccaaaagccggagatatgacccagacaataagaggggagagaaacttgcatgacccaaaatctttccccatctcctgcagaagtagctggggtttctctgggagaagggcagcctcctgagggctctgatggctgtcttgaagtatctgaagttctgttacggagaacctgccatgtactcagacatgcccctgtgagctctcagccccacattccaagtccttgagagaaaagggaagccaatttgaatcattgtatggaagacatttctgtcatctgccaaattaatgatgaagtggtgagctgtttgacagtggtggtaactaagcagtggcaggatgcccagtggagagccttgggcactgtgagctgtggggtgggtgatgtgttcacagggagggtcaaagcccagtaaatgagaacatacccctggcagcaactggggcagttcccaaaagctgagccaaatgctgtccatttcctgccctgctctccagcgggaagcaggagccagcagagggagcggacattcctcctgccagaaagctgctgcagcaggaaaggcctctctttgctgacgaggacaagtttgtgacaaggggagacttgggaagaattaaaccaccttgtttgcttttggtttccgaagcctgttactagtggaagcttggtggcggggcgctggggtccccacccatctgacagatggtgaagtgaaggcagggcaagggaaggagctgagtccccgtcatgtgagacccggacgggcttgcttggtcgtcccttagcccctcggtcagacgtggtgtgtaagggcagggacctgtcagccacccaagaggcagccacggaccctgccctcaaggggctcatagtctggtggagggggcaggcagtgactgagtgccacgctggagaggttgacaggaagaataccgttggggccaggcacagggcacagccagtatggcttgtctggggaagcctctccgagggggtgacatttgggctgaggaggaggaggcaattggcagtgaattgaggtgggggagtgtgccaggcgagagggagcctgtgccaggatgtgatggggcaagtttggggtggcaggggcctggactgcaggctggggtgtggggatggagccaggaatagacacaggaaggacttaaagttggggagagccatgaaaggttcctaataaggggagcaacgcgatcccaggaagaggttccatggcctggaggggctgggcccttggccggctggccagtgtggagtccagctgcggtcccctctggaggtggccatggcccgagcaggagtggcggctgggtgagactgagggcagctttcctgcctgtgactggtggcctctagtggatgttggagcctaaaggaggcccagcttactgcccacataggttgggggcaggaggcaggtgtgacggtgagaagccaaggctggtgcctgctgtcttagcagacgccttacctggggctgcccagcctagccctccccacccaccccagccagtgctctcaggcctgagagtagaactgtctgacaccctcttatgttaatagttgctggtggaagcactctccaagtcagaaaagctgttccctgctgtgatttcatttgattctatgagatagtcctaagaaccaatagcattcccactgtatagatgagaaactgaggctcaaattggccagttgctcaggaagacaggcctgggtggggcggtgggatccgcagcttcttgataactgcctgtctgtggggaaataaaaccccctccccattctgggtctcgcctggccctctctgcttccctgcaggtggggggagtctgtctgatagatgcagcctcctactggggaagaggacagaggtgctgtgtcaggggtggatgtgttcactcctccaggggacagaagcaccaccccctccagctcctccgccctgctgtccgcctccagactgacagaaggcagggtcacccctgctgagaaggattagagaggaggtggggcgccccaactgctgggctccaggccacagttggaggtggggaaccactgctcttccccacccctaggccccacctgttccaaactgacttggctctgggagcggcagcccctcctctagttactgtgatgaagccccctatcctgggagtgggacactctgggataccagccctgctgccaaattcctgtgtgtcctcggggagccagccttctctctcttggccttagcttgctcctctgtccagtggggggtgctggccacttggaagcacatgggtccgggctggtcctgccctccacaatctcctggccagtgaaaagaggcctggggcagaggagagggaagaaagcctttttttgcttgccaacacctcccctgcaaaggtcaggctgtgctcccttccctgcccggcagccagcctggtgcctgacgtctgcccagcggcagatgaccggcactggggctcctagcaacagtggacaaaaggttactcctgacgtgccaggctgcctcggcggcggctggctcagctcagtcgccctccctcttaaataggaaaaaaagttgtggccctgacttgtgtgcgtgcctgtgtgcacgcatgcctgtgtgcacgcatgtggatatgtttgtgtctgcacacttgagccgcctctccctccccctctgaaaaacgtgaactccacatgtagcgccgtaactctcactgatgaaatggaaagttgaacataaatcaatgtctgccgcccagttagctatgcatcagcaggcagcgcctgggagatttgctcggtaacaaagcacccaacagctgcttgggccttgactgccccctaacgcagagccagccccatgctacagagcccagctgggctacacaccacgtcctcctggcctcccaagtgcaggatgggactctcactcctctcttcaaccttttgagggagggaagggggaaggagtctctggcctcttggacttgggaggcctgggctctgttcttgctgctgctcctggcgaagccctcactgggggtgtaaactgactcccgaatctctggcttctgtggatctgatactggaaggatgggtgtcagtagctgcgttcacctcatgcttattaagagcttgggctggtttatcctttctcctttggacctgagtttttactttgcgttttcttagaatggagtgatttttccctgtgcctggaagctgctctgccgcaggtcggcagttctcccagcactgtaccgtggctgctccctctgcccccacgaggtccttctgtccttcatagggggatgggagtggagacccctgcggggctggagagtatttttgttttgtctcttcatagctgactgaggggtggactctcttgctcctgtccccacctaccttctcagcaaattgtactgaggtttttctccctttttttttttttttaaaaaaggtcaaattccttagcccttgtagcagaagaggtttgaggaagagaattccagcagaatcctgtaataacacgcctcggcatgacatggatcaggatagaccccctgagtaagctcatgccacagtgggaggaacctccccttcaggggagtctgggctgggctctgggcccaggcactgccctgggggtcagaggccattccagcatctagctcagtgtgaggcactgttctaagtgcagggaaccacagtatggggtcaggttcatgtcctgtttctgcctaagttaactcccaggcaacctctccctgaaacacttcctctcccaaagagggccttagaatccatgaagctcctaggccaggcccacctgtgatcctgtaaacttttctctcagaaaagccccatctcaggctaggcatggtggctcacgcctataatcccagcactttggaggtcaaggtgggcagatcacctgaggtcgggagttcgagaccagcctgaccaacatggtgaaacctcgtctgtattgaaaatagaaaaattagccaggcatggtggcacgcgactggaatcccatctattcgggaggctgaggcaagagaatcgcttgaacccaggaggcagaggttgcagtgagctgaaatcacaccattgcatgccagcctagaggacaaagcaagactctatctcaaaaaaagaaaaagaaaaagaaaagaaagaaaagccccgtctcttgtttcttgctcaagaccaaatggtgggaaagagactggggacatggtggggtagaggggcacacccttcatgaagtgccaggtctgtatgcagcacaggcatggggttgggagggcacccagctcggcgtcagggaggccgcagagtggctgtgaacagggtctttggagcacgatggccctgcacttggctggcagtgtgatcctggcagtgacccagcctcttcaggcactgtttcctcagctgtgctgtaggaacagtcgcgcagcaaatcctaccgtgtcctttttggagctgtggtgaggattgactatacatataaacctatattcaggccacacgtggtggctcatacctgcaaatcccagcactttgagaggccgaggcaggaggatcgcttgcagccagtttgaaaccagcctgggcaacatagaccctgtctctacaaaagaaaaattaaaaaattagcgagactttgttgcataggcttgtagtcccagctgctctggaggctgaggtgggaggatggcttgagccctggagattgatactgcagtgagcctcgatcacaccactgcactccagcctgggcaacagagcaagaccctgtctcagaagaaactcagaaatctacattcatgtcagtaatggtttattattactgctgtggaaagatgactgggcttcaggatccgtgttgaccagcagctaagcctggagctcccagcgtgccagtcagctcatctgtcccttctgtcttggacagggaggtgctgggtcccatccctccttcaccttctgtgaaggtgatccatgcttcctggtggcctctggtgtcacacagcctgggtgggcacatgggtttcctcgagaaagtcagttcacctctctgaacctcagttgcttcatctgataattgggggcgatgataggccttgacatcttaggtcggctgcgagaatgccgtgagatgatgtgtatgaagccccacctggtgtctgtgctgggttggctctcgagactttagagttgttgtaggcgtgtctgggactgtactgttctagaggcccaggtctttcagtttacccaagaacaagagctgcctcagggtttctcctctttccaggagggagtcttaggggcatggcacagccttagtgacattgatgtgtggaagaggttctgggtatttttgagatccgctagctttttagtgtttaacccttcagtttgaccaacatatttgacacacctaagcaccaggccctgtttggccctttaacacgttacttcccttcatcttgtccacctgatttacctcccttagcccctgccaccttgactcctagtgccctgctccaccgcacaggagctgccgggggaggtcgaggctgggaggcaggtgttgtgtgtctgggaccctctgattcttttcctcccaggcttgctaccatgagtctgatggagaccagctctgacctggggagctgggtcttcacctgtgcgcctgcattctgtcactggtgaatttcacctgagtatcatttgagtttgcgttccccacctgtaaagcagaagcagctctccctggttcatctgggagatgaacacttgtaccagcataaggtgtgtggtcagaatgaatggcagatgggaaatccgacaagtgctccttcccagaggctgacatctggtcattccttccttcagcatacattcataagccacggctttctgcccagccccgctgtgctcccagggttgggaggtagggcagcctctggcccccacacaatcatcgtccacagggcagacctaggctaggctaaccaaaggtgagcatgtggctcattctcctctgtcaggtgttcttcctaccagtggtgccccttcattagaagaatgaagtcagagctctttgtggtctagccctgctaccctcaccccactgttggaccagctgttgttccacagggcaagcaccagagctgctggctctcagacctggcctctgcccctccatcagtctgctggggattgttctataggctgcagccttctcctctccccttcttgaagcttcttccctctcaggtcacttttattcaagaatactttgacaaagtcttgccctttccttggcccaaggtcaaaaaagttatgtccaacatgcgtatctagctaagttccgattcgctagattaattgtaatagccaatcccaaggaacttactctggagctgtagaaaaggtccaagagcttaggaacttcggtctgttttgggaagcagctttcccttcctggaccatagtgtccccacctgtaaatgcagcagtgttagagagcgtggatataagagtccagtggtgagcagaagagacctggcccctgtcttctgggccgtcaagggctttgggggcaaaagaaatgggggactacttctagggccagatgactctggtggagtttgctgaagagcacccagcattgggtggagtttctcttgttgaggggcatgcttccaaccccaagagcagctcagattaggacagcttacgtgttgtaggcaagaggggtagctccgtgggctaataaggaaggctgtgtgaggtaataaggagggctgagccaaagaaaggaggttcctgaaggattccacgaggcggggcagattctgagccacagcttggtgtattaagagctacccttggtaagggctgaactaagtacttgactcctgatagttagacagttctctgtgaggcaggtagggtgaccacattttacaagggagataagtcagtttcagagggagctataggccgagctccaagccccatgaatctggggcttttccagcagcaccacagagctgcttctcattttccgtcaagtttgccaggtattgttgcacctgcccgtgtgactgtgggcccgacctcccacatctgtgtctcccagagtcctggttcttcccctgctccatcctgttgcttcatcttaacagaggaaggaggaagaggtcttgggccattccccaagctcctcagggaggaaaaggcatgaaaaactaccgagttttccagggggctgcaagactgaaagggaaaaacttggcagactttgctgttccgttcttagccctcttctgctcagtgggcaattggggttgaattaggggcattctggatttgtggtttccaaggctttgcagccccccttgctagttggatatgacgaatcattactttttataactgtcgggggtgaaggggcagggcaggaaggctgtgtgcacccgtgtgtctggagagcttaaaagtggagcaggaattctctgggtggatgaggcagtgccttcttaatatgcacatcaccttcgctgtgttgtcatgattaacagtggagcctgagcgctggcgagcggtggcggaggccggcgggcagaagtgggatgtgtctttgcagcactatccattttcagagctgaaggaaatctgttctggggggagaggatcagtttggcaaggccacgttcaccccatgttccagaggactggagtgggtctggatcccgggcccatctcttcctctccaggcttgtctctcctgcaccagtagaggtcagggagagagaggggtgctgtctggactctccccgtggggcacaggattcctagcttctgtgccagcattaaagaaggctgggagatgggcatggtggcccatgcctgtagtcccacccgcttgggaggctgaggtgggaggattgcttgagctcaggagtttgaggccagcctggacaacatagcaagaccctgtctttaatttttttttaataaagagagctggctgtgcagggctgggatgtgacttagcggggcagcaggtaggatggaaggagccactcacagatgggaatctaataattagtctccaacttgagagagggtatagaaacatctttggaaaggaacagaatagatatgtgattcccacgatacagatcgtattgccatttccttggtcaagcccccaaatgttagtatccttccccttggcctggtggtcccatccccaccatcttgtgcatgaagtcctctagaaccacacccaggcctgcctttgggctgcataaatgccatcctcacggtccagaatccccttccttttcttctctgccaggagacacctgttcattctgcaagtcctgcctaaatgtgactgttctgtggtcactgctccctcactccccagtgcactggtatctctgcctctattaaagtgttgcaccctggtctcactggccagtctggagctctttagggaagggcagaatactgcttgttcacgtgtctccggcacttagctcagggtactgggacctagtgcccagttagagtgactgccagatagaggtgggctctgcacatatgttatggatattgggctgtgttcttgaaaagagtgccccgttgtatggatacatgtggaatacacggagaatctccagcaggaaagccctccttaagcatttagtggctggaggcaaagtcacgtctcatatcctggcccttcccaaccacagccattcgaggtggagccttttcctggctgagatgaccccagaggatctaattctttgtgaattcacaccacaggaaagggtccaaacggtttgaacctgccaaaagaactcaaggctgggattcaagctcccagaatatttgtgctggcaaacaaggggaagggcttcttccccagcattgtggcaagaatgaaactggggacaccatcagcaaggagggttgtgaccagccagctggacgtgagcgctgggttttgtgttccgatgatgcactatcactgtattcgggagcagtggccaagagaccagggctcattgattagtgagcatggagggtgttggtgtgacagccaaattcaggtgtgctgatgcctggccagtgctcattctgtttgtcctcaggggcataacatcttggctctgataattaatgccttaatgtcactatacttcagttttccccctttgtaaaatggggtcaacttttgcttcatttgtcttacaagagaaatgtgaggttaaaatcaaagtgtagcactgttttgtttttccttgagaattacagaagactccacttttttccctcttcagtcttgaggaccatcatctaactcaggggtctgcagactttttctgtgaagggacagctaggaaataatcttagactttgtgggccatcaggtctttgtaagcagccgtggacagaacatgagtgagtgtggctctgttccaacaaaactttatttgcactgtgttccaataaaactttatttacattgtgttctaattaaacttaatttataaaaacaggtggcaggctagtttgaccctgacttgactgtagctcagcctggtggctgtgctcttggggtccttgtgctgcagccaagaccagcctttgccctggtatgcagcttggtgcgagggacccagcctagactttgaagcaggttggacctggaaccaatgagatcacatctctgaggctcagtcttcccatctgtatcatggcagtcgcagtccaggcgctggagaaagaggcgctggcaagcagtgtgtggaggagctatgcgttaggttttggacgctgcctatacttttcgtttgccatgtttcctccctttgtttgggaaaccatcacttgctgattctgttccgccaggaggcaagtgagtttcatgcctggtgagcagagccttcactgagcgccccctgttcacgcctcagcagggctgtccagggaagccagattcctaatggtgcaaaccctgaacccttgctgtctgcccagtgctgccctggctccttggagagactgctaggaggaagggaggtcggctggggcctttgctcacacggaaatcaatgaaccatttgctcacctttgcaaggagtggaccttggtggctgtaaggatccctggtatttatgcagagatgagtatgaaggggagatgcagtacattcctgctttctctaactggtaacttccccaccgtcccaggaagatggtccacaccattgccagacctctaaacccagccctctccttgtcctctccccacaaagggccattgattgtcatgggctcttctgctgggtagccaggagccccacctgactgtgagctctcggggaccacgcagaagcccgggcagttattccactgctgtgtggcccagctcagccccctgaggacccacctaccgtgcatgtgccaggcccatgctgggtgtgcaggcgggcaacttagtcaccttctgccctcaagttggtgtctcagccccagctctggcctgtaaacacacacacacatacacaccctacataacacacacacacccacacccttcacacaacccctctccaagccatgccaagttcattcccatgggttgaaatgaagaaataacgtttccgccaaagactgcatgtaaaattgacttgctttcccttcctccccccatctggtcagcttccctttccttgggggctgtgggtgaggcagaccatggtgacagattccggatgtccatggcacctgagcacaccttgaccttctccccagactgagcttacgccattttctgtcggtatttgggaccaaggagcaaattggattgtctatcaagtgccttttgctgtgtataattattgtaattttgtattcactcagttaaagcaacacacctaacaggcagattacacaggccgccagtaccgcaggtcctctgcgtcccactgctggtcgagaaaacccactccttcagcctctccagagcagtggccggtgtcctaggagtcaggagggacgaggatgtgtggagtgttttatctcttaacaacctaaaacctcaagtcccctttcctcagcagccttctgtgaagacaaaaggcggatttggctgggtggtaatggcgtctgtctgggtagctgtcagcagtttacagagaactctcacagctttcgtgacccgtgagagaatcatagcctatactccccacctcgcttgagggatgctctgccaagacccagggcgacaaggccaggactccagccctagtgctttttgggttttgggaccagtgccttcagcacaggtcacagcctgtcctcacacttcgcctcccaggcatgcctctgaacccacagagccaggacttgagtctcagctttatttctcagcaagcccatgacttctagacaggtgtaggcagatttgaggaatatgggtggcatttggggaagaagcagtgagtttggggaatacttaacacatagcttattttttcctttaaaaaatcggtgtaggtttattttgttcttggtttggttttgttttgtttcgtttttttaggcaggtctcaccgtcacccaggctagagtgcagtggcatgatcacagctgactgcagcctccacctccctggctcaagggatcctcccacctctgtctcctgagtaactggggccacaggcgcacaccaccacacctggctagcttttgtatttttttgtagagacggagttttgccatactgcccaggctggtctcaaactcctgggctcaagcaatcctcctgcctcggcctcccaaaatgctggattacaggtgtaagccatgtgcccagcctgttcgttttgcttttgtttttgtttttgttttggttttggttttggttttaaggagctatcttccatccagctccaagaatctttagctcagaagaccaacttggtcacccttttggtactaacttttcttcctggttcctatgagccccaaggtgttagatgtgcctgccccggggcttgctgggtcttgccccttgcccatggcagtgtggtcgcctgctgcctcagccctgctgctctgtttgggccctgccccaaggtacctgtgggggtgagtggcctggcctggaggggtccacatggcacccccagacatggagtaaggaaaggttctgtgtttagagagcacttgaagggctggagcaggaaagccttcatgaaaaaggatatgtggccttcagcagacctggtgagatgaggccagacgtcaagctcctgctttccttgtaaagggcaggcgagtggccacaggagcaggaggatggggaccaggactggggaccccgtgtgcctcacactgccagctgtgccacagccctgcagtgtttgtggaatagtcctcatttcctttatgagggcagtgaggctcagagccgttgggaaactggactccgaatgaaccggaggagctgggattggatcccaggcccgcataatgtgggcgcttcctgtcacaccacaacccgcctctccaggacggcttcagatgaagtgcagggacttagccggagcgtgcgggagggctgggggtcctgctgatgcttctgaaatgcttttccgcagagtccttgaatccgttttacagtgggaatgctctgctccccacggtgtcaatgtgggtaaaggctttttcactaaccatcagtgtccacacttcggagttttcgtgaagtggcccagtgtttgcctcgatcacacccataacagagcctcctgggccctgcctaagtggctctcaggagctgctggatggaacactacccagtgctgaaattacaggagaaagaataacaagaaactgcgggagttagttgtctccactcagagatcttggggccagctgagatggaatagcgagtccattaacagggtccagggcagctggaaggctggacaggaagtgggcgtgtttcctgcctccttttcccagattcaggagtggggattttcccccatgttgaggtctaccccagggcttggtcctgctgccatcaccctgcagaggcagtgcagtgcagtggaaagagctctgacccgtcagtggaccccagttctcatcccagttccggttggatcatgggggtaccaggcctacatgctgtggccacactgggcctcagtttacctgtctgggagtgagagggaggtaggcatcaccctctcttggagcccctggcaggttaagccaacacttaagcttatttctctctgtgtaatcgtttttgtccttagcctggcagctcctcagggtcaggacaagcctgatgtgcctccagaccccagcatggggctggctggccacataggaggtcagcacccggcatctcggtgctctcccaagtccttcagccttgggttcattccactttgccctttgctttctgccctgacagatgacacggaggtgctgctcgcagtcttgtagaatgatgggctacccaggaccctgttagactctagaatcagacatcgaggcctggctccaccacgtaatagctatgcaatcctggagtgcctttatctttccaagcctcagttccttggcaataaaatggggcaattgatcccttactgcgaggagtccgggattagatgagcttatgtaggtagaggccacgctccctgttattgttactctcacggccccattccactgtcaagaaaatggaaatgcagtcaggggcagagccaggattcgaacccagttccttccaaaccctatttcttcatctaaaagagatgcaaatgggaatgtgatgttttgaggagagccctggggtagagttaggagatgtggttcagatgccaactagttttctgtggtcttggagaggtcacacctctgtcatgggcctctcttttctcctcccctgcaaatgttggaggaagggatgatagaatctgtcaaagccacctaacaggtgacccctgggcagatgccgttctccctaagcatctagtaaggacccccagccaccctagtctagcctgatattttgcacaccttcagggtgccatctgccctgatccaccgcatccctggaaggttaattaggcagcctctggaaccgaaggcatccagctctcatggagggagatggtctaaatggagctgggcctgctggccaagcagccctccagatgcacccattttgggttcctcaaaagcttccagcaagtggaagcctcaccagagttgtcctgcatggaaaagcacatcagtatcatcagctttgagactccctcctcctctcaccttccaccacagtccactctgcctgcctgctgggtctgttcagagttcggggaagagagcggcccccgtcccaccaaaggtcagagccctcaatctagatcctttttcattgttgtctgcctcctgtgtagccttttgcccgagtgggtaacaaatccaaaagagcacaaagtccgtcttcttcaaacctacctgtggatctcttgttgagaatgcaggctgggaaggaagacgagagcactttttgtggcctaataaaacacagggcagcagagcccctgactcctcatagagatgggcagctcatctgtcatgttccttgcagaagcaaatgcttccacaaacacggatctctgcccgtgagactgctaggctatgtggggttcctcctgtgatgccacagggtcttagggacacagcctagacacagggaacgtagtgacggagctccgggctgagtggaggtagcagagacacagaggagttctctgtggatgtggacgtgggtggcccgttgggaaatggcaggcgtctggctctgtgccgagaggtgggcaggcagagcctgtcagcgcttcactgcaggtgggagaggagctctgtgccctgaggaggtgggcactgagcttttagcttggcctctgtcaagaatgtggtatcatttttctccctgagtgactggcaggcctgggccaagattcctggtcctcatcattccaacccctagctccaagtcagagggaagacttctagctgctcttcccgccccagatttaacagcttgttccccatgagccagagaggttgtggggctgggctggggcctccctgaccagcctggctccatccttactgcttgtcagctttttttcttgaggcagctgcgccaagagcaagcttgtgccacctctgcttatccagggactggtctccagagtcccccaggggcgcttctgagggaggcgcagaggaggcacacctgccagccttgctgtctggatctcagcagaccccggttggagcactggtcctttgtaaaggctgccgtagattgaggccccaccgtgtgcgccacacgcccttgggtgcttcacttctgttttctctaatctgtcagtgagccagccgcctgccctccctgaccactgggcacacaggtgtgaggggcttgcccagagccccactgctcgccctgaggaagcactcagttaccaggaagggaaggacgcgagggaggaggcactcccttcttgccaagagccgaggaaccaacagaaggccttttgccccctcttggcaactggaccttacccttgaaccttcctcctctgttcttttcatatttctttttttgggggttggcttcaaattatcttgttttgtttacattacacccaagttacgtggtacaaaagacttgcaggtgcaaatatgtcccgccttcattaactcccctccctttttaatttatgtgatttcaattttccttccctgtactgttaattaggggaccctctaatcagtgccattatcacagtggtattcatgtttgggaaagccgctaaacaaatgcttgcaaaattgctaaatggctaattaatgtctgttaattaagaaaattgctcatggtaacaaaccatgccgttgctggcagccgctagaaagacacacacttgttgaaattagtagcgtggcaggtaggggaacatctgctcctcggagctttccggaagtgagcagctcctcgcttggccaagaaactcccaggcctcacagcggcggcgccctcgggttcttgtacagccccctgcgatgttctctgcacacctcttctctgtgggcccacgcccctcctccccagtgggcaggcggctggcagcctggctctgcaggagaaggccaagggggaaaccctacctaggcagctcctctctctttttaatttagccacactcaccccctgtgcacattttgaatttttctaaaaaccaacctctaaaaaacagcacagtcatgggtggggaagagcgaatggaggcctgtctcctcatccctggcatcagcatcccacgctgggtgggctggaacgtgcttccgaggcagccctccgcgcttactgactgtgacccatggtaggagagtcctttggtggtgtgacccagtctacacacacatgaatatttacacacaaaaccggggttcatgaaagacacctgccttaaaatacacaaagctctctgacttttttttttattacctcggatttttaagagataattattgcagcttgctgaattgctgagtgagtttctacccatagtttgtaaccccaaggttgaagtgaattcatctgcccatgtcttctggggcggggtaggggggtcgaggtcagcatagcccagggttgaggcggtgggggtgggggtcagcttggaactgaggtatgaaaaggacagcccacccagtcgcccagcagtccggggtccccacccttcatgcacttccccctgtccccagctctgcaccggaactcttgggtttcagggctggagatgggccttggacccatggggcttctcatcccagctctgccactgaccagttttatggccatggccaagttccttcatccctcgagacttagattcctcatcagtaaaaattggaatgagaaaccccgcctcacagggctgctttgaagtgcaggtgaattcacggtgtgcgagtctgtgctgcccacaccgtgtggccctcactcactgtcccctcactccctgtgtgttacatctgtggtgccccttgctcctcttgcctctgttgtttatctgtcggtgcccccggccctcctgcccccaggaaacccgtcgcctgggcctctccctgacacttgatcagtactgcctcgagtcacccatagccgtgtcactgtcccccagactgtgagctccttgagggcagggcccttcccgatctttccccacctcccgtgcaagcggcacctacgtgctttgcacctgggtccctgtgtctgtgcatcattgtactccctctgagcccgtctcaaccaacgtatttaacatggcaaactccgctccaagggtaggctgtgtccaggactgtactcccgtgtgctttgacagaggtgcttcattttttgttctttcaaccccctgtgaatgtatttatcagcttctctcgctcccgctcgccgttttacaccgttgagccggcgaccaaagcagcagctccaccacctcccaccaaccagagcccacccccccgcacgcccgccgcccacccttcgttttggtttaatttttgttcttttaagctgcttctgcgcttctccatgtgctgtgatctataacctgcctctactgtctggcctcacagggtcctccggggtcacagccctcgccgcacgcacagcctccacctcacaatcctagcagcatgatgggaccccacagtcaggtaaacgcaccgtggcgctcccgcccgccggggacgcggggcgcggaggaagcagagagcccgcagaggaaaaacaaaaatcaaaatgtgctctagccactgcctgcgagtctttattgacaaattaaatttttttagaaatttcttttttctaaagatagtcttcagtcctcggatatcacacccagcttggatacgaaaccaaaaggaaaaaatatatatttctgtgaccttgtcagctgcctttgcgtttttgttttttcctctctcacttttggtttggttttgagtttggttcaccatttgtttgtaaccgaagctgcatcccgagccttttctttgtgcactcgtgctgctgagaaagctttcctgccattcccctgcattaagttagggagcccgctgtctccttggcgtttcccccccagtccttgctcccctctctgtccctgctggtggtttctgtgtgcgtgtgcctgtgtgcgtgctcgtgtgtccagctttgtctgcaggcccttaagatgttacgtatcagtccttcttaccctttcatttgcccttaccgagagcagaggtttcctcctccgccctgcgttgatttaactgtttttcgtttcttatgcaaagtcccagccgctgcccttcccacccagagtagatctccacgaacaaatgtggagtcaagagacacatttgttgtgtggatctattgttccctctgcccaaaggaagttttgctgtcaaagggaagaggctagcaggagaaagaacttaaaagatcactagttataacaaaactggactttgtggagtggagagcatttgtgtttgtcactgtgcagtagggcaggctgtcattgaactaattacctataattgcagccttttatgtcaccgcgatacgcaggcggccccaggcccccgatcagaatgggaaaccaggtactgtaccttttcatgttctctctcccctccctcagccatccttggccctaggtggactttgacacaaaatgaaagttgagggaaaggattgaggggtggaggggcaggtttaacgtggctggtagcttactagctgttccccagagagggccccatgtccccgctgtgcccatggtgcggcagttcacctgcctctccagatggccctttggacagcccattccagagttcagaaggtggcagcagatggagctaaggcgcatctgggattgcagggtttcggctattctagagaagatggtaatgccctgcccctcccttctacccccttcttggaagagggtcttcctccttaatgaagctaattgacaatgtgcattttttcctggaagcttttgagaattgccaaggctggtaaatataatcctgctattagggggggaaatggcccgtaggaatgcttagatcaggagcctggatgcagcagagcaggagatttgtgagtttttcagcaatgtctgcctgcttcccagacccaactcaaaacaagaaaggatttgttcgtgtaattagaaaaggggtctgattacggggagggatttttgcctggggtcatatgccttacgctggcccattagggttggcaattctaggtggtctggagaaatcagaccccatgccaccctccctggttcagggcaggagaggagttgcagaggtaaatatgaatagatgcctcttttgaggatagacagacttaaaagaaacttttcgagaaacatcagggaaattttatgccccaattttttaaaacagaattatttcggtgactttgcaaaagcccttcaaaaaaatctgacagaagcaccagcacatccagcccttgttgcctttgaactgggagtttagtcaccagctaaattagcattgtctgagtgtgatgcttttcattctcagggctctgcaagaaggctcctgagcgaggtgatgcagggactatggagagatgctcattaccaggggtctccaattgtcttttttttttttttaaccggagtctcgctctgtctcccaggctggagtgcagtggtgcaatctctgctcactgcaacctccgtccgcctcctgggttcaagcagttctcctgcctcagccacccaagtaactgggattacaggtgtgcgccaccatgcccggctaatttttgtatttataatagagacaggctttcaccatgttggccagctggtctcaaactcctgacttcatgagatctgcctgccttggcctcccacagtgttgggattacaggcgtgagccaccgtgcctggccagctctccagctttaatgctaaattgcctatcgggttcccacctttttattttgtttttttttctctccaaaagtccttcattttctattttctctgacatgaaggggacaaatttggacaagaggaattagagacccagctttttgagcaaaagaagggatccctggatacatcacagatgaggaaacaaaaggtcagagtggaggagtgacttcccaaagtgagctgggctggagttgatcttggttccagcccagtgctaattgtactctactccacccctttcctcagttttcacagatgtaagattcctgcccccatctgtgtttttaacccatcaccgctgggcctgctttgccgtggcacataggggcgccagcagcagccttcccacccaggagctcttcttggtccaaactggcctctgccaggaagaaaggagctacttccttatcataattgtggtggcccttcttctggcaattaaaggatatggagaggggtgtgtatatttctactcagcaactaagcatgagcaaccactcaagagcaaatgggggataaatccatcatctgtactttgtattacacaccagttttcccaacctccctgccaaccacccccccccccgcccccccgcaatagaaatctacactggggctgggcgcagtgactcacgcttataatgctagcactttgggaggctcaggcgggtggatcacttgatcaggagttcgagactggcctggccaacatggtgaaaccctgtctctactaaaaatccaaaaattagccaggcatgctggcgtgtgcctgtaatcccagctacccaggaggctgaggcaggagaatcgctgggacctaggagtcggaggctgcagtgagccgagattgcgccattgcactccagcttgggtgacagagcgagactccgcctcaaaaaaaaagaagaaaaaagataaaaaaagaaatccacactggttttccagtttcctgtgacctcaagaaatttctatcctccaaagagggatgtgccccttccacaggtattgaccctggggctttcttgaagagtgccctcgttgggtctgccagttaacagaagccctgtgccacccgagttagctcagttctctcctgtgacgggtaaagggagccgagactagaggacttgctggggctcacaggccattatgaatgtgccttttgggtgaggggagtgaaaagggcccttagggaaacaagaagcaaagggtcagtgatgtggcctcagggtcttacgaggcctgcctcccatctgcctccctggctagaggctgtgcatagagagttgctgttttttcaagtgcgggtgattggatgggtggtgacagtggagttcagccgggtttaggagagagtggctggaatccagggttgtcagagagctctcccacacacatctcggcagaggtcccacctggcaggctggctgtgctggcggggcaggtgagagagcatgcggatgcagcagggatttgtccgtttcctgggcagatgcttcctgtgccttgccccacatgcagtgctgtaggagaagagctggcctccgtccaggagccccagagcaactcgctcccctgtaggccccaggggtgtgtgcacagcgtgtaattatggtcccatatatgagccgttgtttttcctccttaagtttgagggcttcagccctctcagtttgagacccctttccttggtcattgcacaccttcttcccctgatagaagaggcccagactgtctgtccctgtctcagggtcacctcagtgagggacgcgacctccaggtcccctctgagcctctgaacagcccagctttgctcctggagttccgacacataggagggttagaggaatccaaggaggagctttctccaagaattggtggtcagcattgggctacctggagagagtgactgccaagccccatggctgcactgtctgggttggatggggtggtcctgcactgggtgactcatgaccctgaaggtcccccatccacctccatgtcctgggatcccccagtccagacagccttagaggcaggccttcctgagtcaccaggactctataaaaaccacaaacccccagtgggcagacgcaaaccagccaagtgattcagagctagggaacctggggccaggaagcagggctgggagaaagtgagaggccggaacaactaaaaatccagggattggaaagacagacgctgagcacccccaggcagacggaaacagcaggtgctaaatgccactttgtgggccaggtgcggaggctcacacctgtaatcccagcattttgggaggctgaggcaggaggatcacttgagcctaggagtttgatacgagcccaggcaacatagtgagaccccatcaatacaaaaaatttaaaaattagccgggtgtgacagcgcgtgcctgtagtcccagctcttgggatggctgaggcaggaggattgcttgaacctgggagttcgaggctgcagtgagctgtgatcacactactgcattccaacctgggcaacagagcaagcgaccctgtcttaaaaaaaaaaaaaaaaaaaaactaaaaaaaaaaacaaaaacaaataccaattctacttcgtgaacatcagatactccctatgccctcacacaatcctctcgtaccttaaccgcacatacccgctcccctgttccattctgaagctagggaaatcagtgaacagtctgtcccttcgctttccaccacctcgttccaaaaccggtttgaagttcactattgagctcaaggcaggagagctccccactcagcctcccccacagcagcacagcctgggctgggggcccttgaggacagacccctgtcacagatgcccagcctttgatcagcactgacacctgcagatgaggaaagatgaccagccaaaaggcttttcctctcgaaggcaaaagctcgtatttataaagccctaagggatgaggtcctagaagcaaacttccccccagcaactcctactctctttttccagttgcagctgaaataacttcagtctcaagtaaattgcttttcatagggtttcacagcgggtggggcaagtgttcacccaggaaacccgtggcccccgtgtttaccttctcattagtaaccacaccagcaccgccgatggccccagctctggagccgggttctcgtctagtacccctgcccctctcctagtggccacctgtcccgccccggggctgggtggcatttcctattgtagaagctgatgggatgtgacctgggtgctcacttggctctgcaacctgtgactgggagcccgcaggcctgtgacctcagtttccccatctcaatcctaaaagcctcctcatcctcttttcccctttaaatggggcttcccacagcgataggattttaggtagtgggtgtctcagtccccgtaatttggaagtagagctaaaatgaggtatgtgtctgtgagacaaaggcaagatggggtttgggcagaaggagggagtgggcactgctgcctctgagaggaaggtggttggtgctacagccagagcaagacctagagaacttggtctcctgcctcacttcagagctctgataggtacacagaccccctaccccaagacagcaggatgaggcggtggtttccctcccacagagcccccaaaacaacgccacagttagagctaacaccacttccagctgactggtaggcccggggtaaccttctcccactggcaggcagcagaagtctcagggaggccatgagtggctccacgtgatcacacggggcactgggtgggacaggtagatgcctgtccccatggccagcagctccggagcagctcctcagcttgtgtcttgcatctctttcagcctccgggaggagttcctgggacacagccattgctgcccaattctatggatcccacacgacaacaaggtagagagggcagggtgggcctagggtggctggggatgccaggaggggctcctcctccctccactcctgccatcccatgacgcgcctcctctctcacgcaggccaccccaacatgggaggatcaatgcagagaatgaaccctccccgaggcatggggcccatgggtcccggcccacaggtaaccaccgcctgtctgtccgtccgtctccctggccatctgtgtgcacccgccttctctcctgtttccatgctctgtcagtctcccacatctctcagttcgcaggggtgagaggaagggcatggccgcatcccctgctcctgtccgcttcctgtggcaggctggcttcacgcgctgcccagggcagccccttgcagatggcaggcagagttgagggcccccaccagggagctaggaaaaaggggacagctgaggccttctagttggcagacccttttggggtgcggtagcctatcatggggtctgaagaagggcagggagctcctgaaccccagagctgcctcccctgggtgaggtagacttgagatggcttagggccaccatcggttgtgtcccagaggcggcgcagatgagtggccttcctagctctgcctgcgacttagcatgtgtctgtccttggatgaatcactttgacctctgtgggccccagcaggcctcagtttccccacctgttaaatgaggactgtgtccgcgattctctggtgggagggggccacgctggcaggaccccagcacccacttcagccgggattctttgaccagagggctccgctgccacaaagggcagtttataagccattggaagaaagcatttcaggtgccctcacatacctcttacggtcacaacaaagtcgttgcccctcgtggccagctctgctcccccaggtaggggtgtccaagcaacaggtgttggcgctgacaggtgttctgctgtggaaccatctcactgcttacccccagccctctgggtgtttgcacgtggttctgtttcctatagtagccgtggcagagcgttcgcgatgttccaccttgggaattctctagcccctaactaaaggaagctggaagtctgaataaggcaaggggcttgttctcaggtgttctttcccttcttttctgttctgcctggagtctgctgcactggtcactcccttggttgcgtgcaggtgttcaggctctgggccccctgcactggtttctgggtcccctgagggtggagtagtgccccccccattcccgcccacacgtgctcccttttgtagggagaggcgtctgccccacagaaccacagccctctgctccatcccagaatccgccccacagaaccacagccctctgctccatcccagaatccgccccacagaaccacagccctctgctccatcccagaattgtatttacagcaagcccaagccaccgctttcttctctgtggtggttggaacatctgtggtgttgaaagattttagggaggtccttgtcttctgccagccccataatcctaaaaggaagcaagcccacagcagttgcagctccaatattctggttgtgttccttcctcaaatcctccaaagttcgcgtttctgctagctccttttaagctgccagagtggccccttcctgcctggcagccgcctggagctgacctctgcagggctgcctgcctagggaagggggcaaggggcagagtaggagcggagcttcccctctccggagtcagatacagctctccctccccacagcctaagccacacagcagtcacattttattggtgtagaaatcagcagtggccttggattgtcagatgtcatgggatctgtgtgactcaggaggatggaatctgaggagggaaaatcgaatgccaccgcccagcccatggatcctcagaggctcagcggctgcatctgtaaaatgggaataagaactgtgcctgacctggagggctgttggaaggggcagggtccagtgtccagttcccttttttttttttcttttaacaggaatcaaattttatttttattttttaaaaattaaaatattttttattaaaatttttttaaattttttaaaaaataaaaaaagttttattgttttttattctttattttatttttttgagggtttactctgtcacccaggctggagtgcagtggcatcatctctgctcaccacatcctcagtctcccaagtagctgggactacaggctcccaccaccacgcctggctaatttttgtatttttagtagagacagggtcttgccatgttgcccagactggtcttgaactcctgggctcaagtgatcccccgacctcagcctcccaaagtgctgggattataggcgtgagccaccgtgcctggccaggtcaagttctcaatgtgatgctggccacagggtgctcccgctaaggaggctatttgtgttttccaactttagggactgaaaaccaatgttaagacctctagttgcttgggtttggtgattgcttttaatttcttcttctttctctttttctggcaaagtcattaacagtttgttaggaccatcgtaacactgagattctaaaggctgggaacagatgtcaggctatttgagagcagcagggtgtgctggcagttcaggacttcctctgggtgtggtggatgtctcatcatgtctgcccctgacccgtagtccagcacactctttggcacactttaaagaagtgagggtcccagcggctgaggccctgcagtgagactctcctggcctcacccaagcagtgtacaaggggtagagctccccttagaccctaggagtgtctccagcgggagggagagaggctcacccgtctttatttatgttacacacccttgccaacctcaggaactctggaagcatatctcctgctctttattttactttatcaatgtggagaccctaaagtgcttcacccatgtttcctatactcctctgggtagggtgagtattaaatcccagagccaaacgtcccttgaagaaacccagggtgtctgcactggcccatcactggggtcaggaaagcctggcattgatgtagcactgggcccggacaaggttgatggtgcaggatggattacagggtctgtggtcacctacgggctcatcttgggcccggcagagcctggtggtttgggactctgaggtggagggtagggagagggcagactctccctgttccctaggccatttctgtctctcccctgaggatgatgccctgtggacaggacagggacaagcccagaacttagttctggaaagcacagtcctgacagcagctcagcctggctgggcctccagtctatcatctgcaaaacgggcagcaagtgatggcctcatggggctactggagggtgggcgaaatagcagctgtgaaatgttacttgaagtccccacatggtgtcctgtggatcccttccccttcccgcaggccctgagcttgtgggagggagccctgcctactgccacagcccgggctgtcaggaagggcggccagccccttcagcataaagtaagcaccacaacacacacagtgctgtgctgagaccaggctcaaaggtgggagaccatcggcatgtgattcacagccgggaattagattgcttttagccagtgaccactccagaactttctgaacaaagaataggtacagcgtggtcggtcatagggctactttatttcaaaaccgaagggagtgacattgcattttgtgagtctgtgtcacatgtcagcctaaatgtctcacaggaaccagcaacgcaggtatcaccctgtcctttgtcatcagtgcttcagacagattttactctggttttgtaaagtgccagtgccagaaaggagatagtacttccacttagaactcttctttctaaaaagttttatgtatgtcagtatcaggtagtaacgtcttatcctagtgtttcaaaagtgaattctaataggacgaagctaaaactgaggggctcctggttggacttagtagagagaatgccagcccccaccagaagtgcggtggctcccagaccccggggtgccaattctgagagccaccgacttgttgttgtttctggtattcaggctggggctggagccaggacagagtagaatcaggtcattatcctggtttgtctgcatttgagagttcagatgaaggagaatccacagcccctgggacaatcctatgccacccccatctcctggggctgatccagggccagtccaagctcagtgccactgagcagaggcccccaaaagagatgggtgggtcattaatcctggtcctgagcaccccgagctggtgaggaaggaaaagggccccttgaggaactttctctggtggtcctgcatgagatggccaggcccctgctgcccagaaaatggctgggacagcctcaaatccactctggtaggtgagtcctaaagactaggagagctatcccctaagggaaatacagcactgtgtgtattcccttcccacctgcctcctgcaagatgcttggctaagaatgcagactctgggggccagcagatccaggtttaaacagtgggcacctagaaagcccttctgaggatgtggcaggagggagcagcagccaccgcctccaggctgcagccccagacagctgctcggtcccttctcactgtggacctggcggagtgcaaagctgagacagtggcccctgtgaatgtggccagccccacggctgcactggaggctcctgctctctgcccagctgtccctgcccctgcagagcggtgccagtggcagagggatacctggttggtaaccgacccttgtacagcttcaccgtcatcacctccagccacgtggtgctgcaggcaggcaggcaggagctggccaaagagggaacccgtttctactgagtctgaacttctgggcattcctgccctatgtgagaaaacttcgctgcaaaccagatttcagcctgctactcgctcctgacatctgtgtggccttgggcatgtctctggctttctgggccttcaagttgtcatctatgaaatgatgaggtgcaagtggctctccagggtctgtgcctctataggcggcaggactggtggagaagctccctctaggaagctgccatgccggttcttggagaggctcctgaaggccaggcagggtcaggagcggcaggatagtgcacttggagcctcccagctcagcgctgcgtactgcatgtcaagagggctctatggagtgagcacctgcttatcatctcctctcaccccactccgtgctgagacataccaggcttctgctcttgttctgagatgcaggcctttctcttggatgggagaggcggctgcagtcctggaaaagaactccatctggaagacctctctagtcagctgggctgtacacacagtggagaataggcctggggaggtggcaagctgcttgtcctggagcagcaggtggggagatgaggctgagatttgtagaggggattagaaagggccctttgagacccaagcttctgcaatgctgcggtagcattaagggctttggtgtttgttctgctgctgacgtcccaaatcagtgcacacctcctagggcttacggggcacttcagaaccattgtttcatttgatccactggagacctgcaaggttggaaacacatggggctctttgtccccattttatagacaaggcagcacagcagaggggattgtgggtctaaagccagagccatgctgcagggcttcaccccagctcagccacgcacaactgcacagtggggtcattcttcctctctacctcagttttctggtctctaaagtgggtggaggaaaggggtcattgtgacgatttattgtaggcagtgcacacacagtctgtggtacatgtgggcatggaataagcactattgtcatttggtaatttgcccaaagtcaccagcaggcagccaagccaaggccagccttcctgtgttctgacctcaggtctcgagttctgctcttcaccctgtggtagagtgggcttggccccagcacattcccacaaggctgccactgtttgcttgaagcccatgccctgagcagccacagggtgaggcggggcctgccttctctggctccgggtctggctctttgtcagccagcctggtgttgctcctgagatcatctgcatcctgtctggacatccttccagactccaagcctctctgtggctgagcaagcggagcaggtggccccagggtggtgagatttggaagatgatccctggatgcagaacccactatcagcccaatattggctctgtgtgtgtcaggctccaggtctccatcttcccattctgtcccccttcccacccgcctcccgccagtttcttggctaagcatacagaatctggggggccggcagatccaggcttaaatcctagctgtccatttgctcactgcaacttgaggcaaaactttctccctcagaccttcagtctccttttctgggagactaaagtgggaacaatcccagcctcctggagttttcacacagatcaaacaagagactgtacataaagtgtgtcatgcactcagtaaagggcagtgaatgctggctgttcctttgccatcaaaattccagcaacctacttcaagttctcctacaagggcagagcttaagctgcagccaggctccctttggtcttcatgcattcccttcttcggtctttcattgattgcttcagtgccagcgtagtgagtgccagtctgtgccactgggtgcatggggtggggggtatatgatcatcaagacacagccccaccttcaaagggcacttggagtccactaggagagatgggagatggacagacacgtggccatgatcagacccagtgtagcatggtggcgggggagggaggttagaaggcattgtgggagtaacagggctggagcagtcagcccgaaggggtggggtcaggagggcttcctagaggagctgctcttggagctgagtaggagcctgccaagcagggagcagggaagcaaggcatgtatgactgcagggaaaatgacacttggagagagggtcacgagcaacactggcctggttatataggaagagatgcgcgtgatacgaggcctggtgccttgacccaccccgctgtgcctcagtgggccgtcctgagctgaatctggactgctgggacttcgtgagttctgtgtagacttttctctcaaacattggctgggcacagtggctcacgcctgtaatcccgatactttcggaggctgaagtgggaggatcacttgagcccaggagttcgagaccagcctgggcaatgaagggagaccccatctctacaaaaaaatttaaaaattagctgggcaggctgggtgcggtggctcacacctgtaatcccagcactttgggaggccaaggtgggtggatcctgaggtaaggagttcgagaccagcctggccaacatggtgaaaccccgtctctactaaaaatacaaatatcagcccgacatggtcgtgggcgcctataatcccagctacttgggaggctgagtaatgagaatcgcttgaacctgggaggtggaggttgcagtgaaccgagatcatgccactgctctcctgcctgggcaacaagagtgagacttcatctccaaaaaaaaaaaaatcatcgaaaattagttgggcatggtggtgcatgactgtagtcccaactacatgagaggctcaggtgggaggattgcttgagcccaggaggtcaaggctgcagtgagttatgattgcactactgcactctagcctaggcaacagagcaagacgctatctcaacaaacaaaacaaaaaaaaactcacacacacatagtgatgatccctgagtgcagaaatggagttttctccggcttcccagcatcatgtctgtggagggcctctgatgctgacacatgggtggggtaggactaccacctggacctggggcaggttggcgtgtctgtatgtgccaggcctgggcctgcaccagcctcgggcaggcttctcaggagtgcctgctcccatccacattgacactcacccctcgcctccctgcctcctcacctcagagcctctcaatgggttccaagaccaagtccatcccctcttacccgcctgagcccagggggaaggtacaggatgacatcatgggagcccagagagggcagcggcttgctggatagccacatgtttttgagaacttcatcttgaaagctcctgaaaatgcactgaatgttgtgactgtccctctgtgctggcttgtcattgtggtccctgtgacttggttcccacccgccccaccgtttttgaaagaatgtattattttttctcatcaatccttttcacagactaaccctctcactatgttttgtctgtttgtttctcctccctcctcctgtctccggttcccttcttctcatagactgacccttggttatcgttgcagaattacggcagcggcatgagaccaccacccaactccctcggccccgccatgcccgggattaacatgtaaggcaaaaacgacccggcccgtggctcagagtccaggtcttcccccaccctctgccagcaccctgggagactcatgataaggggtcattgctggtacctctctggacctcagtctcctcatcggtaatgtgaggatattgatgatcctggtgatgagagctcagcctcatagagtgcctctgtgtgccgggcacggttcaggcatgctgcgtgcatcagctcacctcatcttcatgattaccctatgacgcgatgatttttatttttatttttattttttttgagacagagtcacattctgttgtccaggctggagtacagtggcacaatcttggcttactgcaatctccgcctcccaggttcaagcgattctcctgcctcagcctcctgagtagctggtgttacaggctcccgccaacatgcctggccaatttttgtatttttagtagagacggggtttcaccatgttggccagggtggtctcgaactcctgacctcaaatgatctgcccgcctcagcctcccacagtgctaggattacaggtgtgagccaccgtgcccggcctgacgcggttattattataacccccttacagatgaggtcaccaaggcacagagaggtgaagtaacttgcccaggctcacacagctttcagtggcagggtcaagagttgaacctctggacagtgtagccactgttctctagtgcatttgtgatttttaaccctgttgtgagaatgtggactcccttcctaggaaaatgcacatgcaaagggaatttcacatattttttatctaattttatatactttgtaaagtttacctataatttaaagcaattcatagatttccacccatgaagttacccattactgccctgagccagaaggctctaaaccgcagggctgtaggaaggacttcctgttgtgatttcagccctttccttctgcccctgctgcctccaccgcttggagtttacagcgcctttttcattgtccacatctctttctccctctctcaggggcccgggagctggcagaccctggcccaatcctaacagtgctaactcagtgagtacctgggtcgggtggggtggtgtttgtcaggggagcggttctgggtgcaggggagctactgtccctgggtgtaggtgtcacgggaagtgggagatgcagcaggactctcctgatgcttctagggagaaggccgtgtggaggtggaggcctgggagtaatgtgcaggggtcatcaagggctccacccctgccctgcctgcccagccagcccactcctctaaggagtaagctgagaacctgggctcagagagcactgttcagagtggagacctctacccatctcctccccagcagggctggaaggtgcgggtaaggtgctccgcacagacagtggggtgaaggccagaggaatgtggggtaaagctgtttcctgccctctcaaaccggagggccttctatgtcctccctgtgtctgtggctccctcccaggactggggagtaagagaccagggtctcagggtcagttcaatgtagcagagagaactgggcttcagccacgtcccagccctcccaggggaaccaagtgggtggccagctcactgggtggcgatgcctttcctgtgaagagtgggtcgtgtcctcagggaggtttggcagctgagggcactcagtgactctgacgtggggctccctgacatcttgtttttagattccatactcctcctcatcacctggtacctatgtggtaagtgtgtgggtttggggcattgcatgtctagccacgtgggactgagtgtgcaagagaactggtctggggtccccgtttctttccctttcacacattcttctgagcagaggttccaaactgctagaacttgctgtcaatattcagtcatctgtacagacccaaggtggcccagaaatccccaaaccagacctgggggtggaattgccttctggggagctgaccagtgggctgcttggcgtccaccgcaggcctctctagtgggcatgcctgtgagcacataatgcaggcacacacacccacaggggccgcttggtctgaagaaagggacaggggacatccaggtccccttctcaagcttgagtactttgagtgagcgctgggggtgtagcaagatgaatagcggctgggcccggggcgagcagttgctgctgaccagggagggaggatgccggcccctccccatgttcgttaccaccgtgggtgtctgatgtcagttttgtctcatctttagggaccccctggtggtggcggtcctccaggaacacccattatgcccagtcccgcaggtaagagcgcttgaggggaaagtggggggtctggtggtggagggtggggcatgttgccagagagacctggaggggcactgttgcagagccagagcttaccagccactccttcctgggcagcacatcttccactgggcatttagagggcagggggtcccttgatgacactaacctactcctctgatgctgctccataaaggacagggctgagcagagcagtccaggaacagggattctcgttgcctttgaatcccttttgttgggaagaaccctgttcagggtgggcatttccccaaatgactcaaaaaggggccttggggttctgccatcctgggaccaggattctgaggcatgctacctttggagtttccgtagctcctggcttctggtcctctatataggagatcccttctcccccccgccccccccctttttttttttcttttttgaggtagaatctcgctgtcacccaggctggagtgcaatggcgtaatctcagctcactgcaatctccacctcccgggctcaagcgattctcctgtctcagcctcccaagtagctgggattacaggcacgcaccaccgtgcccggctaatttttgtatttttagtagagatggggtttcaccatgtacccaggctggccttgaactcctgacctcaggtgatccacccgcctcagcctcccaaagtgctgggattacaggcatgagccaccacacccagccctccctgtttctttaaacaaaagagggcatgcgtgcacatacgtgggcatgtgttgcgcgcgcgcgcgcacgcacacgcgcgcgcgcgcacacacacacacacacacacacacacacacacacacacaccccatcacaattatgtttctttcccagctaagaatagcataccagccagctagaaggaattcaacatacgatccttacccaccccaaaaataaaaagtgagaggtagctggatttctgcccaagaattacagcgcctgctcctgatagaaacgttttagctggagacttttttggctaactggggagatggaggggactctcccccgccccctcctcggctccccatagcagggaagctgctcagctgcaggggtggagctggccgcagccgggatcctgggctcccactccggctctctctttctgctgctgcattttgatgagctgcatgacctacattccgactgggccacatgcacccactccatatgtgaatgcgtttccagccccatccctgcctctccctcctgccccatcagcctggcagggtggcctctgggtaatttgccacgtttccctttccctgatttgattaaaaccactttgtagggtggtgggagagcacaggtggtgggaggagagcacaggtggtggttctgctgcccccatgttgtcccaggcagtgtctggggaccagattcggtgtggggtggggagacaagaatttgaacccgtaatccccctgtgccgtgtccacactgctggggttgagtggttttcacagttgaattttctgtgattaaaaactttgtgaatcttcattaaatacaaattagccagaaaatggtggtacttagaggaaattttaggttataaaatacaaaagaatgagttccagtgccatgagtttgttttaattaagaaacgaattaatcaccccgacttgtgggtttccactgttctacagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtgattaactcttgggcaactcagttcccatttcataggcggcagggggtgggagaggaaggggtgggacgatgcccaccctctggttagagccagggcgcccgctgtgctgctgggacttgccacctcctgccgtgctggtgggggaagcgccaggctgtaggtggggtctggcctggtctctgcccagcaaactggctgtgctggcccgggcaatccctctcctcctgggtctgtttctggggctatggagttgagggtggagccagcagcaaggggacagggctcgctgggggacccgcctgcctgtgctgctgccaggagctctggaactcccaatacctggcagcttctttgcctctcagagttgcagcccttgggtgatgttgcagctcacatttccccatttctgattactgcttgccccacttcctcctgtgtcccctgcacccactggatgggacttggttagtcagctgcagcctgtctcctcacccagggggcgttgcccgaggtcggggcctgatctgcttcccctccacaggcaacccttccattctagttccttcccttcctcctccatgcaggcctcaggtgaacctgttcagccttgcccctccaggagctcagggtctgaaaaggaggtctacagactgtagagccagagagtgggcctggggccctaaagtgcgaggctttggcctggttgagggggtagggccttttggggcactctggttttgttggctccgttcctgaggtgacacccggatcaccccacgtgttaaaccccgagcgcgggctgccctgtgctggatattgcctacatccagcagccctctgagggatggtttctggcctgcctccgttgccagggtcctcactggtgtgaccaaccatctggcttttaacactaaaaagccccacatcctgaggaatcccaggacacagaaagtcctgggttttgtcagtgatgcagaaggttgggtggaaagtatgaaacccacacagagggatgacagcaccatttgtagcatcggatggaaatggcgtggatgatctgcctcgagtggtcactgtcgccatgttgcctgacgtggatgctggcatcaggacttgtgattcaccatggatcacatcactcaggctgcaactccgcacgctgcagtcatgcatgttagcagcacttgcctaggagtctgctgcagattcagtgttgggctttttgtctagacggtgctggtttcagtcttgacatcatgaatattgtgactgtatttcctaagagttcagatgatgaaaatgagaacggtgacaatgacagcaccagcgtgacccaggcatcactgggaaagaaggttaaatgaccatgttactttaatgacagatgcaaggacacacacaactggattagggaggaaagaacccaaacagaatgtactgcgcggtgtgcagaaaagaatgtgagaatgggcatatggagaaggggaggtggaggcacattggacattgagtctctcaagtctgaggcatatctttctaaatcaaggtttttttgacctccaaagagacagcagttctcagtcaaaaacagtggtcgcagaattagcttgggcgcactccttgaatggacgccattatcatcttgttcccttgattgcaccgcaaaccaagaaggttacatttcctgattcggaggttacaaactaaaagtcctgtgtgtgaaccaaaggacgagggactttcagtaacagatgcattgcccctttacagtagtgctgaccctgtctgatccttccagcattcgtgcttccgagtgcgtcaagggctgcctgaagtcatggctacaggtttccgctagctcttaggtatgttgatttgaaaactggagtttcagatcgtcttctcgatttctgtgaagattttagtgaagccactgaagacgtaagagattgttgttctcttgtccaaatacaacctagactttgctcatttatctacatatttggcagacagtacacagttaatttgagcaaatttcatttagtccataagcttcttaccaatgaaaatgaaaacatcttacctgctaaatgttcacacctcgtacccgacactgtcacaaaggggtgtaatttgcttacctgtgataccagctttcataatgaaagttttgggtcacctttcggtttcctcaaaacatgccaaagcacttaatgagatctttgactttatagacaggagaatgcctcagacacgtttccacaagatgactatcattgctggccatagaaaagatgttaaaatgttggcttgccatgaaaactgctattttttaaagtgtgagacaagaaggatgtccttctctaatttggaaatgcattgagatgagaatggaaaaaggaattacaataaaatacaggccaggcacgttggcttacgcctgtaacccgagcactttgggaggccaaggtgggaggatcacttaaagccacaaattcaagaccaacctgggtaacaaagcaagacatcctcaccatctctgcaacaaaaaaataaaaataaaaaatacataggctgggcgcggtgactcacacctgtaatcccagcactttaggaggccgaggtgatcagatcacttggggtccgtcgggagttaaagaccagcctggcaaacatagtaaaacaccatatctactaaaaaatacaaacattagctaggtgtggtggtacatgtctgtagtcccagccactcgggaggctgaggcaggagaatcgcttgagcctgggaggtggaggttgcagtgagccgagatcacaccactgcactccagcctgggtgacagaatgagactccgtttcaaagaaaaaaaaaatacataaacacattaaaaataaaatagaaatgtatatactgttttgccagtactctctgatgctccttaaggagccccgaggagcctagatggggctagccagccacacttggattggagagggggccacaaaacctcatacagcaggaataatgacccatttaatgcttgagaactcaaaaaatgtcaccagaaaaggcagtcaagttaaacaggactttatcaatttcttcattaaaactataacatatttggaatccaacttggattttgcaacttcagattacctctgtgctttaaaatcattttttataacaattttaatttataacatccattgtgctttggagtgttaaaaaatgatggacatctggccgggcacggtggctcatgcctgtaatccgagcacgttgggaggccgaggtgagaggatcacttgaggtcaggagttccagcctgaccaacatggtgaaaccccgtctctactaaaaatacgaaaattagccaggcgtggtggctggtgcctgtaatcccagctactcaggaggctgaggcagaattgcttgaacccgggaggcggaggttgcagtgagctgagattgcaacgctgcgctccagcctgggtgacagagtgagactccatctcaaaaaaaaaaaaaaaaaaaaaaaaatcagccgggcatggtggtacacgcctatagtcccagctactcaggaggctgagtcaggagaatcgcttgaacctgggaggtggaggttgcagtgagcagagatcgtgccattgcactccagcctgggcagcagagtgagactctgtctcaaaaaaaaaaaaaaaaaaaaaaaactggacatcttagacagggatagcccatctgatgaattacagatgcaaaggcctgattgacaagcagctggtcctccaaagccagcccctggacaaaaatggatggacatctttggagagatggacgtgaattcctacaagtcccaaaacctgtgcttataagtaaaaccggaggtactttgtgtataagggttgtgtggagaggatatttagtttggtggtaccgtgttaggtgacaccaggagtcagtgtaacatgggctttgaataaacagagtgacaagtcaaatggattttaagtttgactatattccgttttaccagtgcatttaaaagaaaggtgttctaagctgggtacagtggtgtatgcctgtagtcagctactcgggaggctgaagcgggaggattgtttgagcttaggaatttaaggctgcagtgagccatgatcatgccactgcactccagcctggatgacagagccagactccatctctttttttttttttcttttttaaaaaggatgtcctaaaggctataaaggcttcaggcaattcagagaccagtgggaaagaaagcagagcagaatgttctaatgtatcctagggcagaaagaaacattgttattttttatttaaatattagtaatgtttgtttcattaatcctattatgtttgtttgtttgtctgtttagagatagggtgtctgtcacccagtctagagggcagtgtcacagtcatggctcactgcagcttcagcatctggggctgaagggattcctcccaccacagcttcctgagtagctgggactacaggcacgtgccaccacacccggctaattttatttgttgttgtagagatgaggtctcactatgttgcccctaatttattttttattttttatttttatttatttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggagtggtgacgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctactttctacacagacacggcaaccatccgatttctcaatcttttccccacctttcccgcctttctattccacaaagccgccattgtcatcctggcccgttctcagtgagctgttgggcacacctcccagacggggtggtggccgggcagaggcgcccctcacctcccggacagggcggctggccgggcagggggctgacccccccacctccctcccggacggggcagctggctgggcggggggctgacccccccacctccctcccagacggggcggctggccgggcagaggggctcctcacttcccagtaggggcggccgggcagaggcgcccctcacctcccggacggggcggctggccgggcagggggctgacccccccacctccctccccgacggggcggctggccgggcggggggcttaccccccccacctccctcccggacggggcggctggccgggcggggggctgaccccccacctccctcccagacggtgtggctgccagccggagacgctcctcacttcccagatggggtggctgccgggcggagaggctcctcacttctcagacggggcagctgccgggcagaggggctcctcacttctcagacggggcggccgggcagagacgctcctcacctcccagacggggtcgcggccgggcagaggcgctcctcacatcccagatggggtcgcggccgggcagaggcgctcctcacatcccagatggggcagcggggcagaggcgctccccacatctcagacgatgggtggccgggcagagacgctcctcacttcctagatgtgatggcggccgggaagaggcgctcctcacttcctagatgggatggcggccgggcggagacgctcctcactttccagactgggcagccaggcagaggggctcctcacatcccagacgatgggtggccaggcagagacactcctcacttcccagacgggtggcggccgggcagaggctgcaatctcggcactttgggaggccaaggcaggcggctgggaggtggaggttgtagcgagccgagatcacgccactgcactccagcctgggcaccgttgagcactgagtgaacgagactccgtctgcaatcccggcacctcgggaggccaaggctggcggatcactcgcggttaggggctggagacggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggaaagagagggagaccgtggggagagggagagggcccctaatttatttgttgatgtagagatgaggtctcactatgttgcccaggatgtttttgcactcctgggctcaggtgatcctcctgcctcagcctcccaaagggattacaggtgcgagccaccatgcttggcctatgttttattttttaaaaacataaataataagccaggtgcagtggctcgagcctgtagtcccagctattcaggaggctgaggcaggtggatcacttgagtgcactctagcttgggtgacagagcaagacctcatctctaaaaaataattaatgtaatatagcctatcaaatttaagtattcgagcaaaaagttatttctgtatcagaggacagaaacgttataaaaatattaatatttttcctcatacatatcaatcatttaactagtccacctcctaattgctactaattgccgctgttaacagttcctattgttgtttacataatagcattaatctaatggaaaagtaaataatacagaataaatgatgctgagacaactgaatatccacatgtggacaaatgagattgaactgtgtccttacagcagtacacaaaagttaaagtagatcatagggggccgggcatggtggctcacacctataatcctagcactttgggaggccgaaacaggtggatcatttgaggtcaggagtttgagaccagcttggccaatgtggtgaaaccctgtctctactaaaaatacaaaattagccaggtgtggtggcgcgcacctgtagtcccagctacctgggaggctgacgcatgagaatcgcttgaacccaggaggcggaggttgcagtgagccaagatcacgccactgcactccagcctggccgacagagtgagaacccgtctcaaaaataaattaaaaaataataaaaaataaaacaaagtagaccatagatctaaatgttagagctgaaactacaaaacacttgaagtaaatacaggagtaaatcttcatgacctgagttaagcaaagccttcttagatgcaagaccaaaagcacaagtagcaaaagaaaaaagtagacaaactggacttcatcggagattaagatttgtgcttcaaaggacaccatcaaggaagtaaaaagacaaaccacagaatggagaaaataaatcatgtgtctgataagggacttgaattcaaaatacataaagaactcttagaaaaactcagtaataacccaatttaaaaatgggacaaggatctaaatggacatttctccaaaaattacaaatagccagtaagcacatgagaagatgctcagcatcgttagtcattaggaaatgcaaatcaaaaccacagtgagatggcacttcacacccactaggacggctgtagtaaaaaagataatgactggtgttggcgagggtgtggaagcattggaactctcagacactgctcgtgggaatgtaaaatggcacagctgctttgttaaacagtttgacgtttcctcgaaagatcagacagcctagtgatgtctgctgtgatatggtaattgggttaccctatgacccagcagttctcctcctaggtatctgcccaagagaaatgaaaacgtatgtccacacggcagacatgagtgtcattacatcagtgtcattagtcataatagtcagacagtgaaaataacctgaacgttccttctgctgatgaatggataaatgaaatgtggtatatccatacggtggactactttttgaccataggaaggaataaagtactgattgatgtgacaacactgatgaaccttgaaaacatgctaagtgaaagaaaccagccacaaaagctcacgtgattctatgtatatgacatgtccaggataggcaaatccatggacagaaagtagattagtgtttgcctggggccgggggcgttggaggaggacagaaatgactgcagtcgggtacaggatttctttctgaggttatggaaacgttcaaaattggttgtggtgatggttgcacaaccctgtaaatatactgaaaaccactgaattgtacttaaatgggtcagttatatgctctgtgaattatatctcaataaaacttaatatacagaaagtatacaataatatgtcattttgaagaaatacttgtttcttaatacattgatgttaaagtagcgacatattcatgttaaggtaatgacatacatgtgcataaatctgtattatcatgtttggggattttgggggtctggcatggctgtgtcctgggttggctccctagaaagctggttactttcatcctcctatcacttaggttaataagcatgaaattggttgctagatggcaaaatgtgcccaaaagcctgtgagctgctttggtggggggcccactggagaggcaaggatgcgccacccctcccccagtctgggtgggcacggggaagcagctcataccctagctgtgcccctgcagcctggtcacagccttaccccttacacccctttctgtgctctggcacgccatgctgccacccacttggtagccttctgctcatgtgggacccctgccttagagtgatttccgcgatgggctctgcctgcccagattttacccctcaattttgttgatgctctcttcctcctccaggcagccggttctgatttctctgccttgctctgaagccgcagctgtactttgcagctgtctttggaagtcagcatctctgtcctcctgtggggtagttgggtatccgtgagctgctcctctgggctggggctcaggtgtgactcagctctgcgtctgtggcacccagtcccggccaggtgccaaacagccctccattccaccacctccactcccttcccactcgatgcagatgcagtctgcatcacagggccttggcgctccaggctgggctcagccgcccctccccagccccgtgactcgtggctgtgggatgtgacctttctggtcttcctttccgagaagggtttgatagttccagataggcttgtgggtgggtagaatcgactcttatctccaagccctcatctgccacaccaacagttctgcatgggagcctcatcagtgacctcctgccaccaccccacagtcccagggtgccatgcagtgcctccagggccagtgccctagctctctcttccccaccactcatcaaaccccacctcttctcaccgcccagccccaggaaacatcttcatttctaatttcttccttttgttaacttgggagagggccagcatgacagctccaggcctgctgccaggttccagtcccagctcctccacctccagcctctgggacctcaagcaaagcgtttcctctcactgcttctgtttcctcacctgtgaagtggggatgagaagcacagatgttttggtccctggcctgacatggtcggagagctgtccacatgtgcctctgtctggggaaccacactctccacacgggggatggagagggccctgtggtgggatccgagaggctcagtttcagaggtgcctctgtgtggagttgggtggcagtgggccagtccctctccctcacctgggtcattggaatgagcacctctgccctgcagcttagagggccgaggtgaggaccctggcccagctgccaggcaggacatgtccgagtgtgagcagagcctgccggagcaggggttccccagggccaggactcaagcgtggctgcagccccctgcctgtgaggggtgcagagggccagggcccgctgagctgccatgccctgtgcttcttccccagttcccgatgggtcccggctcggacggtccgatgggcggcatgggtggcatggagccacaccacatgaatggatcattaggtgagtggcccctgccctcgccatgccccaccctgcctgggcagccagctctgtgcctcagctcctggctcagctgggcttggtacagagccctggccggccttggctgggcacacaggacgatcctgagagggatgccgcacagaaagccctccgcacagtgtgggactgggatggaagggcttagaggcccgaggagcccaggacgaggggagacccctccgtggaagagcaagcaagaaactgaattggattattttttctttccagggtcaggcgacatagacggacttccaaaagtgagtgtgcactcggtctccctggcggcgccccatctgtgtgggcaggttgttggggacacaggtgctcacctcctctcctctttccacagaattctcctaacaacataagtggcattagcaatcctccaggcacccctcgagatgacggcgagctaggagggaacttcctccactcctttcagaacgacaatgtaagcctcgccccctgcctgttgctctcgtccccacggcctggggactctttcctaacaagttgcgagctacggagccgggctgcagcctgccagctaagctggtggccgtgttatggtttttccacctcagttatttttttagcagaagtgtgcagccttgacgctgccctgagactgcctgctggtggggccttctggaggcagctccatgcaggctggatgcctctggcactgattaagctgatacggccgggagagccctgggctgagagagttggggcagtattgccccacgggtccatttccatctgtccagtggggaaaggttcgtgcagccaacgattttcagggctctcaacacgggttggctgtctgcttttctatagtgggcttctgtgtgcattctcatttgaagaaacagtgttatgattaagcagctttcaagaaccccagactgccagcctgggcaacatggtgaaacctcatctctacataaaaatacaaaaattagccgggtgtagtgtcgcatgcctatagtcccagctacttgggaggctaaggtgggaggattgcttgagcccaggaggttgaggctgctgtaagccttgatcgcaccactgcactccagcctgagtgacagagtgagaccttgtctcaaaaagaaaaacagaaaagaatcccagactggccccaccccagggcaccctggctgtgctctggctcatcaaagcccagttccctgcagtctggaggcctgcactgggcaaggggcaggggctgtgactgccattggagaggagaggatgactcagacaggggcaggagcaggggaggcgccgtcagctgccttagttcccaacagaagggcaggctggcactgagaagtggctcttagctcccgcctcctggcccttatcctgccctaccggccccctgcccactccatgccaccatgtgcccctcagctcaaccacatccccaaatgagccctgctcagttctgtgcagtcaccccaggctcttggcacctgggtgtgtcagcggcctccccacaatcctcacccccccccccttctctgcttctcctttccagtattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgcagcccttcctgacatgtttggggaatgtgggttggagtttattacactgattacaaaatgcaaggtgacttcttgggcacagtttttgttcctggtgcataacaagatgttttgtgtttgaggcgtctgccttcttttcctgggcctgcaagttctgtgttcttgtggagtcgcgatggccttggcggaaggtgggttgggagggaaggtatccatctcactttaaatatttgggggccgtctaaaagccattttccatttcttgtcttgcaaacacattttggtccgctggaatgtcttttatttttctggaagtagaaaaaggttcctcctggtgccctctgttttctatggggagtcgctatcggccaggagggccacagccactccctgctttctcccctcgggtgggactggcttcaccccaggcccccagcctcaagtgcctgctgttggcgactgttggcacagggaggttgatttttttttttcctaaacctccaaggtgtactgggagcccttgaagggttttgagagtagtgcagtctacttaaattttggaaagtgtatgctggtggtctcctgggagatgaatcaggtggggctggcaagatatggagagaggcattcccagacgacatttaggcaagaaatgctgagggctagggtgaggtaagctgctatggatgctgacttgcacgactagaaagaactttgtacttccctggagctctggggacctcattctaggcttgtagcaggagcggatgccgtggtgggtgggtgggagacagagggtccaagcaaagggcaggctcagcccatgtttataaagcccttaggggaccagatagcaaattcccaggtttaaatcttgtttgctgcaacttgctgtgtggccttgggcaaattagttgatacttctgttctcagttctctcatctgcaaaatgggggatggcgggttggctgcctcataggctgtgaggaggttagcaccgtgaagtgcttagaacagtgccgtgcacggactaagagcagcatgtgttcgctacaagtgatgttactcgtggggagagtccaaatgggtgtgttggggagtagctgggaggatctaggagattccatctggtccttccctcttgaccttggaacaaggtttcctaggcttttgctgagtacagacacctttgaactattggaaaagcatctccattggagagatgaagagactgaggctgcgactaacctgatcaatggtgctgacccagggctggggaaaggaggttgggtggatgggatatccatccgatacctgtgctccttggagcaggagtcaggcacagacgagagccatgggatcagggtgcctagctggaggaaggcaggtcacggggcccagcctgggaagagcgcctgctgtgtgctgtgctacccctcagcctggggcccctcggcagcctggcagttgccttcacaacacaaatggccctggtgcaggttagtttggccttcctcaggggcagatctctgagcaaagaactggttcttgttcactaagcattttcatcactgcctggggccaggccagagctctacatgagccagtggaaagatactgaaatgaggaggagaaaagggagcatcatgccagtccttccacaaaatagggcttcggcccatcactgagaggtgccggagtcgggggccagaccacagctttcctgctggagtcatcgctgtccacaggcacttgattctaggggtcggccggcctggggggccagaggtaggaccaggcctgagacaggaccccacacctgcctccctgctgggcatccccactgccccctgccccagagccaggaaagaaacttaaggcaagtcgctgacaccagcagcagcatagccactaacgcgctaggccagagcagggctctagcgggggtaagaaggctgctcagtctggctccctggtgacctgaggaatcccccgccccagtctcggctgtcccatgaagtggtgggctgtgttcccagattccacagactccaggagattgagcccagaacatacctggggtccctcagagggctctgaccctgaactgaggggagctgggcctcttggggttcaggccatggggctcccctggacttgagcagagtggctgggcagggtggggttacaggcggatgagcgctgctctgcccagccctgggctcactgggtacaagcactgggggcttggagttggggctgggggttggatgtaaaagatcagaccaacgagggtgggtgctgaaaggcagaggttctgttctctctattcccagggtgcctgcggagccgcagaacctggcatctggtttctggaattcagccatgcccttggtttcctgcctcccatgtcagccctccagtgccacaaagaccatctcactttgagcctccatagacttccttctttccatccatccactcgtgtttgctgagcaccccttttatgccaggggttgttctggcactaggggtacagtagtgaacagacacggaaggacagagatgccgtttgtggaggtgaggcaggctgcaggaagagctctgttctggcgagttaaatttgagatgctgatttgatatccagtaaagacatcaagtaggcaggtctgaactacagacataccatgggagttgttgccatttagagggtctttaaagccaccagactggctgaaatcatctagggaatgaatggagaagaggccgaaggactgggccctgagatctggggaataggagggacccacaaaggcgacagagcagtgagtagaagaccaggaaagtgagatgccctggtgaccacgagaagaaaaggggtgcagagaggagagggcttcttgctagtggggaacccaggtggccacgcccaccgtgactctgggaccaagtccacgctcctcacagcttccagatagctgcagggcatggaagggccatggacactcctgcttttccttgcccctcagcacttcacctccaactttgcagtactctgtggatgtctgcccccccagggcctttgttcctgctggcccctcctccttcccacttgcccttcagaacctagctcagatggcccctcctcctggaagccttccaggctggggtagctctctccctgggtccccacagcctggttcagtgtatgcttcccccatcaggctgggagctcctctaagccagggaccatgtaagagccctcttcgtcctgagaattgccagcacaggtcctggtgcccagtaggtgctcgatgagtgctcttggaataactggatgttgttgagtagccccagaatgtgctcagtggcacccctccctatggcaagctgtcacctgtgggtgggtaggcgcccaggtgtggggaaggaggtggcctttgtgggtacctgctactgccaatccaaaggagaccactctggccgtgtccacccagtaccccaggagctcccagagggcggggaccatgtctccctcattctgtaactcgctcccagcacaacacctggtacacagtaggagcttattaaatgggctgcccccaaaggaggtctacggtgagggacctcagggctcaatctccagtctggacctattcttgggttccatcattggcctagctggggaggaggagatccatgggtctcgtgtacacgtgtgtgtgtgtgcacatgtctgagtgtgtggtgtgtgggtgggagtgtgactgcatgtgtgggagtgtgatgtgcctgtatgcatgtgtgcgcgcatgtatgcctgtgcacgtgtgtgagagtgaacatggcaggggccatgttgctctgacaagctggcctctaagggatggaggtcctgccctgggcagcacgcccccctggatgcagtttttggatatgaggagatgtattctgaggggagagggtccctggatcgggggtcttccagcagtgaagcaggtaggccttatgggtcatggacatctgagtgtccatgttaaagagagagtcaagacaatcgggtcacctgcatgctttctgagactttcacccacagcaaaagaggaaccagggagatgctgtctaaagcccgagaggatcctgtcctgctcctgtgggttgtcacagagcctctgccaaacaaacacttgccccaggtccagcctgagccagctttgggagagaacagagagcagcctaaagtgaggtcccctccagcaagtccacctttccacctggcttctaagaactccaaacccatcgacttgaaaccttggcgaatggagcctatttgatccaaaggtggggaaacttggaagggaggtgctgtatccccattttgccagcgaggaagtggaggatctgacagggcagctggaatacaggaggggaaaagtggctttcccccaggccaaattagaattcccttgccactgaagcttgctggaaatgaactgaagaacttttgaatggaacaaccaggaatttaaatatatgagacagtgagaaatacgttcacaatgggaatgtcaccatttcatttccaaaagtctgctgctggaagttcctctcgtggggtttcgctatccagcatgacccggcacagcactctccctgcagcgtgctcctgctccttcaccagctcactggctggggagcctgtactgggcgggaggctggctgaggccctcaggttccgctgcatcacttcctctcctgcgttgaatgagggagtgaggacgaagctggtagacatttgggatttggagaagcaaggacctgtctgtggagggggcagctgtcatgacacacgagcttcccagctcttcacactgcatcatgtggtctctaagcctgtttcctcatctccatggggacaataaaaaaaaccgccagtcctgcctgccccactttgcagatcagctgtactttgcagctcccttgacacaaaagtgtagttgggttccaggctccacaacttagcactaaggccagcatccgagctgccctcattcagggtgggttgggaggacaggctgcccaggcctgcccggcaaccctggcccccttccaggcagtcctcaagctacaaggtcatctgctgatggtccgcttactcagagcctccgtcccactcgctcagggctcaagttcacctcaccctccctcctctccaagcagtctccaggggcttcagcctgctcaggatcacgccaagccatcaccaccacttgccccaggatccccgcagtggcctccagctggactccctaccgccatcccaccagctcctcctctgtactcccaacagagtgttgtttaaaaaaaaaaacgtttgactcagcaattccactgctaggaacttacccaatggctctgctggcaaaactactctaagatacatgaacgagggtgctcactgcagcattatttctaataacaactggaaacaacccggactgccatcaacagatactaatgtggctgctcaaaagaacgaagagatcctatgtggtgatgtggcaagagcctacaatccagagacatcaggtgaaaaaggaagtgcagaacaggctgtaaataggatgactcttcagtcatgtatatatgtgtgttgttatgatacatacacattttcaccaacagcatggaagaaacttgaagctctgttaaccttagagaaaaggactagctagggatcaccttgggtgggtcgacttatctttccctgaactctgaacttttatcatttatgtataattgtttcctgtctgtaaaataaaaagtaaaatgggcagcagggctcagagtacccggagccccaggtcagctgccctaggaggtgaggtgcttggtgttcaggcccctccctagctggccactccagccccagccaagcctccggcctccccacttccagtcacttcctgtccccatggtcctctgtgccttgctgcttttcctgctaatccctcaagcctaaaaagtaagctttcaagtggaaagagcccaagcctgggaggcagagacacaggctggacgccactttgccactgcctagctgagagctcctccagctgctggaagttcccacactaactgctctcagcagtccctcagcaggaattacagaccaacaaagccacctcgcccaaggtcccacccgctgtcaggaagcagcacatatccaatggctggtgccaggccaggggtgtttgtagaaggctcaactcccttgcctctggctccagagtgcccatgaactgggtgaggcctcagaggcagccacactgagcttgggcccgccacccccacctgctgctgccttcgctctccacaggttcctgtcctaaaggttctccccaaataaaagtctctaagtgtttcctcgggaagctgacctatagcaccaggtgggtgaccgtgggcaaattccttaaattatccgtgttttcttcttagggcccagaacagtgcatggcacatgctaggcatgcaatatttttcttgaatatggaaatgacatttaccttgtaaggggtgtgtgcagattaaatatgctatgtatcaggtgcttggcatggcagcagtgtctggcacagatcaggacttgacattatttggacagagaccagctgaaccaggggtgtacttgccccattaaccaggatacgagggagaaatctacaataaatatgctagcgagattttctgcagtcattgtggaatgtgtccacaatttaaataatgccataagaacctagtgaccatcagcgtatctgccatgtggcagacactacacacacataacccagagtcttcaacgccaggtaagtcacattagccccaggtttcagatgaagaaatggaaagagacagatgaagatccttatctaagatcacaacatgggtcaagggcagagctgggcttcagctggggcaggtcaggctccagggcttggacttgtgtgggcgcccttcccgatggcaccctcataccaaacacaggcttcagtgcaacgcaagggctctttattgtcagcgagagcagcaggccaaacgggcactgaggctccacggggcccaggccctcttccgtggaagagaggcaagaggggtttcaggattcagaggggtcctctgctcacgcagcaccatgcaaatatagagctaaaaactttctgaatgtctctggcttgaaaccaactggcccaacaggttcctggaaagaacacggttcattaggatcctgctactaggtttaacggcagcaattaaaacaaagattggattgaagtaaatcttcagtgcctggacagtaactttctttttctgacatcgtctctctctcggactaagaaggggcattgaggggctgtagcctgggaggacaggaagcattcccagcccccttcagccaaaacaactgttgacgctgctctgctcccgaggccctctcacttccaccaccaggaatgatggttgaaatgggctgctgccctctctaatcccagggacaatcatccctcacccattccacacacatttattgggcacctgcttgctttctgctgcgcctatatcctgtgctggaaacagacacagcagtaacttgactctggttcctgtcctcaaggagcttaccgtcagctgatcaaatagtgaaaatgaaaggagacagaccccactgcagaagtaggaaaaagaagaaagcaggaagaaatgactgacttgccgacatttatacatggaagggtgagcagaatggggcagaaagaaaaagaaaaggaaggagacttcagaaagcccagcacatgcaatagaagaagtagaaatgaaggcaggaagggcaagatcgggctggagcccagggcgaatgctgaggggtggagcggcaggagatgaggctgcagaggtgaggagaagctgtctccaaaccacaacaggcccagccctgagtcagtatcctggaagggagaggctgagggaagagaacctgaagacacagagtcaggagggaaaacctgactaagagcagagagcacggaggtggctggtgtgactatgcaggtgaactgagggtgtctggggccaaagcaaagggcacagacccagcaggcatttcaggtggaaacagcactgagagctgctggagaaccagttcaagaacggacctgctgagaatgttcaaaggctcagcgactccatttagcaagcccacactcaggcctgtgtggggcctggttggtcccagagcaggcagtacccctactccgctttcgcagtcctgaccctgctgtaggtctctccagggtgcatattactgcctgatgctctatcaggaatttatttagatactgctactgcccactacacagagagcaggcctggaccccgtcagctgagcagtggggtgcagcacaatggtgccgcaggaggaactccgtatctgtgggatgaaacaaaatgaatgcatccccagaccctgccctcaaggatctaggagcttggagttctgtttggtggaggaaaaaaaacatgtgaagaggttctacgcacagcaatgtgatcgtgctctgatgggggaatacggaggccagggcagcccacctgaggcacttaagtgagggttgggatggggacggtggtggtcagaagtttcccaaaataagaaacacttatgctaaacctggaaggacaagtggaggatagcctgacaaacagtaatggggaggggagaaggcaagaagcctcccagacaaaaggagcagcacctacaaaggccagagctaatgaagccgcagagcaccctgggagctgcgaggagctggattggctggagggtgcaaagggaagcaggagctggagtggagcactgggcagggccttaggtaggggcgggactgaaggagtcctccaggcagagatcccgggtgggaagtccccagggccagggctctcctcacagagcaccccagcaatcccacctgaggctcacaccaggtaggaggaggcatggccctcctgggtcaggcaggagatggctcaacttaccacaaccactctctttttgatcactgggagacaccaaaaatgctgatagaggagctggtctgagtccacccaggccaaattcttgacaccctcgttacagtccaggtctgtggtattcagttgaaacactaggaaatggaagacacgtccatccgtgcccacgctctgcaccaccacgggctgctccaagaccttggcatcattctgagaggaaaaggggacaaggaaaacaaatcagaagctgtggagtgtaaggaacagcacggcccaggcagcttctagttcttccctttacaacgtccacctacgtccactgaatggcttctctttgggacaattaaaatagaatgaggagttcagggcactgtccagggccgggccttccttcacccaggctggctgtgcctcatggccccagggtgcctgctcttctatttgagcacatcaaagtaatagttcctgccactgagaggcgatttccaggcaagccagagttcaggcaggccagctggggggttaatgacagaaatccctcaaactcctggcgttacttgataaggaccacagtgacatcagctatcaaatgtgaatccggagggtcaacggatagatataatctcattcagttctcaccccatttgaca

SEQ ID NO: 569 - DNA, 2290 bp, Homo sapiens
agtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagactgacccttggttatcgttgcagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgccc

SEQ ID NO: 570 - protein, 266 aa, Homo sapiens
MPGGPIPPGFFQGPPGSQPSPHAQPPPHNPSSMMGPHSQPPGGVPGTQPLLPNSMDPTRQQGHPNMGGSMQRMNPPRGMGPMGPGPQTDPWLSLQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 571 - DNA, 43400 bp, Mus musculus
  misc_feature (1)...(43400): n = A,T,C or G
gctgacttgtaacaaggtgaaaacctctggggaaaggaaagtcttactttaaagttgttagaaaacctagatctctgtttgaaaagaatgaagccgagagggcccttgctttatgctgttctgttatttactttgagctcaaccagaaggccaagaggtgattgctgctttttttttttttttttttttttttggttttggttttggtttttccgagacagggtttctctgtgtagccctggctgtcctggagctcactctgtagaccaggctggcctcgaactcagaaatccacctgcctctgcctcccaagtgctagaatcaaaggcgtgtgccaccactgcccggcttgttgcttattttttagtgcaggtctaaaaacaaaattgttttcatttttcttttcctgtttttgttttttcttcttttttacattcttttaaaaaaaatctattgatttatcatatatatatatatatatatatatatatatatatattaactattgctctcttcagacatcagaagagggcatcggatcacaacagatggttgtgaggcatcaggtggttgctgggacttgaacacaggacctctggaagaacagtcagtgctcttaaccactgagcctctctccagccctcatttttattttcttagactatattattattttatctaatctttttttaaacttttttctttttttaattagatattttctttatttacatttcaaatattatcccctttcctagtttcccctccaaaaatctcctatccctgccccccctccccagctccctaacctacccactcccacttcctggcctggcactcccctatactggggatagaaccttcacaggaccaagggcctcttctcccattgatgaccgactaggccattctctgctacatatgcagctagagccatgagtcccaccatgtgttttctttgattggtggtttagtcccagggagctctgggggtactggttagtttatattgttgttcctcctatggggctgcaaaccccttcagctccttggatactttctctagctccttcattgggaaccctgtgcatcatccaatggatggctgtgagcatccacttctgtatttgtcaggcactggctttattaggctcctgtctgctagctcttgttggcatccacaatagtgtctgcatttggtggttgtttatgggatggttccccaggtggggcagtctctggatggtcattccttcagtctctgctccaaactttgtctctgtaactcctttattttatctaatcttcaaactgggttttagggcatttgggggatgtatctcagggcctcactatacttagccagtgctctgccactgtgctacacacctgaccaacactagacttgattttatcacttcctgtattctatctcagtcttctcaacttcagtaactaaagagtcagggtgatatgcaatcctgtttattttgttttagtttttatcgtgtgtgtgtgtatgtgtgtgtgtgtgtgtgtgtgagagagagagagagagagagagaaagagaagagagagagagagagagagagagagagagcgagctcagaggccagaagaggacctcagttcccttggagctggaattacaggtaagttgccctctgtgggtgctgggaactgaacttggatcctctgtgtcttagttagggttattattgctgtgatgaaacaccatgaccaaaagcgacttggggagggaagggtttatttggcttatagctccacattactgttatcaatgcagtgatttaagtaagaatgtccctcataggctcatacatttgaatgcttagtcaccagagggtgccactattcaaaaggattagggagtgtggtcttgttggaggaagtgtgtcattgggggatgggctttgaggtttcaaaagcccatgccaaacccagagtctctatctctctccgcccacagatcaggatgtagctctcagctatttctccaatgcttgcctgcatgctgccatgctctcccccacaatgatattggactaatctctaaactataatcaagctttcaattaaatgttttcttttataagagttgctttggtcatggtgtctcttcagcaataaaacagtgactaggacaatcattgaaggaagtcaggacaggaactcaagcaggccaggaacctggaggcagagctgatgcagtcatggaggaatgctgcttactggcttgctcctctaggtttactcagtctgctttcttatagaactcaggaatacaagcccagggatggcaccatgcacagtaggctaagccttcccaaatcaagcactaattaagaaaatgccctacgggctagccctcagcctggtcttatggatgcattttcactactgaggttccctcctctcagatgattctagctgtgtcaagttgacataaacctagccagcacactctaccacagcagtatatactcttaaccacagagccatctcttctactgcttgcttattttatttcataaatgtatgtgatggcttgaaagaaaatggctccaaggggttcatatgtttgaatgcttgttctccagttagtggaactgcttgggaaggattagggggtgcggcctcattggaggagttgtagccttgctggagaaggtatgtcagcagagctgtgctttgaggttttaaaaacccatcccaggtccagtgtttctctttccctctgcctgctgcctgcagacatcatgtaaagctctcagctactactccagcaccatagccgtctgcttcttgccatgttgatcactgaaacttctaaactgtaagcaaaccaactaaatgctcctcacattaaatgaactgtaaagacaatgtgttagtcagggttctccagagaaacaaaattgatagaataataatctatattaaagggggatttattagattggcttactgtttgggtagttcatcaatagctaccttcaccagacagactaacatcccaatagctctgagccttgaggctggatgccttcgcattcccaatttggtattgacaatggaggattactggggagtcattggtcttcagttcacatagaaagattgaagaagctgggctctgatgtcagtgaagaatggcagtggcggcagcagtggcaacagtggggtagatgaactctatagcaatggaaaaagcaaataggcaaaaagcaaatgcctttcttcctctgacctcatatctaaggttggcaccagaaggtgctgtccacattaagataggtcatcccacttcaagtgacctggtcaagcaaagtccttacaggttccagagacttgtctcttagtcaattccagatgcagtcaagcgaatcaccaagactgacaatcatagtggacaatcaaaggatccccctacctcctgtttttcttcctttcttctttttttttttttttttttttgctttaaaataaattctcactctgtggctccggctgacttcagacatagctatcctcctgtcttaatctcccaagtgctgggacaataggtgtgcaccagaaatttttaaaaactaatttatattatagtctttgccagtcactaaatatgtatatatatatatatatatatatatatatatatatatatatatagtctcaacatgcagttcccgagccatggcatagaacttactctgtaggccacgctgaacttaaactcacagaacatttacctgcctctgcctcccaagtgctgggtgtgcccccatgttcacctagattgtgtgtcttaaccagaaatcaactttttttttaaagcttcctgaggtctctctgcttagcctacttgctgtgtcttcacatgctggcgtcttggcctaagtcagtggttctcagcctgcgtataatgacctgtttgccaaatgactctgtcacatggggtcacctaagaccatctgcatatcaaatatttacagtataattcataacattagcaaaattacagttatgaagcagcaataaaaataatgttataagctgggcgtggtggcgcacgcctttaatcccagcactcgggaggcagaggcaggtggatttctgagttcgaggccagcctggtctacaaagttccaggacagccagggctataaagagaaaccctgtctcaaaaaacaaacaaacaaaaaaatgttatagttgagtgtcaccacgacatgaggaactgtattaaagggtcgaagcattagaagtttgagaaccactggcctaagttctgtctgtgtcctaacttcttttgtaaggatgccagtcatcagatgtccatgcacggcacctcattttactatgtctcttcaagccctatctccaactccagttacattgctgagagttaggactttaacataggaacagtgtgacacacgattcagctccttatactatgaaagggcttactataggcattaaatggaatagtccaagtacaggatgggggacctagatgtaacacaagtcgaactgtgcacttaggctggatacagannnnnnnnnnnnnnnnnnnntaaagtgtccacactttggtcttcgttcttcttgaatttcatgcgtttggcaagttgtatcttatatcttgggtatcctaagtttctgggctattatccacttatcagtgagtacatattgtgcgagttcctttgtgattgggttacttcattcaggatgataccctccaggtccatccatttgcctaggaatttcataaattcatttttttaatagctgagtagtattccattgtgtaaatgtaccacattttctgtatccattcctctgttgaggggcatctgggttctttccagcttctggctattataaacaaggctgctatgaacatagtggagcatgtgttcttcttatcggttgggacatcttctggatatatgcccaggagaggtattgcgggatcctccggtagtactatgtccaattgtgatcaaaactgcatggtactggtatagtgacagacaagtagaccaatggaacagaattgaagacccagagatgaacccacacacctatggtcacttgatctttgacaagggagctaaaaccatccagtggaaaaaagacagcattttcaacaaatggtgctgtcacaactggaggttatcatgtagaagaatgagaattgatccatttctatctccttgtactaaggtcaaatctaagtggattaaggaactccacataaaaccagagacactgaaacttatagaggagaaagtagggaaaagcctcaaagatatgggtacaggggaaaaattcctgaatagaacagcaatggcttgtgctgtaagatcaagaatcgataaatgggacctcataaaattgcaaagcttctgcaaagcaaaagacaccgtcaataagacaaaaaggccaccaacagattgggaaaggatctttacctatcccaaattggataggggactaatatccaatatatataaagaactcaagaaggtggactccagaaaatcaaataaccccattaaaaaatggggctcagagctgaacaaagaattctcacctgaggaataccgaatggcagagaaacacctgaaaaaatgttcaacatccttaatcatcatggaaatgcaaatcaaaacaacactgagattccacttcactccagtcagaatggctaagatcaaaaactcaggtgacagcagatgttggcgaggatgtggagaaaggggaacactcctccattgttggtgggattgcaagcttgtacaaccactctggaaatcagtctggcggttcctcagaaaactgttcattattttttgtcgagctcactgattgcacttgcctggctggccagggaaccatagaaatcctcctgtctctaccatgctgcctgtatactgctgagactggtggggcctttgttggttggttgttgtttacctgtgtttgtttttttttaaacatggatattgaacccaggtcctcttacctacatggcaagcactttaccaactgagccatctctccagtccccttctttttaaaattactactactgctgctgctgctgctgctggtggtggtggtggtggtggtggcaggttttttgagacaaagtttctctgtacaatagccctgactgtcttgaactcacagggatcttccagcccctgcctcctgagtgctgggattaaaggcgtgcaccaccatgctcagctttattttttattttctgaaagtgtctcatatagtcaggattggcttaggatgtagttcaagataaacttgccctcctgatccttctgccttcacctcccaagtgctaagattaaacacatgtaccctgacacttagtatgcattctcctggtttctctgcctactgctgctgctgctgttactgctgcttgctgtctgcctttccaacctccccaacctcctgcttgcccctttcggtaataaatctccttcgtgttgagaatttggtggctggatgtgttcctcccttacagatggaacctggggtctcatgaatgccaggaaagcactccactggactatacatccccagccttataaatagtggggctccttcctgctatattactggcgaagttgtcttcctcccaccccggcctctgaagcattggcattgcaggtgcacaccaccatattccattttttggttccattataatctttccatccttgttccttcttggttcccatgagatgttcttcctgtgaacagacctcatgtttcctctcttcaactgctgtaagtttgccctttgaaatgggacacatcccgtcccaggcccttacagctcagcaagtgcatctctaaggctcctgctgtatctcttttttggagacgtcacttattattaaactttaatgataatcacttatatttatagccctttttccatttacaaagctcttttctatccattatctcttttaatcctctcagcatctgtgaggaggaggaagtgtgcttttctctactttacaaatgaagaaaataagactctcaagagtaacatcagaacttgggaggctgaggcagaaggattgctacagttggaggccagctagggctgcatagtaaaacacagactaaaaacaataacagcagcagtagtggcagcagcagcagcagcagcaataacagtagcagtagcagcagtagcaacaagaagcctgggaggggtgcacacctgtaatcttagcatttgtgaggctgaggcaggaggatcccagtgagttcaagaccaacctggagtatgtgtctcaaacctcctctcacatcttccctccctaaaaaatgtagtctttgacttgtgagccacacagatcatatgtggcagagtttggtctcacattctggtcttttggttttgaatagctcatgtattagatagtcttctattaaaaaaaaatcaagcaaaagcccactgaagctggttaatgcatgcctacaatcccagcacttggaatgtggaagcaggaggaccagaagtctgaagtcatcttcagttatgttttgagttcgatgccagcctgggttacaggaaaccctgtctcagcaaataactaaatcaatatataagctcctactatctcttttagagaagtgcagatgaattatttaagactatttagattggaaacaacaacaaaacataagggaaactggcttaagcagaaacaaaatttactggcctaccccaggatcaatccgggaactgggtgagaagggatcaatggggccaatgcactattgtcaaagcggtgtggacagaacttcactgagagcctctgctctagagagggaaaccaagacccagccttgcaggaactcgcagtgaatctttgatgtccttttcttctggatggctcagcgtggctcagcaggctaggaaaagaataatttaagacaaagcagggaacagggcaggagattgcttggaaatcacccaaactggaagcatctgcagcaggacccctctgtcttcttacatcttccgtctcccgagtcctcttgactccagtaccccgcattggagtgccacccttcagggggctcatccctgcttattagatgggcgagatggtttgtgacaggttgacagggcagttgtcttcttccatggcatgtcttccttggcttctatccccatctgcaaaatgggaagaggtattggaggagattgcttgccccatcccttctgctcatgcttccaggaccacaggatccttggcaggtggaaaggaaggctccttcaaagagagtggaaagagaagccaagttcatgccagtactccgttcctggggatggtgaattcacatggacctgaggtctcaagttgtggaatttgctaggtccattctccctttataatctgggattcaaacgcctgtttcttataaagacatcaaacatccaacaaacccacccacaacccccaccctgttaccaccatttcttaaaagttgaaaatgttgatctaggatgtcgctctgttagtagaatgctctcctggtttgatctccagaaacgtacaaaacagacacaaaacaagcttgttggtgcatgcctgcgatttcagcactcggatagaagcaggaggattcctgcatgttcaaggctaccctggtcttaacacagtgagttctaggccagctagaactacttagcatactctccccaaataaagcagacttttacaaaatacataatcagaaaacaaaaacaaaaaacaaaaaggagaaccaaaaaaaaaaaaaaaacccaaagaccaaaagaacagtttcttatttcactggaaaaagacatttaaaaatatgacatgagtttttgcatatagatatgagtttcaacaaacatacttctctgtgtggtccagtgtttgggatccactaacatgtgcgtgctcgagcacacacacacacacacacacacacacacacacacacacacacacacacacctctataaaatggggcataatttgtccactttacagataaggaaacaggtcccgatagctcaagttcaaggttagtgttagtttgtctgggtttcaaaggctaagcaatgactgagtcaagctgcctcccaggagtgcccctgagggtgttctttggcctaatcaccacccttgactttgaggcgttgttgtttagatcttcatgatgttcagacttcatggcttgcatcgacttgggcacgggggaggatgtaaaggaaaaaccagcttgccagcccctttccctcctggttttggtactcagcctgggtcttgttccctggctccatctccttgttctgtgggccaaggaatccccaaggctggcgtggggtgttaacagtttaggagtttccctctcccaggggggtgttgacagtttcctaggagactctgaaaaccttcaacgcctctaagacgcaaaggcgtggaagcagaatggagagactggaggcattgtcatagatggtagggggtaatcaggaatcaagagattgagttcaacgtctatcaaataatcctcatttcgttccttcccccatttccacgggctttgtggggagctggaaccccacaactcaggttgaccgaagggagtcccagtagtcaggaggcctgaagccggggctggggtagaggctatgtttctggctgagggacctcagggtcaccgtgcctgaccgtacctctgactgtcagaacctggagggcccctttccctcctcctcccccgccccccttccattcctctcagttctttacgcccgcgcgggaacgcgccccggccgcgccgcgccagtgcccgggagcgcgcgcctcggcgcgggagcgcgccccggggagagccggagcaagatggaggccgcgcagaggacgccgcctgggccaaggcaaccgctgttaggagcatcgagcaccggagcttgagccctgccggtcccggatcagccgtcccgactcggcccaggttggtcttcccacatcccttctccgcggccgcagcctccgcgcgtgtccggcctgggcgcggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcgtgccctcagtaccagcccctgaacaacctcttctcttccttatagtagaagcgtctatcctctttcagatcccctttagtacacccagtcccaggacccactacccctaataacagctccaatatgcccttcccagctctctctattcggtgcttgttaatgctccaatattgatctccatctttcattacatctccccacgtccccttcttaatccagcaccagttcccaagccccctcttgaactcccccacgagcactttctggcacccccctacttccagatcccatgtcctcatcccagccccccccaactttcccatgactccttctcaggccccccaataggaggccttcaagtcgccgccccaacactgtcatgaccccctcctagctccccagtcagcccccaggttcccagctccgcctcaggccccgcccttgcgagttcctagactcagggctgcttctcgcgtgcgtccccagctcccgccccgcggccggtggtcagtcctgggccggcggccccctgtcagccgctgccgccggccccgcccccgggcaccatgctgccctcgcaggaagcctccaagctctaccatgagcactacatgcggaactcgcgggccatcggcgtgctatgggccatcttcaccatctgcttcgccatcatcaacgtggtggtcttcatccagccctactgggtaggcgacagcgtgagcactcccaagcctggctacttcggcctcttccactactgcgtgggcagcgggctagcgggccgcgagctcacctgccggggctctttcaccgacttcagcaccatcccgtccagcgccttcaaggcggccgccttcttcgtgttgctttccatggtgctgattctcggctgcatcacctgcttcgctcttttcttcttctgcaacactgctactgtctacaagatctgcgcctggatgcagctcctggcaggtaggggaggagtgggcgcaggacccttagcaaagatgctaaagatgggagctctttcttggaagagtcagggctaaattcctcttctctgtattgagacacttcaggccagctctcagcagctactggggagaacattcaacaacagagagccaccttagggcaggggacaatctttagaattggtatttggatccctcatgttgaaagctcgggtctactgatggattagcactatgttcgtgttttgggggtctttattggcggcgtttgaggaggacaattttttttcctgagtgagggcttactataagtatgatcaatttctgttatgctgggggcgttgatgcagaaattggtgactcgagagacttgtcttggaccttgaactcactgacattgttggcttttttgaggtttggtttctcatctgtaaaatgatgcagaggagaaatcctgtcctgagagttgggaggctatctgtggtgttggtactgagaagatgtgtgtggaaagcttgtaacacaagcctctgaagagaaggtttccatccttttaaacgtacccctgacccacattcaggaagggttctgtgccacagtcaatggtgatgagtcctttgaaatctctgaactgtttggctgggatagtcatcttcccctaaggctcagggaaagaccttttgggaatgagaaatgctgagacagtttcccctgatccattagagtcctgtgtccccacccactcttcgatcgcagtcacattttgaaaactcagcagcctggatatttgcctaattgcaggaaaggaaaagagagttggacagggcaaagcggagcctagggactgaagggtggggaagaagatgggtagaggctagggggaagtttgaagccttccagggatgggaaggaaaagagaaggcttgataatggtgcattagagatgcttctttgcagtaagcacttcagatcgttcaacaagtggtcagcctttcaaaaggggtgcccaaaggaaaggtgatagatgacagcttgtaagcaatcccaccgcaggatatactgcacggacttgtctctgcagtgtggtatgtgttcacttgaacctttccattggaaagaaatctccatcttttcaaggaagagtgtgagtttttcaaaagggctggaagtcactcaaggtcaagtgctaagaatgcagtagtgatcaaattaagacttgtcacttgggctgaaggccagatgtgatgtcaaggccatgaagctagtttgcttccccaagtggactcttacaaatgtagggaggaatgtctgtcctactggggggtattgaaggtctgaagatggctgattggaagaaggtagtatatattcagatatggacgttcttttatttttaaaggtttcttttttatttttagttatgtgtatgtgtgtggggtggtggtggtgataaggtacattcaaaagcagttgagtgtggaggccagaagagggcattggatcccatggagctgaggatacaggtagttgttagctctctgatatgagtactgagaactgtgttctggtcctctgtaagagcagatagcattcttaaacatagagcggtctctccagccctcagatatggacctgtcttaatgggactctttaagaaccattgaaaagaacagagaaagagaaatgaagggagtgtggatattgttccatgttttccagtggtgtgcagaggtgacagcatgggtttccgttgtgttctcccctgaaggcaagctggaaagatatatgctcatctagaaaaccaactcatcaactctaatttggactgtgtgactaggatgctgacctcttggcccgctgttcctctgtaatccgtgtgagattccatcctgggatttgatggacagtccaactgtgtgatcactgaaatttaacaatcttagcgatcagcaccttcaaacttcatcttcacttctcctgtttcagagcggcaactgccacagacctgtgaaagacttactcaaagtcacaccactagtgtgggagtaaatccagtctatgggcaggttttgttgtttggttggttggttgttggttggttttggcctcctggtccaataccttttccttttcctaaggactgaggaggcagttggcagagttaagaacttaggtgcattttcctcagagatttctgagttctctagataagtgactgatacacattgcttaataaagtgacgttaggaaacaggccagctttggactgcaaggtatgggtcacaaatgccacgacttacagtctttttactttttcatgacattcacttgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatccttttgtagtagtatctgatgatgctttggatttcctcaggttctgttcttatgtctcccttttcatttttgattttgttaattaggatactgtccctgtgccctctagttagtctggctaagggtttaatctatcttgttgattttctcaatgtaccagctcctggtttggcccatcctctcccctcactccctctgcctggctatgttttgtttttcttacctattctgtggccatcctgtgcacaatgctacaatgctgggtatcttagtcactgttctattgctgggagagacaccatggtcaatgcaactcttataaaagaaaacgttggttggagagatggctcagcagttaagaacactgactgctcttccaaaggtcctgagttcaaatctcagcaaccacatggtggctcacaaccatccgtaatgagatctgacaccgttttctggagtgtctgaagacagctacggctgtcctagaactcactttgtaggccaggctggcctcaaactcagaaatccacctgcctctgcctcccaagtgctgggattaaaggcgtgcaccaccactcctggctacattgttcttttaaaggcagtttaaccataaaccagggcacacagtaggacagcaggttaagtacatagtcttaaataatctcaaggcatattattggctcagctgcaaggttccaataaagttctgtccctttatggtccaggggcatttttagaaaaatgtacaactgcatccgaccacaagaatcttaagcctacgatgtgcagtccctgctctcgggaagctgactttctacttggttcttgatattgtcagcagccctggagtgatagacgacagcccatcataaataaaataaatgagcagaattgggtttattgtcttatatgatttgaaagtcaggagtttctgacttcatgtggctgcagatgctcaggtgacatctgagggatcctcctatcccttggtccctgggccggctcattttaaaacccactacttcttctttttcattttcaattgtatttatttttattttatgtgcattggtgctttgcctgcatgtatgtctgtgtgagggagtcagatcctctgggtacagacagttgggagctgtcatgtgggtgatgggaattgaacccaagtcccctggaggaacagctaatgctcttaaccattgagccatctctccagtccctagtccactgcctcttaaaggtaaaaaataaagtggctccaacttcacatagctcaagcttagcaatgactgtggaaaatgaatgccagcagccaagtgtggtggcagacatctttaatcccagtactggggagagagataaaggcaataggatctnnnnnnnnnnnnnnnnnnnnacacacacacacacacacacacacacacacttacactcacacaaagaatgatggaagtaaaagtttcaaggctgaattctgtcagcctgactcctgcctggtagcagcctcctaatgaatcgtggtgactctgtccaagacccaaatgtacccatccctgcaacatggctcaatagtgagaaaggtgagtccccacagagactgtaaaagaaggagtaagatgaccacagacaggtgttcccaacccctggggactctgatgtgtgctgaactacaaatgttgtagatacacagtcaaggctggctatggcttagctgggaatcaagactggaggtgggtcatgttggcaggtgcaggctgtatacgggttcagtgtgaacacagggggttccggatggacaggtgtgtctgacttgtgtgttgtatctctattggagcaacagatttgagatggatggatgagtgccgggcaggggagtttggattctaatgactgagcagtttgaagttactgtgactgttacaacaactcaaaaacactactagctttgagtggtgcccaggactgtgatcccagaacagggtcagccaacacgggctacgtgagatcctgtctcaaaaagaaaaaaaatgtcagcatattctaagacgttactgagtaccagactgtgtgctaaaaagttatttgtcccaagccatagatgtgctgggtcacggaaccattattgtgactcagtcctcctacctgaagtcagaggacaactttgtggagttgattcccctcctatccctatgtgccttctggagacagaactcagcttgccaggttttgaggcaagagacttcccccagccatcttttgttgttgttgttgttgttgtttgttgtttgttgtttgtttttgtttttgttttttcgagacagggtttttctgtatagccctggctgtcctggaactcactttgtagaccaggctggccttgatctcagaaatccgcctgcctctgcctcccaagtgctgggattaaaagtgtgcaccaccaccaccgcccggctcccccagccatcttgtccgctggtttctatgccagatgtcttcacactgttgccccacccttccgttacaatgacctgtccaatctcacacatctgggatagaagggaagctgagtctcagtgtgagtactaatgagtccagaaccttccgctgctcagctggaacaagagacgtgaattcacagtcgatgggtgagagccgcaagagtcagaaatggggctgaggggatccacaggaaacagagaggagacccaagctgcggcctggcggcacatgccagcatcagagagacctcaggcaagaggatggtgtcttggaggacagtttgggctacaaagtaagcaaagtagaagagatgtgaatctatcttcatcactgcctgtctaccatgaatgagaccttgggttcgacccccagtgcctcagatataatgagacagaggaatgtgccaatacttcccagctatgtggtcttggacaagtgggtttgcctctctaattctgttttctcatctgcaaaatagtgttgtacctgtttccaaggatgataggaaagaatggaacagtggtttttaatgcgactcccatgtatggtcggcgcttgagacagtctgagggaagccattgtgaaggctttgctgctgagtttgaactcattgcgatgaccaccagccttgagaagtcgtcagccatcagcagaagagggaagctattggcttgcctgactctgctatgaatgaaggaagatgctcagagagaaggaacagctgaatggtcacacagtgggaacctaggcttctctgtccccagaaggaaaatgagcctggcccctgttcagccaggtgtgagtgtgtgcacatgccaggcttcacctggtgtgcagaggctggcaggggaggcggaagctgagtgctagatagtgtcatgcaggggcgagcagcttcaggctgtggctatcacctgggtcacaggctctgggatcagaggtcacaggagtgggcataacaggaactcaagacatgcacttgtgtctctttctacgtcctcagactttggttcaggttgcctttgggaatgaatgatttaattatttagataggctcttgataggcagccctagttatattttagcttgcagcgatcctcctgcctcagcctctcttagaggtgggaatacaggcccacattatcacacctggataggtttcagattttaatcatataataaaatttagaagtttagttacattgaatatgtattgagtatacaaaatttagcgatctctggttacattgctaggacattagcacatgagagggactccctccttccctctctccccacccctctcactttctctctcttcctttttccttacttcctcatgcctctctccctccctctcacactgacccttcactggaggactcctctgtacatcagtgtgctgggctctgggaatgctgggtaacagaccttgctcagcatcttagagctcaaaagacaaaagggggggaggagtctcctcctgtggcacacacatgaagtgactgggtcacagaggtgctctagggtgcacagctaaggacagatgcacatgcaggcagaatactcatacaggttacatactaaaataaaataagtacttttttgtttgtttgttttagaaaagttgagtgggcattcacctctcctagcttccttcacttacacgaccagtgccttaggtgcttgcagccagagcttgagctgaggttgttgctagtctccctaacatgggggcattattctttaagaggcccttaagtacttaaactgctctgggactaaagtagttgataatgatgaggcacaggaatgggaagtaaggggaaagatgaaaaacccagccttgtccactgcacccccagcccagatctgattgcttctccagtgcctaagtgacacaatgggagtcttgggccagaaggctccactcggtgtacagtaggtgcctagtaagtgcccattgctttgttgttgctttggttttagtgctttttatttttgagatagcatcttactatataggccagctccagtgaaccttgtgtcaatcttcctgtcaccttgtgtcaatcttcctgtcttagactttctttcttttttgtttgtttgtttgtttgttttttgttttgttttttattaatatgtaagtacactgtagctgacttcagacactctagaaaagggtgccagatctcgttacggatggttgcgagccaccatatggttgctgggatttgaactcatgacctttgtaagagcagtcagtgccatctcaccagccctgtcttagactttcaagtactgggagtgtaggcacaagccactatgtccccagaagtgtcctgttgaatggataggtgaaagatgacgcctaagtcctgactcactctaccacccagctcctttggagggagcagatacctggtgctgcattctggttgtcacagtgattgtgagcccttagggattttcccatcatttctgtttcctgtcatatacaatgagcagactcgtggtgtctgagttggctttggactgcagaaacaggctgttacatgggcaatttgtaagggacagaagtttatttatttattttggtttgttcagacagacttttgctatgtagcccagtctggcctcaaactcatgggcatcctcctgagttctgaggtcatggacatgctatatttgtatgtctctgttgtttgtttgtttgtttgtttatgacaatctcaagtagcccaggctggcctcaaattcattgtctagctgaaggtagctttgaactcctgctttcctttttttttttcccccctacattggaaactacattggaactacaggtgtatgctaccttgcctggataacatgatttccccctttttgtttttctggtgatcatggctgttctcatgaagccatttttaaaagcgtgtatgtgttatggtgttagggatcgatccagaacttcacacatgctaggcaaacatgctctgctactgagccgtgtgcccagctggttaatgaatggttcttgaggctggacagtgcacggctgaggagctggccagctgataaggacctgcgtgttgatcagtcacatgcagaagacattacaggactgggggcagagggaattgacttgtgtggggatctgttctgtggaggcgagggcctgacacttctgaaaggttcccctgcccctttcgacattgccattcaggattataatccacgatgctgggagacatgtttgaactgtaacaaataggtcacccctcttaggagtcattggaagggtgttgtgggcacaggtgtgtgcactgacataggacatgctcgtgactgtgaatagctgtgatgtgacccacggtcgaatgcttttgccacgaagctctgtgtgagagagggaggggaagtgaaaggcggggtagggttggaggaggagctatccaataaccttccgagcgtccagccttggagcgtaggtcttacgtacaggcgtacaggccgtggcaatcacttttgggagtaggagtgagcagggcctggcgtgggctcccgaagctcaggtggctgccgggaggacctagggagcagggaacaacggagaaacaacatgcaagtgactgtccaggcaacagcagggagaggagccggagcgggtttgggagaccactgggtttgtgggctgaggctaaggcaggggcaaagcgtcctttgtgggtagccaagcctctgaagtagcattcacagaggagcactgtgtttctgacagagagagatgagctcctctcagggaaatgttgagttttggggccctgggagatgtgtaagggggagaacccaataatggctgcatgtttgggtctgaagtcaaagagaaaggtctggagtcaaacctgaagatctgaggtaacatcgcatgacgcttagggtgagcagagttgcccagggacaaggtgaggaagaagagggaacaacatctcagggcatcaaccagcacagaacaggcagcagagaagccagagaaggaggccgagaaagcaatgtgaacaacagagaccacgtagcaagtgggaagctaggaaggagcacgggggactctgtgtgagcggaagcctcagcatcccctgggatgtgctgagaacagctgggacctctcagtgtcagcgttactgattggaccctgggccggcggatgcctggcaagtcctcctccactgtggattttcagtcctgaaggcttgcactcgatggaattgaccttcaaaacaaagcatgatggtatttgcctgttatccttgctacactgggacccgaaacagtaggatcatgacttcaaaacaaggagaaataagggaaaagctgagggggggtctctttgtggtggatctatcttagaaggagttgtgtgtgtgtgtgtgtgtgtgtgtgtgtgtgtctgtctgtctgtctgtctgcgtgtgcacataggtgataggtgtcatccctcaggagctatccatctgtctgtttgtttggttttgagatcagtatatctcactgggaccagggctctnnnnnnnnnnnnnnnnnnnnnnnnnnnnnnnnnnnnnnnnnnnnnnnnnnnnnnnnnnnnnnnnctctccagttagactaagctagctcaccaggagagcccaggagtctccctttctcccttccccagcactgggattccaaagacatcgcttccaggctctttaaaaggttcattttttgttcttttatttttaaaaacataaataacaagggcacaaagaggaaagtgtggcagacagagtaggtatgagtcttgcaacatcagcaagcgtgctgggtgccagtggcctaagtgtgccaattaagaccatcatcagaatgggtgaaaacaactgactcacctgtgtgcagtctaccaaggacccacttcagctgtaaagaaacaggaattaaaagcaaataaaggaagacaggcttggtcttaggtatctgcagtaacagcagtcgggaggtaggaagcaggaggattaggagttcagggtccccttggctacatcgtgagtttgaagacagactatgatacatgagaccttgttttgaaacacatggaagacgaccaaaagaaaagaagtccagctgccagaaaatccctcagaacatgaccgactcagcaatagcatcaatcactctatccaatagctggctggaggctacggcgtccaccagccacagggaatacatttttctcaagttcacatagaatgttcgccatggcaggccacattctgaacccaaagccacacggttgttacaattacaaagctcgaaaccacactgtgtctgcgctcagagcaaaactgacttaagccagaagcaacagaaagatagaagagttgatagcgccggacatggtggcgcacgcctttagtcccagcactcaggaggcagaggcaggcggatttctgagttcgaggccagtctggtctacagagtgagttccaggacagtcagggctatacagagagagagagagagaaaaaaaaaagagttgataacatttggatgtcagagaaatctttatttatttatttttttaaaaaaagatggggtcttactgtatagaccaagctagcctcctagaacttgctaagtagaccaggctggcctcaaaatcacagagatggccatttctatcaagcaacatgtagatcaataaacagaccaacaaacaaatcccaggaattttgaaatatttgtaagtacatgaaaacacaccaggatttgtgagcagaagagctaatagggaaaattgtagcattgactgtatgtactagagaagaaacaaagattaattcatattgcaatgctggagatcaaacctagggacttgtgcttgctaaacaactctaccactgagctacgtgccctagtgtaacattttgttgttgttgtttttgttggtttgcttgttttatagtttttcaagacagagtttttctgtctgtcccaagctgtcctggaactcactctgtagatcacgctggcctcaaactcagagatgcacctgtctctgcctaccaagtgctgggattaagagcatgtgccattactacccagcttaaatttttttaaaccattcattcaagcccctatattaataaactagaaatagaaaaggaaattgaattagtaacattctagggcatggaaatgctgtcattcatataacaagttcccttgtcatagatgtgtccatacctgtgttggctatgcagccaacccactgcatgtattttccctgtatatgcacagggagaactatgtacaaagtggggaggaggacaggggataggagaggaaaaaaatttccagcttctcttgcactagatgcggcttcaagaaaacagatgtaaatggatttaggggtaagcacgctcaaaagagcaaacactattttgatgttggttaccactcagtctaccttgcagcttgagaagtagatatcaccattcttaagatcataaaacagaggttcagagaggtgaagggacttccccaatgacacactgttgaaagtttgttaataaacaaaaatagccaggtgtggtggcacacgcctttaatcctggagcttggggggtggaggcaggtgaatctctgtgagtttgaggccagcttgttttaggacagacagggatacacacaaacaaacaaacaaacaaacacaaaacccccttagtcttgaaatccaataaacaaatccaaaaatgtttaaaaattaaagggaatattattacatctgctagaactaggtttgtgtgcaattggaagaccttaaataagtatggtttagtaatctaagatttagtttctctttaagaattttattttaactttaatttaaaaatttttaatttaatttaactttttgaagatttaattttattcgtgtgtgtgtgtgtgtctgtgtatgatgcctgcagaaactagaagacagcatacgatccatgaagctggagtaaatagaaggttctaagtgcccagtgtgggtgctaagcaccaaactctctccagccttgattctggactcttaggttaaaacaaatgtccaagaatcaggcagcccagaagcagtacaacagttgctatagttgctaatgacattcagcttcctgcgccagcgctccgaggatgtgacccttcttttcattgctaaaactgactgcaagattccttgaccttacacttgtattctgtgcatcaggatggatagagaaatacatgaagaaaaaggaaacagaaagtatagtcaagggacttgagagatggcccagtggttaagagcactggctgctcttgccaaggatccgggttcagttctcagcacctacgtggcagttcacatccagttccaggaaatctgatagcctcttctgacttccatgggtaccaggcacacaagcagtgcgtatatgttcaggcaggcgaaacacacatatacattaagtgaattagacaatttgaaggagtctgtcccaagataagcatgaagtatctgtctggggttgaatacagggtttgtctgttcccagttgggtgacattcagttaagagactctgtcgctctgagccttagttccctcacctgtaagtgatgtttttgtcgacctcatagattatgaaaaatatttattattgtgcataccaccatgatgcgtatgtgtgggcacacgtgtctcagattgcacgtgcaggtcagggggcaactttgtggagtcagttttctcttccatctgggaatcacagtcaggtcaccaggcttgtgtgacaagcatctttacctgcagaatcatcttgcaaacccttaattttctttttttttataggattaaatgagacagggaaacaatgtgggagcttagcactctggtctatagttaaatgctcagtactatttatctttggacagaggtcttgcaatgcagtctaggctaccctcatactcatgtctttcccttattgtccctagtgctgggataatatgtgtgggtcatcatacccatcttcagtgttattgttaaagataaattattattgttattattattgttgttattatcattgctgtactgaacttagggctttatgcaagcactttgccactactacccaacactggggctacactccagtatgatattatcaatctaaaattgtcataatgcctcctggctgcctgcatcccagggtaccagtagactctagggtcaatgactggtctattctaggacctttgcctctacaccagtggtttttagtaagcaatctcgttctcaaatgttttgagggatttttaatacaacagtaactatttgctcctatgatctcgtgggtggaggccagggatgaagcagaacatccaacagtggacagggcagtctctgccataaagtctttaggcagaaggttgtgagtccttgccacatgcttgccctgcttttgagtatcagactcaggagccgctgatgtttcaaccaacatctgacttctgaaagaggctcacagtccacagacctcagcgagcgcatcaggcaggtgagtgctgaagcctgtcttgtctgtggttcaccatccccatacttgagaggcttgggtgaggctgacttctgcccctctccctccagacctaagaaaacccatctcagtctggcttttctcgagtagtttgacctctggttctctcccatttctagagaagcccctaaggcctcatagccatcatctggtgctcttcagagccaaggaggtagggaggctgtctcagtcttttccagctgcccctgatgctctggcctctgttcccagtctgtttcctttgagacagcccttcacacacatgacagccagtgggtgacttgattttacgccccctttcatgctgaagatagacaccatgcctgcctgtgtctgtgacacaccgctcctgtgggcccaggatggggtcaaggattccagaaatttatttgtgagatgttcaagggtagaggcagaggcagaggcagaggcaaagggagacagagagggagggggagggggagagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagaagcgcactggaaagcacagggaagaacatctccactgaggtctcagtgcccgcgttggaaaggcggaggaagctagggctccgggatacaggagtggtttccatggagatgaggatgcaccaggagcgagcaaaaacagactacagcgaggccagccactctggcacctagggagaggaaggcggtgaagcaattgaagggatagcgtgtctgttgttcccctgaaagctcctagccccactgctgccttttgctagagttcctcagcccaggaatgaggagacaaatcaagggcatctagggagaacggcatccaagtctcctcctctttttcctcctcttactcctccctgctccatggcagtgatagagcacctcagggcttagtcccatgcctactttctgctttccacaatatcaaatttaagtgcccatggatgcctgaagcttccagggttagcctctggctcctgttctccccctgccccggggtggggtctgcacttgtttctctatttgtgcaccaaggtgcatcttcagacgttaagtctctagctctcctggcttggttctgctgcagagctggagaatcttttatgcccatcacagtgggaggtccggtctctgaagattctgaaggcagccctggtagaatgagagattggtgacagtgctgttggggacattacatcaggcactgaggatgggtgggtgtgggatggaatccaacttgcagaactctggggagggaagaggagcgtagggagcactcccttttactggagatggggggaggagtgtcaaagccctcacccctctcacattgtggggactggatgggccacatatagtggacagaactgagagccagccaaactaatatcacctaatgtcgtctaatatccaggttaagctcttgggtctggaggagtcaagggtcatacagctcaaaaagctttgtgcaagctgcagacctaaatactgcagagggactgagctgagcaagtattttccgttgcccattgaacctggtccttctgattggcctgctgtggggccctgtgccactcatagacaagacaaccactgtttccaaaggaacgcagtgagatggttggctcagacttgccccacccactcccagcctaggctggtgttgggagggtttggtagtttaacccaagtgggtagattggatgaaggaactatctttacagggtcatcctggcctgccctttctacctttatctatctcacctgaaacctactgaactatttccttatttgtgtaattattatttttgttatgactagggttttttgttttgtttgtttattgtctggctttttttttttgagatggtgtcttgttgggcaaactggcttgtaactgtgtagatgaagatgaccttgagttattatattttctgtgtgtgttttgcctgcatttatgtatgtgttccgtgtgtatgcagttcctacagaggccagaagagggtgttagatctcctggaagtgctgtaatagataattgttgtgaactgccatgttgggtgctgggaacagaacccagaaccttggcaagatcggcaactacttgttatgactagttttgatactgacaactaacattatatggaagttactgtgcaaaacactttgaggccacctgtcatctttatagtcatttgatgatagtcttaaccacccccattttacagatttggaaactgaggcacaaatataaaggaattgaggctcacaaagctagcagagagctggggcaacatttaaatcctaaaccctatactgcaaccttcctttctcctatgtaaactctatgagacacagatccaagagcctccctgagctctgctctagtgcctgacagacagtaggcccacagcaaagtttgaacaaattggcactttgctaaatgtctctgaagcaccatgattcctattccacagaacgcataggcctggcacctctcacctcccagtcacagctagaagtggagaatctataggctggccctgccatcagtcctctgcagtctgtttgcctagcatctttgaacgaatgcaaagtgtcagtgagccaccgttgatcgaataacaaaattaaaaccaaaaaccaaagacaaactcataaaaactggagtgatgaggatggggggcgggggagagtaagaggctgtcagggggcgtggcctggcattgatatgttcatgttccctaaaggcaaggtgaagcaggagaagttgagggttccattttctgcttctttgggtcaacgttgctctcccaatgcatgaaaagtagttaccacacattcagattggtagatggggctgggggaattctcaggacctagcctccacccaccgtctcacttctaaggagtaataatgctttctctttcctccctactccacgtcggtgtgggtcctgctcctgatggccagccctgtgcctcgtcttgggctgtatgatctttcctgatggctgggatgctgagaccatccgggacatgtgcggggccaagacagggaagtactccctgggggactgttcagtgcgctgggcgtacattctggccatcatcggcatcctcaacgcgctcatcctgtccttccttgccttcgtgctgggcaaccggcagacggacctgctgcaggaggagctcaaacaggagaacaaaggcaagtgtgtggaccagagggcaaggcctgctgtgaggcaggaaagggcaaccgcagatgcaataaaaggagtgaagcaaaaattacacacagggagctggcgattcagagcactggctactcttccagaggccctgggctgattcccaacatccacgtgaagccacagggccatctttaagtctagttctagagattcaacgtcctcttctggcctcctctggcactgtccacatagtgcacataaatacactcaagcaaaatcacccatacacttaaacgattttaaaaaggagtacacagaggccattaagatggctcaacaggggctggtgagatggctcagtggggtaagagcacccgactgctcttccgaaggtccagagttcaaatcccagcaaccacatggtggctcacaaccatccttaatgcaatctgatgccctcttctggagtatctgaggacagctacagtgtacttatatataataaataaataaatcttaaaaaaaaaaaaaaaagatggctcaacagtaaaaggcacttgatgctaaactcgatgatctgagtttgatccccaggatccacaaggtggaaagagaccctggaaaatttgtcccctggcttacacacacacacacacacacacacacacacacagagagagagagagagagagagagagagagagagagagagagagagagagagactcttacacagtcaagcatgcacgcatgcgcacagagaacctgaaaactaagcaaacaggctgaggttcaaaggttgtgggttcccatcatctgatgccccacactgtgaagtgaggggacagaggtgactgagaaactatatgtggagagggaaaaggaaagttcagaagtgactgagcagtgtgttcattaagtcccaagccaagcagaaataagggatgcatggcttaaataaaaatttaaaaaatggaagttgccgggcagtggtggctcacgcatttaatcccagcacttgagaggcagaggcaggaggatttctgagttcgaggccagcctggtctacagagtgagttccaggacagttaaggctatacagagaaaccctgtctcaaaaaaacaaaaaataaaattaaaaaaaaaataaaaatagggtcttactcaataccaggctggatttgacgttgacagcgctcttcctgcttcaacttcttaagtacttggattacaggagagtcaccattcccacacattttgttgttgtttagacagcatctccaagctggctttcaagtcactatataatcaaagatagccttaatcttcctttaatcacacttcaagtattcaggttacagacctacaccaacacaccaggtcatatatacatatatacatacacacacacatatatatgtgtatatatatatgtatatatatatatatacacacacacacacacacatatatgtatatatacacatatatattatacacacatatgtatatacatacatatatatacacatatatacatatatattatataacatatataatttgttttaatataatatataatgatacattaaaatataatatatttaaatatattacatttatttaatatatacttaatatattttcatttataaccaatgtatttaatatatattaaaaacaaagaaataatggggctggagagagagctcaatggtgaaaagcatgtgcagttcttctagaggacatgagtttggttcctagcacccaggttgggcatctcacagctgtctgttgactctagaccctggggagccaaagccctcttctggctgccacaagcatctgtgtgaacacatgtgacttacaccaacacagagatacacacataaataaaattttaataataatctttttttgtttggttgttttttgtttttttgttgagacagggtttctctgtgtagccctggctgtcctggaactcactctgtagaccaggctggcctcaaactcagaaatccacctgcctctgcctcccaagtgctgggattaaaggcatgtgccaccacgcctgacaaaagtaaccttaaaaaagataagtacagaagctgggagggtggtcatctgggattgggtctgaaggggaggaacctagggtgtgagactggggcttgtgctatatgcaaattatcaacagctacagctttgaatggtaccattcacaaatttattacatcatgctgtataactggtgtattacatattacatatatcaagtaacagtaaaatacaacaaggaaataatttagggccatcaagatggcttgttatgaaaccctgataattgagtttgaagcctagaccccgttgtggaaggagagaaccgacccccaggctgtactctgatctcacacaacctcacatgtcttccacagacatgaataataaatttcatttaattaaaaagaaaaacaaacaatttcagtcatgcatacctgcataacccctgttctcttgtggctggcattggagaattatgatctcaaggtcagcctgagccacatatcaagatcctgtctcaaaacaacaggaaacaatttacacagaaagccagactctcagaggtaactgcttttaagcggattggtacccacacacgtcatcgcacgggttgaatggtggtttattttattcttcttctattagggaaggtctgaggtttcctgatgacactacagtgaatatctttcttctacctccacacacacattcacaagttttttcccttggggtcttcagaaataaaatataataacagtgccagatagcctccaaagggctgaggtcaagcagagtcttctgaccctaatgtcagcctacccccagttctgagagaggcattgtggtggatgcttgtgtgtatgggcacacggtccttagactgagtctcagagcagtggttcccgcggttcaacctatgcttagcttgtccactccttacagtcatttcttacggtctctgctcaccatacaatgagcttaaatgataacatacacagctgcgtgtctactcatctagcaggagacctcagtgttgtgcttaaagtcttcttgaatggtgagcacagactagagtagaagcgggttaagcctaggaattacttgccctcgagtttcagtttcccatacttcataaaaccagggtgatgagaacagatccgtctcccaggactgtcaggttgaggggaaagtttctgtatgcaaagcggctagcagggtctagtacttgggggatgctcaaagcggtcagctctaacaggcctctgcaggcaggcattatgaacaccgggttacaggtgagaacaagggtggggcaggggatggtgtgcacacagagggagagcttgctccaagtcatctaagtagtgaagtcagggcttgaacgcaggttcgagtccagaaccaaggtccgacaacacactacctatcttagagctcagtgaggccaaggttctacaacacgctacttatcttacagctcagccaggctagaggttttctgtccccttttattagcttcctgggacatttctctgctaatctgaccttaaaagctctgacagatccctcccatcatgtaggttctttggtcttggtttgaggtcaggacctaccccctggtggcaacttccagaagtgcaaggctaagcctatgtggattctctgatgctaccctggcaatggatggatgaacctctcagtggatgggtccattcagtgtctctctcctgttcccacatggctccctcacaagttcatttacttgaaagacatggctctgctttgtagactaggatacactggaacttactgtgtagcccaggttgcccccatacctgtggcaagccttatgcttcactcagcctcctgttaagagttaagattaagatgggagccaactttcccagctacagctcattgttaaaatgatatgggaggccagtcatggtagtgtatacctgtaagcttcgtactctgaaggcataggcaggagaatcagatcaaggctagcctctgctaccttgtaaattcaaagccagcctaggatacaagagagttaaaaacaaccccttcctgcccaataaaactccccacaccagtgatgtggggagctccacccatctgcatccttaactgcttcatggaggtggacactgtaggccagttccaagtcaaaggcatttgctatgacctttcagaatggccctgtggagtgggagagggtctttatttcacacatgacagctaatgggttacatggtgtgcttaaggctgacctgtcattcaaggacttggttctagtcacttctggccatttgtgtcttggggagtggctgagggggcagctgggacctcacaggctctaacattctccctttttcctctccctccccttccccctctctctttctcccctcccctcccttcctcccacagatttcgtgggcactacagtaagttccgtgctgcggccaggaggtgatgtgtctggctggggagtcctaccatgccctgttgctcacacacagggaccctgaaagccgggattttatagcccaggagttggcctgacctcagcatatcccgtctgctgccctctcattcctgcgttcaagctccagacccaaatcttgaactggctgcacacggacctcctccgggctctgaagagaggcaggggctaggtggcagcctggcaagaaggcagagcccttgagatcctgagtctggccccgcctccattggacctagtggagcctgggcctccctctttggtccctcggtttccttctctcctgtgtagactagctggaggtccctggggatccccagggaaaggacgctctgccgcgcaatctccttggaccccttcagtgtgcagggctgcctgctgcgtccttgcctgccggtcctgatcgcctaaagagacttactcaacacactgccccaggagggccagactctttcctactttatttttattcgctgatgatggtcccaccacatctgccacaaagctccaggtgccaccagccccccaacggggcctcctctgcctccctcattcaagcctgcacccagctctcaaaagaatctgagccgtgctgagggggaaaggatagggtcttccttcctgctgctggtagtccttcatcacctcagagtctgagggggagacacgggctctggaggctgtgggaggaggaagctagttccagcctgaggctggcctggcctcttccctactgggatatctcactggtgactggcccctcgagcctggcctgttttgtacagcatagacttctcaggcccattgtcagggttggtggctgtggagagggggcacagaggtggggacttaggggttacccctctccttctcatgcttcctacaccctggacatctgccaagggcagagactgtcttgcgtctttgatacttttctgcctaacttgaacttgcaggtcacctctgaacagggtacccttgtccccaccccaggccctgttaccctgtccctgcctctttctcctctttgcccacttctcgccttgcgataagcccagggtctgcaacctcatgggcagtgcttggagctgaggtaggtgtgtgtgcatgagtgtgtgcgtgtatgtgtgtgtatgtgtgtgtatgcgtgtgtatgcgtgagtatgtgtgtgcgtgtatgtgtgtatgtgtgtgtttgtgtgtgtgtgcgtgtgtgtatgtgtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcgtgtatgtgtgtgtgtgtgcgcgcgcgcgcgcgcgtgtgtgtgtgtgtgtgggtgtgtgtgtgtgtgcatgtgttaggaaagggcagatgagaagatctctcttctcctgcagtggggggcccctccctcccccttagcagagagaaaaacgagggagatttccaggttgtgttgttgttgttgttgttgttttgttttttattttgttgtagtttttgaccatctttggctaccttatggatctggtggcagagccatctaatcatagaaaagcctccagtttccagtggaggggtggcagacgaacgtcatcaaacataatgtctccgaggacacggcctgctgcctggtccttgtgtcgaggaatgtgtgcctcctataggctgtccaggaggcgtctcacttccctgtgttacattggcctcagccagagaggaagaacggctagtctatgagtttgctgtccttgtgttcattttcagaggacttggagctgagttaggattcctgagccaggcccatgacccaaggctgccccagcaggaccctacctggaatctgatgctggttcctggcagaattcctgacacttggaacgttccagatcccatctccacattttctcctctctcctccagggtagacacctcctcctgagctttggccactgcccttgtcttccccagctcttgtcccaacctggtccctccctggagccagagtgctggagtcatcttcagcaggtagccaggagactgggaatggacaggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagagagatctggagaggcacacacaacgatggagaagtgaagaactagaatgggttttccatggatgggcagcagatgaagaaacctgggaggtgggaaatggaggggtaattcacagggagcaagaacaaaatgtagagaagaaagaagatagtgggtatgtgtgtgaagaggaaacgctagggattgaggagggcagccatgtgtgtgcttggagagcctgttttcctaagaacacttgctgcccagggggtcccttgtgctttggcagacaggatagaattgacttcttggtgtctgcggtagctctgatcctttggagagaactgtgtgtgtacaagggaccgagcaggccaggctgtgttagatagaggtgggctaatgacagagaggaagggcatgagttccctctgaggagtcgtctaccagtgttcttgccactctccagccaaccagctgctgcccagcggtgcagtgtggagtttcaggctggcaggctgaggtctgcagtctgcaggagccccagggtatcgcggggaaagaagagagggagcaatgggaaccaaaatgtggtcttgaaggcttagaagagttagggacaaagaaaatggatgtttcggccaagaactcaggtgaggctctaactgacctcctggcagttgacgtaggacagttagggcggggagctggtgttagcctttggggaaggataggatatggacatcaacatctctgtttctgatcactaaccaagagcttcccgttgttgggtccctgaaaatcctcagctatttgtgactggatggagaggctggtgtttggtgttagcggatttctttgctcttgacagagaggggagaggagaaagcagttatagcttcaatggggtccagcctctgctccagagcactgtttagactagtccttggggttgagggaagtagaacactgccctctaaggaccagagctatggaggaaagctgttccaagggcctgaggatgtggggaatattaacatccttctggggcctgcaagagccaagatggcagcttgcagatggcgcttgggaggacggggaagcttctacaagttgagtccctcttgagcacagagggactagtccttctccagcctctggtatgaaccaaaaaagggaaaccctcttggaagggctggattccttctagcatgagaggcttctgggggcccttgtctggctcagagctagcttttgggtgggacaggaggtattcctgagaagagagcaggagccaccagccatcccaggactctgactggcagtcctccaaggacctgtgctgtgtgttagggtagcttggtgttgtctgtgccccactagtaagttctgtctgaatgtgtcttagatgttcactgtccaatttggtaacatttcttttggtcccgcccccttctgctgctggatttatgcttcagtgcaggtggaatggtgttcaaataaagacacaatttatatcacccatgctggctgctgcttctgactcctgacccagggcctcatgggtgggatacagcccaaccctccattcatatcaatggctgtatattcatggagtgctaatgttcagtgtgacttaatgacagtttcttttaccacagctttaaaaaaaacaaaacaaaaccaactttggtaatacatacctgtgatctcagaactcagaagacggaagcagaaggattataaattcatggccatactagactacatgaagagatctagtctcaagaaagaaaaaaatgtctgggtatttctatagcatgaccatggcccacgttgggagcaggagcccgggtcctgtctgcatgtcccctgtagccatcacctttccacaagcatcgctcacagacgtggggttggcattggagggatggcccagcagcgacaggcaagggcttctcttctagaggactgggctcaattctcagaatccaggagcatctgtaattctcgttccaggagacctgctacaccaggcatgcatgtgattgtagtacgtgcatacatgcagataaaatgcccttacacataaaatacaaatttaaaaaagggggggcagtcatgatggcacaggcctttaattccaatacttaggaggcaggggcatgtgaatttctgtgagtttggcactagcttgatttatatatccagttccagactagccagggctacatagggagattatggagagaaagacggggnnnnnnnnnnnnnnnnnnnntaataaaaatttaaaaaagtatctcatagcttaggttagctgctggtgttccagtcatttgatctatgagccacttgaagctgcctggaaatgccacagaactgagtcccctggcacatgtaactgaaagaggctagaaacattaactgggcacgttgccaacgcaaatgaaaccggggttctgtgacacggcaaaaggagacagcagcagcggcactctggatactccctctggcacagtcttgattctgcatgcggtattctgaccacagtaacagtgctccactcttttgtgaggactcggggaagccaggatacctctttctagagcacttacccaaagggaagaaaataaaaatccacactgaagagatgagaattccgacattcaccgcattccagggcgtggtcaggtggttgggggcacgtgtgtgagctgcccatgtggaccacatactgcacacaatgacttgttctaaaagtgcgtctggatgtggagatgagcatgtcagaacatggcaggctctgctgaatgccagcttcttgtgggtgctcttaggggcggtacctaacatggcttctggtggaatgcgcgtatgcggaggaaatcttactgtgtgggagcgagagacaggcaggccacagtggaagagaaagcagcttgagtgacaggtgggtggattatatccccgggagactgaaagcagctaggacaggtgaagcaggaaatgtgaggtgcggaggggtcagagacaagcctgggggtcaacaagggtctgaaagagctcagagttaagagtggtggaagattccttaattatttggaggtgggtagaccagggtctacctgtgtatccctggctggcctggagctcactgtgtggaccaggctgaccgaggacactgtttgcttctgcctcccgagtacagaagttaaaggcgtacaccaccacccatggcaggagttgtttgtttttgagacagggtcctggtgtgtatccctgggtagattgaactcaaagcaaccttccgcatcagctggtaagggctgggattacaggtgaatgccactgtgtcagttacatttctctcacagtcataaaccagtgtgaccaaggcaacttagagaagagtttattgggggcttctggctccagaaggttagagtacatgatgtcagagcagagcaggtggcaggaacctggagcagtttcaaagagcttggacacagaacacactaggagtgacttgatgtcttggaaatctttaaaccctacctccagtgacatcctctgtcatggaggccaacctcctaatcatttccaaacagcctccaaaccgggaccaagtattcaagtaccaaagccttatagggaacaccacactcaaaccaccgcagctcccaggtctagttcacagaagtattttacacagggctcacattttcaggaagattactttggtatggtgataatgaatgggccaaaaggtgacaattttgggaggctgcagagatggctcagtggttaagtggttaaagagcctgctcttgtcaaggaccaatacccacgaagcagctcccacccatctgtaactccagttccaggggagatgatgctctctgctggcctccaagatcgccagacacacatggtgtacagacacacatacaggcaacacacacacagaggcaacacacacacacagaggcaacacacacacacacacacacacacacacacacacacagagattaattaaaaagtaaattaaaaaatatatttttttaaataacaaatttgggggctggaaagatgcctcagtggttaagagcactggctgctcctcctgaggatccaagttcaatccccagtacccacaaggcagcttacaactgtctataactccagctccagaggatctgacaccctcacatagacatgcatgcaggcaaaacacaaatgcacataaaataaaaatgaataatttaaaaaataataaaaataatttttaaaaaagaagatggattttggattgagagatggctctgtgagtaaaagtgtctactcttaaacttggtgacctgagttagatccttaagacccacatggcacaaggagagaaccaactcccaaaagtggttatgtgaccttcacatgtgcacagtggctatgccctcccctagatagagatagatagatagatagatagatagatagatagatagatagatagatacatacatacatacatacatacatacatacatacatacatacatagaaagatagatacatagatagaaaaatagatagataggaagatatatagacagacagacagatagacagatagatgtgaaaaattttaaaatatggaatgcttcacaaacttgtgtgccacacttacagcaatgctcatctctacattgcttcaggttgagtagatgtgatatcaaagttgggatgacacaatttaaagaggagacagtttagatgtgagagagctagacacctggtgtgacatgaggtcatggcagtagatctgagggagggagtgagttcatgctctggagtggagctgaggacacttggtaactgtttttgggataaaagaaacaatgtcagtgacattgaggaagacagggagcttgaaaaaaaaagatcttttttgagggactagaatgatctgctaagatatcaggagacttctgatcagttcgtatgtgggaggctctcctgacagatgtaggccatgggcagctgcacttgggtcatagctgcaatcagaagtgtagatgggcctatccaatgtaactgactgcacagtgtaaagagagctgccaggggaggctagaagatgcctggtgtaaaggccagtcagaggaagaaatgtacacagagagaggacagaagcatgccaacttgtgagagaacttcaagtgtgctgctatggaaaccaaggatgaggagagaggtccagcattacagggctgatgataaggccaccagggagttggtaggaacattggagacagccaaagtgaggttagttcggggcaagaccggttggtgatagagtggagattatccatcatctggcaaagagggagaactatgtgtggaggttccgtcatgatctgctaagtggacccatgacccagcagaggataagaaccagctttttacccagaggcggcaacagtctctaaatatgtgggtgttttcaaagctcacagatgtgaggaaggtatgggagagaggactgcaaaggggccagctctgaaggggtgggagccagcccagagtgtagaggtgggggctgaaaagatgcccttttgtgttagagttggagctctggcctgttgaagtctattttctcagtgaaccaagaggctgagatggtagtggaggttagaaaaggatgctcaagtagctaagtctgaagacaaggcctggcaggtggccacaaatctgccatagttccaatcaatgggagggaaggctaagaagggaacagatctgccctgagatctggagagggtgttggacaaggagggcctgaaaagaggctctaagaggaactaagggcttctctctctctctctctctctctctccccctctgcctgtgtctctcttgctgtctgtgtgctgttttgttggcttttttggggggacaggttactgtactataacagccttggatgtcctggaatgcactctgtagaccaggctggcctagagatctgcctgcctctgcctcctgcctcctgcctcctgcctcctgcctcctgcctcctgcctcctgcctcctgcctctcctctgcctctctgcctctctctctctgcctctctgcctccctgcgcctctgcctctgcctctgcctctgcctctgcctctgcctctgcctctgcctctgcctctgcctctgcctctgcctctgcctctgcctctgcctctgcctctgcctctctgcctctgcctctgcctctgcctctgcctctgcctctgcctctgcctctgcctctgcctctgcctctgcctctgcctctctgcctcctgagtgtttggattaaaggtgtgcaccatcaccacccaggactgaggtttttgtgaaacagtaggaaagacaagaaattgtgaggacagaccctggatggtcacctgaatattccaggaagactttggagaagaacctgtatacatggtttcccccaatttgggggaaatgtggtctaagttagtctggagagccagccaccacaaagcaacctaaagaggcttgctagggagtagaacgataaaggtaatgaaagggtgtagagcaggggttctcaacctgtgggtcacgacccctttgacctgaataactctttcacaggggtcacctaagaccgtcagaaaacacagatatttgcattatgattcataacagtagcaaaattacagttatgaagtagcaataaaaataatttatggttggggggtcaccacaacatgaaaaactgcattaaaatgtcacacagcactaggaaggttgagaatcactatgctaaaggacgtagtaaaagacaagagcctcaggatggagggtattttaatcttgtggacaagatgctagtgtctgggagagtcaatgagaagcttgacgcaatcagatgagaggaactgagtatttaaatgttctgtaaggatgagacagtgcgtgctttgcaatcccatctcttcccacaagggaggtagaggcaggagaatcatgagttcaagggcattcttgttcttggctagtaagaaagaagaaggcaagtctcacctacatgagaccctgtcattaaaacacacacacacacacacacacacacacacacagagcacacttcttcggtgtaagtgtgatccccaataaagccaatggtgagttgaaggagatgaagtttatctataaaggagaagcatgttctgaaacatagcacaaaggccaatgagagaagagatagggggaagtagctacagggcaagaatggtgttgggagccaagatgactagcacacattcattctggaaggtcagtcctgtggtgagacacatgaacaagggtaggtcaatgttggctgctggcaccttaacagatggagtctggctgcaggattcaccgggttgactggaatgtcttcaaattcatttgctcactaaacaaagcactcagtggacatccaccctggctaggcacctaggccctaggggtagagaaacaaaccacttgtggggttgtcaaccatctctggccaatttctagtggcctgtcattgattatgcatgagagatg

SEQ ID NO: 572 - DNA, 975 bp, Mus musculus
cgctgttaggagcatcgagcaccggagcttgagccctgccggtcccggatcagccgtcccgactcggcccagctcccgccccgcggccggtggtcagtcctgggccggcggccccctgtcagccgctgccgccggccccgcccccgggcaccatgctgccctcgcaggaagcctccaagctctaccatgagcactacatgcggaactcgcgggccatcggcgtgctatgggccatcttcaccatctgcttcgccatcatcaacgtggtggtcttcatccagccctactgggtaggcgacagcgtgagcactcccaagcctggctacttcggcctcttccactactgcgtgggcagcgggctagcgggccgcgagctcacctgccggggctctttcaccgacttcagcaccatcccgtccagcgccttcaaggcggccgccttcttcgtgttgctttccatggtgctgattctcggctgcatcacctgcttcgctcttttcttcttctgcaacactgctactgtctacaagatctgcgcctggatgcagctcctggcagccctgtgcctcgtcttgggctgtatgatctttcctgatggctgggatgctgagaccatccgggacatgtgcggggccaagacagggaagtactccctgggggactgttcagtgcgctgggcgtacattctggccatcatcggcatcctcaacgcgctcatcctgtccttccttgccttcgtgctgggcaaccggcagacggacctgctgcaggaggagctcaaacaggagaacaaaggcaaatttcgtgggcactacagtaagttccgtgctgcggccaggaggtgatgtgtctggctggggagtcctaccatgccctgttgctcacacacagggaccctgaaagccgggattttatagcccaggagttggcctgacctcagcatatcccgtctgctgccctctcattcctgcgttc

SEQ ID NO: 573 - protein, 270 aa, Mus musculus
ALPVPDQPSRLGPAPAPRPVVSPGPAAPCQPLPPAPPPGTMLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFALFFFCNTATVYKICAWMQLLAALCLVLGCMIFPDGWDAETIRDMCGAKTGKYSLGDCSVRWAYILAIIGILNALILSFLAFVLGNRQTDLLQEELKQENKGKFRGHYSKFRAAARR

SEQ ID NO: 574 - DNA, 66973 bp, Homo sapiens
  misc_feature (1)...(66973): n = A,T,C or G
ccatcagctgggcacagtggcttgcacctatagttccaacttctcaggaggctgaggtgggaggattgcttgagcccgggagtccaagaccagcctgggcaacacagcaagaccccgtctcaaaaattaaaaaaaaaaaaatcttccatctgtcaacccagcttctgaacacatgttgaccttattctcttactctcaggctctgccacagaattgtgggcatgaccatctgcaacctaaagtcagcatctttacaatgtatgatttaaggaatgaaaaactgagcccatctctctctctctctctctctctctttctctctttctctctctctctctgtctttcctcttcccccagggaagatgctgattgattaggatgggctcagttgtccatcctgaggccaaagtattaaagccaggtggggcagggcagtatgattagctgaactggaacacacatctactgctatgaccccaagagggcaagaggggctattatcagaaaaaaaggagagagtactgggtagaagaaatccagccaggcgtggtgactcatgcctgtaatcccagcaatttgggaagctgaggcaagaggatttctttagccctggagctcgaggccagcctaggcaacatatggaggcccagtctctaaaataataataacggccgggcgcggtggctcatgcctgtaatcccagcactttgggaggccgaggcgggcggatcacgaggtcaggagatcgagaccatcctggctaacatggtgaaaccctgtctctactaaaaatacaaaaaaattagccgggcatgggagtgggcgcctgtagtcccagctacttgggaggctgaggcaggaaaatggtgtgaacctgggaggcagagcttgcagtgagctgagatcacgcccctgcactccagcctgggagcctgagagcgagactccgcctcaaaaaaaaaaaaaagtaataatcataataacaatagacaaatcctacaggttttccatttcagcatatactgatggtttcatacacacatttaatttaaagactgataccttgagagatgactatcctgtttatctttatcttcacaagcactaatttatctattttatgtattaatgctttgtagactttataaagaacctataaagagcaaattctataggtaaatatgaatcgtttagaattttccatctctcccatattttcagaggaataatgatattttaaaggcagaatagttgaatgtttccacatcctcaaatagacgttcttgtttctttctttagtctctctcagttttctccaactttagtacctatgaagtacaagatgggataatatacatgaaaccttggttattgtatttttgggcaattaaggaatttttcaaggataatttatatgatacacctccccagttgcatttgtctttaggacctaacctcctacagaagataaaatcctctgtgctagtgttaactagagcatctactgtgtgaccagctccttatgtattttaccatgtgaggttaagcagttgtaggttcaattttgtaagtaagaagaatgaggttcagataatttacataaactgatacaagaggaatgatagacaatgaagagtcagaagggcgagggggtgggagggggaggatgatgagaaattacttaatgggtacaatgtacattatttgggtgaggagtaccctaaaaactctgactttaccacaacacaatctatgcatgaaacaaaattgcacttgtactccatacgtttaattttttttttttttttttttgaggcagaatctcactgtgttgcccaggctggagtgcagtggtgtgatctcggctcaccacaacctctgcctcccggattcaagcgattctcatgactcagcctcctgattagctgggaatacaggtgcacaccaccatgcctgggtaattttttttgaattttttagtagagacagagtttcaccatgttggtcaggctggtcttgaactcctgacctcaattgatccacctacctcggcctcccaaagtgctgagattacaggtgtgagccaccacacctggcctgtacgccataaatttatacattttttttaaacaacaacaacaagccaagctcacaaaaactcttaggtatcagggttagaatacaaatatctgtttatctgactttaggatagctctgattcctacccttaggggcttaggaacttcggaaagtttgatgtaagggatgcatgcatgaggtgtgggtgaaaacacacacaggtttcaatcctggaatgcccactttctagctatacaatatatatatatttttttctcacctcccggacggggcggctggccgggcagaggggctcctcacttcccagtaggggcggccgggcagaggcgcccctcacctcccagacggggcagctggccgggcggggggctgacccccacctccctcccggacgggctggctgccgggcagaggcgctcctcacttcccagacggggcgacggggcagaggcgctccccacatctcagacgatgggtggccgggcagagacgctcctcactttccagactgggcagccaggcagaggggctcctcacgtcccagaggatgggcggccaggcagagacgctcctcacttcccagatgggatggcggccgggaagaggtgctcctcacttcctagatgggatggcggccgggcagaggcgctcctcacttcccagacggggtgacggggcagaggcgctccccacatctcagacgatgggcggccgggcagagacgctcctcactttccagactgggcagccaggcagaggggctcctcacatcccagaggatgggcggccaggcagagacgctcctcacttcccagacagggtggcggccgggcagaggctgcaatctcggcactttgggaggccaaggcaggcggctgggaggtggaggttgtagcgagccgagatcacgccactgcactccagcctgggcaccattgagcacttgagtgaaccagactccgtctgcaatcccggcacctcgggaggccgaggctggcggatcactagcggttaggagctggagaccagcccggccaacacagcgaaaccccgtctccaaccaaaaaatacgaaaaccagtcaggcgtggcggcacgcgcctgcaatcgcaggcactcggcaggctgaggcaggagaatcaggcagggaggttgcagtgagccgagatggcagcagtacagtccagcttcggctcagcatgagagggagaccgtggaaagagagggagagggagaccgtggggagagggagagggggggagagggagagggagagggagagctatacaatattaatggcaaacagcttttgaatgttttctaagtgctcagcactttgcatgcacaatatctcattcaatcttcttgaaaacttttggaagaagacactactattgttattcccactttaaagatgaggaaactgacacttaaaagcagttaataaggtgcagaaatggaactcagatggtctgatgccagtgcatgtatttgtaaccaaatgatatggatataaaaaggaaatgagcagttgtaaagaattgaatcataggccgggcgggcctggtggttcatgcctgtaatcccaacactttgggaggttgaagctggtggatcacttgaggccaggaattcgagaccagcttggccaacacggtgaaacccccatctctagtaaaaatagaaaaattaggcatggtagcacgcacctgtaattccagctacttgggaggctgaggcaggagaaacgcttgaacccgggaggcagagtttgcagtgagccaagatcacgccattgcactgcagcctgggtgacagagcaagacagcgtttcaaaaaaaaaaaaaaaaaaaaaagaatccactcttgagaatggtttatatgacatggcaattaagaatgtgggctttggagcagattgcttggggacgaaccccagctcttctacttgctagaggtgtgactttgggtaaatcaaagaacctcagtgtcctcatctgtaaaatgggcatacagtagtgcctacctatattagtttgctagggctgccataacaaaatattacagcctgtgtgacttgaacaacagaaattaattttctcacagttttggaggctagaagtctaaacattggcaaatgtttcttctgaggcttctttccttggcttataagtggctgccttcttgccgtgtcctcgcacagttatccttggtctctgtgttgtccatgtcttaatctctttttataaagattccaggcattttggattagggcccacccgtatgacctcttcttatcttcatcatctctttaaaggtcctatctcaaaatacagtcacattctaaggtactgggcaattggactttaacatatgaattttgtaggggacagaattcagccataacactacctcacagagttattgtgaagattaaatgagacaatacatgtaaggcaatgaacaggggacctagaatgcagtgagagctaccagcaagttgcaaatcattcctcagcaggatactggctggaagtacccagggcttctcttcttatccaaatgcagtccagcatcatccttgcttaagatctacagtccccatttgaatcgcacaagtcttccattctggtctggcccctccctggggtcgataagatgttcttcctgtagagaactctcagattttctttccgtaactgctccaagtttagtctttaaaatgagaacacgtcctgtcccagctcctcatggctcagcaagggcatttccaatactactgctctttcaactctttggacaagtcatttattattaaactttaatgataatcacttacatttatagcctctttcagtttacaaagctcttttcctatccattatctcttttaatccttacaacatctgtgggaaggaattacgttcttctccatttgacaaatgaagaaaacacggctctgaagagtaccatcgtcttcccaggttacacagttaacatgtggcagagatgggcttcaaattctggtcttttactttcagtctatcaggagtagctcacccatcaaggcatctttctttcttttcttcctttctttccttctttctttctttctttctttctttctttctttctttctttctttctctttctctcttcctctctttctttctttctttctttctttctttctttctttctttctttctttccttctttctccgtccttccttccttcctctcttgctctctctttctttctttctctctttttttttttttcagagtttcactgttgtcacccaggctggagtgcaatggtgcaatctcggctcactgcaacctccgcccccatgttcaagcacttctcttgcctcagactcccgagtatctgggattacaggcacaagccaccacacctggctgatttttgtatttttagtagagacaggtttcgccatgttggccaggctggtcttgaactcctgacctcaggtgatccacccgccttggcctcccaaagtgctaggattacaggtgtgagccaccatgcttggcccaggcacttttctacaaaagtgatatactagacaaataatgcccctgctctctctctttcagaggaatgtaggtaagttattaaggttagttattttgattggaagtgattaaaaactaactcaaactgacttaagcaaaaattgaatttattgggtaaccttaagaaaacaattcagaagtagattttcaggcacagatggatgcagatgctctaactatgtcaccagaatgctctctccatttcttcttctctttctttctttctttctttctttctttctttctttctttctttctctctctctctttctttctttctctctctctctccctctttctttcttttcttttctttctttttctttttgagaggagtctcattctgttgcccaggctgcagtgcagtggtgggatctcagctcactgcaacctctgcctcctgggttgaagtgattctcctgcctcagcctcccaagtagctgggattacaggtgcccactaccatgcccagctaatttttgtatttttagtagagatggggttttgccatgttggccaggctggactcaaactcctgatctcaagtgatccgcctgcctcggcctcccgaactgctgggattacaggtgtgagccaccgtgcctggcctccctctccatttcatagcttccctttgtgtcgaccttattcttagacaagctctctgctgaagctctgtctccactagcttcagctcacaattccctcagttcaacacactcaatagaaagagaacaccccttttctgtaaacggcaatgcatgagctggatatcattctcaactctttgacttgggttatgggcccactcatgaaccagtcactgtgtccaggacaatggagtattctcattgtccaggcctgatcatttgccccctctggagtgaagtatggagtgtgtgtgtgtgtgtgtgtgtgtgacagagagagagagaaagagagagagagagagacccactaagggatcaagtgaggagaaagaagattcttcaaataaaaagcactgttgtcagaagtgagtgggtggtaggtggatctctacagggtgtctttgctctgcagagcaaccacagaggaactgggggtccatcttagcaagaagtctcacttcttgccttgaggaagagtaataagtggacttttatgattttttcccaggactgcttagcttggctcagcaggctagacaataaggcaataattcaagcagagtatggagtaaagagtaatgaataacctggtatgttcagggcaggacccaaaccaggagcagccccagaggggactctgagatgctctttgatgatggccacctccctgctccctgccctcagcatcttccatctccctgtgaagctgtgagctccatgagagctcaccggcagggaccacgtctgttttactgaccaccttctccccagtgcttagcctggtaactgtgcctggcacatgacaggggcctcacacatttataggatgattgaataaattaatgaaccaggttgatcagtctgactggcaggatctatctacctctctggataagtcaacccccttctttgacctctgttccccatctgtaaagtgggagaaggtatagaaagaaacactctccacagaccctgcagctcatgattccaggatcacagggttctcaggaaacagccaagatgcgtctcaagaagccaaatggaaggggaaatcaaatttattgagcacctcatgttcaagcgctgaatgagactaattcacgtggttcccaggtctccaaattgtgggattttatggatccataactttaataaaatttgggattgaaataggctatctactttttattttggcaaataaagacatttaaaaaacctcccgttaactatcaccactatttcttaaaagaagtgaattttttttttgcaagaagcaagtaggaaatacataatctcaaaacaaaaagagcagtccgacttccccactggaaaaaagacagttggcaatcttacatgatttttttttttttttttttttgcagataaaattgcatttcttgttgaaatttcttttagagacgaggtctgtctctgtagcgcaggctggagtgcagtggcacgatcatagcccacagcagccttgaactcctggcctcaaatggtccccccaccttaccctccctagtagctgggatgacaggcacaagacactgtgcccagctccagatacacattttgagattgacccgtgtatggggtccagtatttgagacctgctaacatggattgctttttgccaccccaccccacttacatgcctgtgaagtgtgacttaagctgcccactttacagatgaggaaacagaggtttagacagagtggtagtgcaaggtcacagagacagttttagactcagtttgtctgggttcaaacccacatcatcttgacagatcctaagccaaaggctattttccagcagggaaagaaatgaaccacgccggctcccccttggggtgcgcctggggtgttctgtgacctaaccctgtgcctggcctttgatgctttttccttaacacatctttatggtgtgcctacttcatgccaggcgctgagctgggggcaggggagagtgtagggagggaaaccaaaaatgtcccagcccctttctctcctgtcccctagtactcactctgggtctggttccccaggcctcgctccttgccctggcagccaacgaatccccatcgcaggcgtgggctgctaccagtttaaggggttccctctcccaggggtgttggcagtttcctaggagactctgggaaccttcaacgcctccaagacccaaaggactgaaagcgtaatggtgcaacttcaggcactgtgataggttccaggggaggtaattgggagtaagagatccgttcaaatcctgtcaaataataccccctccagctccttccccactcccataggctttgtggggcctcacagccccttagctcaggctggaagaagggagtcccctacatcgggggccctactgtggaggtgtgcttgctgccccggctgggggaccccaggtatcgtggccacccttccccccaactgccagaaccaggagcacccttccccggttccgccccgccccgtcccgcacgcccgctcgggagcgcgcctccgccgggccgcgccggtgcacgagagcgcgcgcctcggcgcgggagcgcgccccggggagaacccgagcaagatggaggccgcgcagaggccgccgcctgggccgaggcagccgctgctgggagcgccgagccgcggcgcctaggccgtgccagtcccggatccgctgcctccggccgtacccaggttggtctccccgcaccctttccccgcggccgcagcctcgcgcgcgtccggcctgggcgcggggcagccgcccccccaaccccggccctactcgggcccggccgctccccagccccccggggacagcccctgcccaccgcctgctcctcgcgggccccgctgctcaccggccccggtctttcgttcctttggcctggaaaccccctctctccaaccctggcccgccaatcctaggctccctccagcctacctccagccctggcttctgaggacagcccccccttcatcgccccgtgtccagcagtcccagcccccgatcccgctctagctgtatcctaattctgccactttgccctcttagaccctcataccagcccccattccccgtcccagcccccatattaccttcccaaccacccagtcccagcctcttaaattccctcttcccccatcctagaagcgcccaccaccgcctcatagtcccttgctagacacccaataccagacctccttctaccccttaataccagtccccaaattcccttctgagctccctaaattcagcccctctgctagtcctccaacaccagtctccagcctccattccacctccccttgtcccctcctactcccgtaataccagctctcaaaccccctccccaactcccccatggccactttcaagcacctccccccgcacttccaggtctcatatccccatcctaggcgccccccaactttctcatggccccctcctaggccccccagtaggagacctttgccagtccccctagacacggcctcaacactctcatgaccccttcctctctcccttagcagctcccagacgcccccagctctgccccaggccccgccctcgcgggttccttgactcagggccgcttctcgcgtgcgtccccagctcccgcccggcagcccggcgctccgtcccgggccggcggcccccgccagccgccgccgccgccggccccgcctccgggcaccatgctgccctcgcaggaggcctccaagctctaccacgagcactacatgcggaactcgcgggccatcggcgtgctgtgggccatcttcaccatctgcttcgccatcatcaacgtggtggtcttcatccagccctactgggtgggcgacagcgtgagcacccccaagcctggctacttcggcctcttccactactgcgtgggcagcgggctggcgggccgcgagctcacctgccggggctccttcaccgacttcagcaccatcccgtccagcgccttcaaggcggccgccttcttcgtgctgctctccatggtgctgatcctcggctgcatcacctgcttttcgcttttcttcttctgcaacacggctacggtctacaagatctgcgcctggatgcagctcttggcaggtaggggagggggtggacggaactcccagaacaagcgccagggacggggctccttcctgccaggtccccttcctgaaggagtcggatagattctgcttctctgtgttaagacactcacctctttggctgacggaccctcagtgggtattggggagggggtacgctgcagagagacaccttagggcaggggacagagccttgggactgggtgggtgggtctgtatgcttgggtatgggtacgctgcatttattgctcggttagcattaagttagtgtctctaagggtctctgttggctgtcttgggggaaatatttatctgagtgaggggttactgtaggtatgatcaatttctgttatgttgaaaaaaagcatgaaatggtgaatcaagagatctggcttggacttttaatttgttgacactatcaacttgggtgtttcactttacttctctgaggctcggtttcctcatctgtaaaacaggggagaagattccaaaaggacaaatgaaagagtgttttgtaacctttaaaatgctgtgataagggggagaggctgtctattgtgcttatccagtgtttgagatgtgagtggttgaaagcattgggtgatatgggtctctggagggcaggtctccatccccactcccacccctgcaccatgcaagaaagttctggtgccatgcccaatgggagtgagtccctgagaccctccgaaatgtttgaccaagacagtcatcttaccctaagaaccagagaagggctttttgggaatgagaaatgctgagacagttttccaggatccattagagtcccccacttccacccacctttcgatcagagatagattttgaagactcagcaacttgggcttttgcctaattgctggcagggaagagagttggactggggaaagtggggccaggggatgggaggggtgggggaggagagctagtgaagggaaaagtttggagtcttccagggatgagaaagagaagggggaaatgtgattatcatgcagcagagatggttttttaaaataagcacctcaggacattcaacaagtgactgccattccaaaagagaccccctggaggaggcattatatcacttgctgatgattccattgttcagagcattgcagggaattagctttggagcatggggtgtaatcacttgaatatcttcattgaggagaaacctctatcttttaaaggaggaatgtaacttttggaaatggctggaagtcactccagatcaagtatagagaatacgatgggtcatcaaattgataattgtcacttggaatgacagccaaggtgtgaggacaaagtcatgaggctggtctgtttccacaagaggacttttacaaatccagggaggaattactgcctcattggaagaattgcccaaactcctaaaaggactattttgaagaaggcagatgtggacattctaatgggcttgtttcaaattcatctcacccaactcaatttagatgtggatctttgaagagggtgggaaaggtgaactataggatatgggggatatggctccatacttctctgtggtacccagggaggtgatattatgtatttctattctatttctcctgcaaaggcaagctggaatcctcaactcatcaaccttaatttggagtctgcagatgggttgctgacctcttggctttcaaattctctgtaatctgtgtgggtttaatcctggggatttgatgaattgtccaacaacccccatataataatagaatttcaggcaccttagagatcagctccttcaaatcccaccttcccctccccctgttttagagagaggaaactgagtatagagatgggaagggcttacttgaggtcacacagctgttaagggaggaagctagttctacagccgggggtccttgacttctggcccagggcacttttgcttgcattactgccccacccatgtgggctgagggggcagttggcagagttgagcagtttattccattttgttcagagatttctgagttctctgggtgagtgactgattcactttgcttaataaagtgacaccaggccagaagccagaccactggactacgagtcttggggtgggggttcttggctgacttgggtctgtgactcaccatgcagtgttaagtaagccttttagtttaaatctcaatttcccatttgtacaataggggactgggagcaggtagataaggtgatttaaagtatctcttggccaggcatggtggctcatgcctataatcccagcactttgggaggctgaggtgggaagattgcttgaggccaggagttggagattagcctggccaacatagcaagaccctgtctctgcaaaaaataacataaaataagtaaaaaataaagtatctctttcagccctgtggggatcctgggacaactctttcatcaagatcattccattcagaaagtgataaatcagtcatcctcagaggaactgtggagaatcaaagggctctgtttttgtcagataagaattaaagtgcctctcatatgattttgtacctgttaactttttttttaaattttgagacggagtttcactcttgttgcccaggctggagtgcaatggcatgatcttggctcactgcaagctccgccttctgggttcaagtgattctcctgcctcagcctcctgagtagctgggatcacaggtgcctgccacaacgcctggctaattttttgtatttttagtagagatggggtttcgccatgttggccaggctagtctcaaactcctgacctcaggtgatccacccgcctcagcctcccaaaatgctgggattacaggcatgagccaccatgcctggcctgttcctgttaacttttattcaagtattttagggtcttctgagtgcagagcatgggggcattgggaaaatacaaaaagatatttattcttttgtttgttcttcaccagctctataaccatccctatgcttagtcctgtaatactgagatgcataagacatcatccctgtctccaaggatcttaggtctataaaatgcaattcctgctctcagggagcatactgtctagttacgtcactatattagtcagcagtttttcagtggcaaatgacagaaacccaactcgagctggcttaaataaattagaaaaaaataaagaggctagggtttatcggctcacttaatttgaaagtcaggagtatttggcttcgggcatggacagatccagatgttcaaatcacgccatgaagaatctgtctctctccatttcttggttcctctgtgctcgctcattttaaatccacttctgtcttcaaggtgacaaataaggctactagtagatctaatttacattgtttcagcttagcagtgcttgtggaaaaagaataattccagcaaacgttccagggctgagccagattggcccagcttggtcaagtgtccacctcttaattaatcatggtgactctgtctaaggcccgagccacatgcctatccctggaaccacacatggactgatagtggagaaaggccaattccctcaaagataaatcaagtgtgagcactggaagaggggtagcatgggcaagacaagcgccaacagaagttttcccctgggcagtctgagcactaatatgtgcgggctggaaatgccatggaaacccggagcagcagagggggctgccagcttagttgggaagcgaggcttgagctgggcagggtgttaccaggtgggaggtatgagagagcatcctgaatggagaggaagatcatgggcaaagacacagcggtgagaaagacacatctggcttgagtgtggcatccacataggggagcagcatgaggagaggagaggaaggaattatgggggccacagtatgctgggtcaaagaatttcgactttaatcagcagcagttggatactgctatgactgttatcattattacagaaaaatagctaacattttacatgcattatataatttgatactcacaacaatcttgtggagtaggtaccattattcatattgtataggtgagatcaagctgagcttcaaagaggaaaaagtcatttgtccaaggtcatacagttggtaagtggtggagcccgaattgtaactccatatgtctgactctaaaaccggagatcagccaggctcggtggctcatgcctgtaatctcagcactttgggaggctgaagcaggctgatcacttgagctcaggagtacaagacaagcctgggcaacatggtgaaaccctgtctctacaaataatacaaaaattagccagttgtgatggcatgtgcctgtagtcccagctactcaggagggtgaggcgggaggatcgcttgagcctgggaggcggaggttgcagtgagccatgatcatgccactgcactccagcctggatgacagagtgagaccctgtctcaataaaagaaaacaaaacaaaacaaaacaaaacaaagaacaaaaatctccgagatcttggttaaaggaggattaattgtggggatagcaacagcatgtttttgccagaagagtcaactgctaactaagtagagaggcaggatatctctgctacgttttttacccggttgttcccatttactaagaatatccaatgtgccagcttctatgctagacgttttcacactcgttgtcatttaatcctcatctgttgaaataacttgctccaaggtcacacatttagtgaaaggtggagctaaaactcaacgcaagtctaatacagatctagaacctgtttgtatcactgaactggaacccaggaagtgaatacacaaattacagagctataatctccatggactaaatgttacctgtgggcccggtgtagttagccgggggacactcccaactgggtttgagattcaaggtgaagtgtggttaagggtcgggggtgccaggataagtatgtgctagtcgtgtaagaccacaggacttatggccaggcacagtggcccaggcctgtaatctcagcattttcgaaggctgaggcagaagggttgcttgagtctaggagtttgagaccagcctgggcaacatagtgagaccccatctctacaaataatttaaaaattagccggatgtggtggcactcgcctgtggtcccggctactcaggaggctgaggtgggaggattacttgagctcaggaggttgaggctgcagtgagccatgatcatgccgctgcactctagcctgggcaacagagccagaccgtgtctcaaaaataaaacaaaacgaaccaagaatagaggacttagaatccctgctcttccactttccaactgtgggccttggagaaatgggtttgcctctctgaatctcagtttctccatctataaaaatagaaattatcattgcacctgctttggaaatgaaggtagtaaaatgctgagtgtggtcctggtgtatgagaagcattcaatacatagtcgctgttactcttgtgacatagtccgagggaagagcagtttgtgagggatctttgacacttagagtttggacttgctgggatgaccaaagggcttaagaaggcataaactgtcagctggaaagagtcttatcaatccacttccccaactccctcattttaaagatgtaaggactgggtctgagtctcagagagaagggacaagttcatggtgacagagtgagacttgtacccagacctatcctcattccatggaagggaggtggttctgaccacattcattcaatactaagtgcttattgtgtgccaggcaccaccctggtacctggaccgcagcagagaatagaatgtgtagaatggaatggaagctggtggaccctggaggtgggaggaggcaggaagaggggtttgggggatctagaagtgagtacctttcagccttccagttgtgtgttctttttttctttttcttttttttttttttcagaccgagtctccctctgtcacctaggctggagtgcagtggtgcgatctcagctcactgcaatctctgtctcccgggttcaagcgattcttctgcctcagcctactgagtagctgggattacaggcacgtgccaccacacctggctaattttttgtatttttagtagagacagggtttcaccatgttggccaggctggtctcgaactgctgacctcaagtgatccgctggcctcggcctcccaaagtactgggattacaggtgtgagccactgcacctggcccagatgtgtgttcttaattatcagggtctctgggctaggaacctcaaccaggaactcccatcactatggcatagaatattcatctacatttctctccatttctttctttcttttcttttatttgaaactgagtctggctctgttgtccaggctggagtgcagtggtgcgatcatggcttactgtaaccctgggctcccgggcttaagaaatcctcccacctcagctccctcagtagctagaactacaggcacacaccaccatgccttgttaattattttattttattttattttatcttatttatttatttattttgagatggagtctcactctgttgtccaggctggagtgcagtggcatgatcttggctcactgcaacctccacctcctgggttcaaacaatttctagctaatttttgtattttttagtagagatggggtttcaccatgttggccaggctggtcttgaactcctgacctcaggtgatctgctcaccttggcctttattctattttttgtagagacagggtctcactatgtttcccagactgttcaactcttggccttaagtgatcctcccaccttggcctcccaaagtgctggaattaccggcctgagccaccatgcccagcacattgccctgggtcttgtttcagatttgatttggaattttattcttccactgtctttgttgtatgtgcgtgatactgataaacacattgagagaatttctttccgctttccctcctcctctccctctttcctctgttcctccctcatttctttcttcctcccccaattctcccttccttcctctctcttttttagtacttttgagtcactgttttaccttctttcctctcttctgttctcctttccttccctccctttacttttgcctcacttccctctccccacccctcttcttgtgtttctcacatcaaccctttactgaccgtgtcgtgtgtgtgtgtcaggcactgtgctagcctctagaaatcctgagtaagaatccttgctcccagggagctcatagtctgatgggagaggcaggaacaaaaacagatcatcacaatatggtacaatacatgaaatgggagattcatgtacagggtattctgagggcagggaggggacttccaacacagttaaagagagccagggaagtcttcccaaaagggtaacatttgagctgagtcttaaaggatgggtaggaaagaggaacaggatgatcacaggcatggaggtgggaatagtagctgtatctggggactctaagcaactaggccaggaaaggtaagagttgagactggggaagtgggccagagctggattgtagagaccttctaagtcatggtaaggagtttagactttatttgtttttgtttgtttgtttgtttgttttgagatagagtctcactctatggcctggtctggagtgcagtggtctgatctcggctcactgcaacctctgcctcccgggttcacgcaattctcctgcttcagcctcccgagtagctgggagtacaggtgcccaccaccatgcctagctaatttttgtatttttagtagagacggggtttcaccatgttggccaggctggtcttgaactcctgaccttgggtgatccacctacctcgacctcccaaagtactgggatacaggcatgagccaccatgcctgaccccagactttacttgtagacagcagttcattgttaaagggttttttttttttaatttttattgtaattatttccagacttttgactctttggaaaagtaatacatgtacaagagacaaaatttggaaggtaaaaagggtacacaggcagacataagtctcctttccatcctctcccccacctgtttctcccagagacaacccccattaccagtttcttgagtaccctttccaagaaatttcttaaatatgcaagcaaatgcaaatggtgtttttacataattagagtattatttatctatagctgcataacaaattaccccaggctgggtgcactggcactcatctgtaatcctagcactttgggaggctgaggtgggctgatcacttgagcccaggagtttgagaccagcctgggcaacatggtgaaatcccatctctacaaaaactagctgggcatggtggcacacgcctgtaattccacctactcaggagattgagatggaagggtcacctgagcccagagaggtcaaggccgcactgagccgtgattgtgccactgcactccagcctgggtgacagagtgagatgttgactcaaaaaaaaaaaaaaaaaaaaaaccacaaccaaaaacaaacaaatcaccccaaaacgtagtcgcctgagtcaacaagcatttatgatatttgtttctataaagtcagagtactttgggagcagcttagatgggcaggtagctatgactcagggtctctcatgaagttgcaaccaagacctcagctggggctacagtcatcctaaggataactgggctagaggacccactttttttttcttttttttttgttttgagacagaatctcattctgttgcccaggctggagtgcagtggtgcgatctcggctcactgcaagctccgcctcctgggttctgcgattctccttcctcagcctcccgagtagctaggtctacaggcgcccgccaccacgcccagctaattttttgtatttttagtagagacggggtttcaccatgttagccaggatggtctcgatctcctgacctcgtgatccgcccacctcggcctcccacagtgctgggattacaggcgtgagccaccatgcccggccgaggacccacttttaagttcattcatgtgggtgccggcaggagacctgagaatgagtgctccgagagagaaaaaggaagaagccacactgcccaccccctttttgtggtatcagttgtattgagatataattcatatgtcatataattcacccatatcaagtgaactattacatggtttttaatacattcatggagttatgcaaccatgaccacaaccagttttaggatatttttcattatctcagaaagaaacctcatgcactttagctatcacccattaacccctgaccctccttccttctcagccctaagcaaccactaatttattttctgtctctatgtattagcctattctagacacttcatataaatgggatcatataacatgtgacttttttttttttttttttttgagatagggccttgctctgttacccaggctggagtacagtgttgcaatcgtagctcactgcagcctcagtctcgggctcaagcgatccttccatctcagcctcccaagtagctgggactactggcacgtgtcaccatgcccggctaatttttttaaaattttggtagaaacgaggtctctctatgttgcccaggctggtcttgaactcttgaactcaagcaatccttccacctcgatctcccaaagtgatgggattacaggtgtgagccaccatgtcagggcactatatagtcttttgtgactgacttttttcacttagcataacattttcaaagttcattcatgttagagcacatatcaatatttcatttctttttatggctgaataatatccccttgaatgggcataccatgttttgtttatccattcatcagctgatggacatttgggttgttccaccttttggctattatgaagaatgctataaacatttgtatacaaatttcttttttttctttttgagacagagtctcgctctggtgcccaggctggagtgcagtggtgggatctcagctcactgtaagctccaccacctgggttcaagcgattcttgtgcctcagcctcccaagtagctgggattacaggcagatgccaccacacttggctaatttttgtagttttagtagagatggggtttcaccatgttggccaggctggtctcgatctctcgacctcaggtgatcctccctccttggcctcccaaaatgctgggattacaggcatgagtcaccacgcctggccttgtgtacaagtttctaggtagacacatgccttcatttctcttgggtacttacctagaagtagaattgcctggacaaatgagaactctgtatttaaaattttgagaaactgacagatgttcccaaagtggcttgccaaatccaagattgcaaagatttacccctgttttcctctaaaggttttgtcgttttggctcttacatttaggtctttgatccattttttttttctttgaggcgaaattttgctctgtcacccacgctggagtgcagtggtgcgatctcgactcattgcaacctctgccctccaggttcaagtgattatcctgccccagcctccctattagatgggattacaggcacacgccaccacacttggctaatttctgcattattagtagagacaggttttcaccatgttggccaggctggtctcaaactcctgacctcatgtgatccacccgccttggcctcccaaagtgctgggattacaggcgcgagccatggtgcccagcctttgatccactttgagttaatatttgtatacggtgtgacatacagggtccaacatcattcttttgcatgtggctattcagtttcccagcaccaaggttgttctttttccactgaatggttctggtacccttgtcaaatgtcaattgactatagatacatagattgctttctagactctcaattctattccattggtctatatgtctatccttatgccagaccagactgtcttttaaaaatttttattttgccgggtgcggtggctcacgcctgtaaccccagcactttgggaggccaaggtgggtggatcatgaggccaggagttcgagaccagcctaaccaacatggtgaaaccccgtctctactaaaaatacaaaaaatattagctgggtgtgctggcacacacctgtaatcccagctactcagggaggctgaggcaggagaatcgcttgaacccaggaggcagaggttgcagtgagctgagatcatgccattgcactccagcctgggtgacagagtgagactccatctcaaaaaaaaaaattattttatttttaaaatttattttcatttcttattttttattattatttttttttgagacagggtcccactctgtcgcccaggctggagtgcagtggtgtgatcacggctcactgtagccttactcaactgatcctcccacctcagcctccccagtagctgggaccacaggcatacaccaccatgcctcattaattttttttttttttaaatttttgaaaagacagattcttgctatgttgcccaggctggtctcaacttcctgagctcaagcagtcctccctcttagcctctcaaattgctgggatgacaggcatgagccactatgaccaacccaggctgtcttgattactgtcactttctagtcagtttgaaatcagaaagtgtgagtcctccaactttgttcttcattttcaaggttgttctggctatcacactgccttttatgtcctgatagcagacatcacacaccatcacttctgccacactctattacaagaagtaagttcctaaatccagcccacattctagaagaggagaattaggatccttctcttgaagggaggaatatcaaagaatttgtggacatatttccaagccactgctaatggtaatatactaaacatttggttctgtggcttgctttttcactcaacaatacatcttggagatagttccatatcagtgtataaagagccacctttttcttaacagccacgtaataaacttttctataggtgcatcacaatttaattaatatttatttacaatattttgctataataatgcttcagttaataatgttatatgtaaataatctaatacatatgtaagtataaggataaagccctagaaggggaattgctggttaagtggtatatacatttacaatttgacagatctatcaacagtgtccttcacagacgttgtacaaagttacactcccaccagcgatgtatgatagtacctgttcctccatgtccttgttaactgagtgtgttatcaaatatttcatttttttccaccctgatagaaaacactctcttattgtggtaatttgcctttctattattatgaatgagattgaatacctcttttatatatgtaattgttatattatatatatatttttaaactgtcatttcttaaattttgaaaatcaatgtaatggcatttttccactttgatttgtaagagctctttatctactaagaaaggtagccttctgtgtgtgagatgagttacaaatattgcttctcagtttatcttttgactttgtctatggatttttcccccatggggaaattattttctttttactataagcaaattccctcttttatggttgctgggtttagtgttatacctagaaaggctctgaagtgtttcaagtctgaggggaacatgatcggatctggttgttggtggagaggatggattggaggtatcaggaggacaagggttgaactattccttttttttttttttttttgagacgaagtttcactctattgcccaggctggggtgcagtggtgcaatctcggctcattgcaagctccacctcctgggttcaaacaattctcctgcctcagcctcccaagtagctgggactacaggcgcccaccaccgtgcccagctaatttttgtattttttagtcgagatggagttttgccatgttgaccaggctggtctggaattcctgacctcaagtgatccactcacctcagcctcccaaagtgctggattacaggtgtgagccaccatgcccagccccagaggaatttaatgcattatgagtgccctggatcaggaatctgtacctggcatataggtgcttaattaatgtctattgaatgaattaatgatgatatctgatttaagtctcagctctgccacccattcctttggaggcagcacagtttagtggtcagaaaacctgaatttgggccgggagtggtggctcacatctataatcccagcactttgagaggccaagttgggcagatcacctgaggtcaggggttcaagaccagcctggccaatgtggtgaaatcccatctccaccaaaaatacaaaaaattagctgggcgtggtggtgcatgcctgtaatcccagctactcaggaggctgagacaggagaatcccttgaaccagggaggcggaggttgcagtgagccaagattgcgccattgcactccagcctgggtgacagagcaagactctgtctaaaaaaaaaaaaaagaaagaaaacctgaatttaaattctgactgtggtgttaccaactaagtgctctcaggaatattacctgatttctgagtctcggtttactcacctataaaatggggacaataataataactgcctcatggcgctgttgaaggattgattgtgaatttgcgtgcacaccatggcacaaacaaaacacttaataaacgttagcaattattatttgttgttgtgtgaccggaatcaaatcactttggcttcagctttccaacattccatggcctgtgctagaacaagggagaaagggttgaaaagtgggaacagttgggagaggagcctggagaagtagttagggctggcttatggagggccttgacagtggctttggagttcgggtcttattcctagatgatggacaatcactttcaggcatgggagtgaccagggtcagatgtgggtttagaaagatgacttgggaggctgctgcggagaatggaccagttggaggcttgatgggaggagggagcccgggaagaaggcgatccaggtgagagatgccaaggatggcggatggagaggaggagaaagattggagacctatttagaagaccaatgggtgtgttggttttgaggacaaggcagttgttacaatgactccaagtttcttacagataattgggtctgtggagtgacattcacaaaggacataggatgaagatcagacctagggtggaggaagagaaggtctatttgggaaacactgattttgaggttcttatgggatgtgcaaggggaaaggtccaatgagtgttactgaggtctggggatgaggagaaggtctcagctgtggatggcgatttgaggcatcattgtatgaatctgagcatagatgaaattgcccaaggagaacgtatggagggagaagagacagcctagggaacagcaaccttaaggggcgggcggaggaggaagagccagaaaaactaactgtgagacaggagtcagagcaggaggaggcaaattagcaattgaggggctgaggaagataggctcgaggaaggccacatgtctgcaggagaaggtggacttggaagggatggagagagcagtgggaggcttttcaccaaatcctagaggtggatgtggcagagccagcctaggacaataggggtaccctgaggagggacagatgccaaggttattaacaggctgtggactccttgcaggctgggcctagggtggcagatgagagtaaatgctgttaccaaataattactgcacaaagtgatggggttccatctctccacaagtcatctgtgatgccagatgccattatttgtgttcccaacagtacccccctccaaaactgtgagcccctcaaggtctggaaccacgagttgagactgaatgacttagagaaagagtgtcccaggaagagaggatgaatttgacacgttttcaggaacagaaaggagggcagtgtggccagagtgcaagcgagaagctgaatggcaccagaggaaatggagggaggctggggcctggaagccacggtcagctgttggcaggattttattctgaatgccatgaagagagagttaagtaggagagctggtttctttcttttttttgagacagggtcttgctctgttgcccaggctgcagtacagtggcacgatcatagctcactgtagcctcaaattcctgggctcaagtgatcctcccatctcagcctcctgagtagctgggactgcaggcgcgcactaccacacccggctgaatttttttttttttttttgagacagagtctcgctctgtcacccaggctggaatgcagtggcgcgatctcagctcactgcaagctctgcctctcaggttcacgccattctcctgcctcagcctcctgctaattttttttttagagatagggtctcactatgttgcacaggctgatctcgaactcctggcctcaagcaatcctcccatttcactcttccaaagtgctaggattacaggcatgagccactgtgcccagccatgataccatttgtttttgaatgttcattctggatgctgaatgtggaacaggtgatggtggagcaagggtagaagcagagaaactagtttgaaggtgactgtggtaatcagggaggaaggtcatggggcttggagcaaggtggtagctagcagtggagatggagagaaggggtctggtgctggacattttttggaggttgagttagtcagccttgcaaatggattgggtgtaggaggtgagagaaagggaggatctaggatacctcccaggctggcctcagcatctaggttgttggatgggacaggagtcacctcctaggagctgataggggcattaagattgggcctggatgtctcagattttaaaaggagaagctcagtctcccttgtaagataagcccctgccctggatgggcaggaacagagctgagtgctcagacctggtagggagggcctgtggacaggcatctccaacccacttcccgaacttccttctcctgggggatctccctgtgagacagttgtcaccacggcccccttgtgtcctggggaagccattccctttgaaagctgtggcccccctggccagacctggtggctcacgcttgtaatcccagcactttgggtgaggtgggcagatcacctgaagtcaggagttcaaaaccagcctgggcaacatgatgaaaccccctctctaaaaaaatacaaaaattagctgagcgtggtggtgcgtggctgtagtctcagctattcaggaggctgaggcaggagaatcgcttgaacctggtaggcagaggttgcagtgagccaagatcatgctactgcactccagcctgggcaacaagagtgagaccctatctcaaaaagaaattataatgaaaataaaaatataggaaagcaagcaagcgagcaagcaagctgtggccccaatgtggacagaaatcattcactggactcccctcagtctcaaacctagccaggtccttctggaaaaaccttcctaaattgaaggagggactgtcagcggacacaaacagctggctgtgtattctgtgctacagtgattctttgtatatctcaccttttctaagagttttattgctttttaaaaattatcattgttctttgtggaaaaattggagaatatattttgagcagaattacacccgtagtcttagtgtctcagcaatagtcattcttcactgcatagtctatactcataacagtatagagtgctggttagaagcaggctgtctgggtccaaatcctgcaacttaccagttgtgtgaccctggataacttggataacctcaaacgtcttgcacctcagtgtcctcatctgtaaaaagaagataataacagtatctattccatagagttgtagagattaaatgaactagcatgtgtaaagtacttattatagtgcctggcatggtaaattctatataactatttgctgtcactgtgtgaacatttttcccaaaaagaaattatgttgtgtgttatttttaaaagccttttgagacctaacacatcatgagtatttcttatatatcattaaaccttcctcagtatacttttagtagctgagtagtactctgtggtatgaaagagctatattcctgtatcgatatagtaggagtttttgtctttcctcccttccttcattatttctcctccttctcctccccttgctcttatactcttcctcctcatctttttcgtcttcccctccctctttcttttataaacagcaacgtgatgaacatcctcacagttaaatcttagaggacatctgtgaacattttcttcgataaattcctgtaaattggcaagctcagtcaaaagaggtttaaacgtttcatttttctgtttttgagattaatccatgatttctataagttacatttgacctctgcattgcctttctttgctgctttaattatttcattccaagtgaatgaaaatctctggtaatagtcatttactagcagtcaaaccccacccactttatggtttctgtcggtaatttatttacccggcttcaaattcaaaaggtgcaacaggttatcagagaaaaatctgctcctccagctacccaatgcccctctttagaaggagccaaggttgtcagtgtcttataaatatgtctgaaaatattttatgtacctgcaagaaaatatacccccacatacatatgatttcctgcctctttgcaatgggaacattgtgcagtatttgttaccatgagccttgcctttcacttagcagggtatccagagatcattccacaccagcacataaggagcttcctcattctctttaatgactgattatattattgaatgctactgcaaaggggcactatacctaatcagttacctatcggtgggcatttaagttatttccaatgtttacttattacacatcatggtatgcaacccccctactttttttttttttaagaaaaggtcttgctctgtcacccaggctggagtgcagtgggacaatctcaggtcactgcaacctctgcatcccaggttcaaatgattctcctgcctcccaaatagcggggactactgcatggtggcatgcaccaccatgcctggctaattttttggtattttttgtagagacggggtttcgccacgttgcccaggctggtctcaaacccctggactccagcaatccacctgcctcagcctcccagagtgctggaattacaggcatgagccactgtgtccgaccctatgcaacctttttttttttaaagtcataaatctacagcccaaagaaaatcacaaagtgaacatgactatgaaaaaagcacctaggtcataaacctcattcccccttccagtcactcctccaaaggtaatcctgactttatttttttttgagacagagtcttgctctgttgcccaggctggagtgcagtggcacaatctcagctcactgcaagctccgcttcccaggttcatgccattctcccgactcagcctcctgagcagctgggactacaggcgcccgccaccacacccagctaattttgtgtatttttagtagagacggggtttcatcatgttagccaggatggtctcgatctcctgacctcgtgatccgcccaccttggcctcgcaaagtgttgggattacaggcgtgagccaccgcacccggcctgacttttaatcctatagactgattttgcctgtttttgaaatgtatataaatggaatcacacttttgcttcacatgaagattcatccaggttgttgcaggtaaccacagtttgtccgtcttcactgctgtatactattttgttggagtaaactgcacaatttatttatccattacattgttaatagacatttgtgttgtttccaatttgggattgtgagtaaagctcctacgaaccttctagcacatatgttttggtgaactcatctacacagttcagctggggacagcctgaaaagaggggtctgggtctaggggatggttcagtgggttcagccccagcagatgctacagcaagcagcttttggagactgtaatacctggtgctggatcaccttccagtgcctgccccctttgaacttgtagacattttccttctcttgctgaggagggtcctagcacacaggggacatgtggcgtggggtgggcaggtgaaagctcctttggcagcttctgcagccccgcactgtcctccagggcccctgcagcagcagaatcttctgcccccactgaggcctgtttcttccctatagctgaacttccatctgcagggcctgggggacagggacccaggtgaaaaagtggtaggtggcagatcagagaggccacatcaagggagaagggagtggggcctctggagagtctgttcaaggacagaagaccctgagcacacccagcctgatcccctataacaggtggcagctgtgttgagtcatgcacagaggggcaactgaacacaaaaaaggcctccctaaaagaggatggtgtaaccgtgttctaatgaaaccctattaaaaagataagcataggccaggcgcggtgcctcatgcatgtaaccccagcactttgggaggccaaggagggaggcttgaggccaagagtttgagacaagcccagaaagagagtgagactccatttctacaaaaaaataaaaattagctgggtgtggtggcttgtgcctctagtcccagctactggggaggctgaggcaggaggatcacttgagaccagttgtttgaggctgcagtgagctatgatcacaccactgtactccggcctgggtgacagagcaagaccttatctctaaagtataataataataacaataactcaaggccgggcacggtggctcatgcctgtaatcccagcactttgtgaggccaaggcgggcagatcacctaaggtcaggagttcgagaccagcctggccaacatggtgaaatcccgtctctattaaaaatatttagaaaattagctgggtgtagtggtgcacacctgtaatcccagctactcgggaggctgtggagcaagaattgcttgaacctgggaggcagaggttgcagtgagccgcgattgtgccactgtactccagcctgggtgacagagtgagactccatctcaaaaccacaacaactaaaaagcaatagctcagcataaaatgcattatgaaaaggctttacataaaagtacatcgatagcacaagctttaaagaaaacaagcacctgagtataaagtatatgttctcttattctttacctcttcttaggctcatcctaattttattccctaaactcaagtaatcttcctttgaactctcctttagttttttagtcttttcttttcttttcttttcttttctttctgagatggagtctcgctctgttacccaggctggagtgcagtggcccatcttggctcactgcagcctcccgttcccgggttcaaacaattctcctgcctcagtctcccaagtagctgtgattacaggtgcgcaccacacacctggctaatgtttgtatttttagtagagacggggtttcaccacgttggccaggctggtctcgaattgttatttcagatgatccacccgcctcggcctcccaaatgctgggattacaggcatgatccaccatgcccagctgagtttcttatttcttaaaagctctccttccctgcctccttccctctctcccccaggctacttctcagaggtaaccgtcattaagctgcttctgtatccttccagacatgcttatagatactcaagcgtatatgcaggcatacctcgttttattgtgctttgctttattgtgctttacagatattgtatttttaatatattgaaggtttgtggcaccctgagtcaatcaagtctgtcggaactattttccctgcagcacgtgcccacttcgtggctctgtgtcacatttttgaaattttcacaatatctcaaacctttctattatgattatatcttttatggtgatctgtgatcagtgatctttgatgttactattgtcattgttttggggcaccatgaactgcgcccatgtaagacagcaagcttcataaataaatgtgcgtattttgattgctacacctgctggctgttcccctgtctctctccctcctttggctttcctattccctgagacacaacagttttgaaattaggccagttaataaccctgttatggcctctaagtgttcaagtgaaaggaagaatcatacatctctcacgttaaatcaaaagattgaaatgtgggctgggcctggtggctcacgcttgttatcccagcactttgcaggaggctgaggcaggaggatttcttgagatcagaagttcaagaccagcctgggcaacatagtaagactctgtctctaaaaaataagtaaataaataaatatttaaaaacaaaagctgttaatgatgaagtagtgaggaaggtgtgtcaaaactgagataagccaaaagtgagggctcttgtgcaagttggccaagttgtgaatgcaaaggaaaagttcttgaatgaaataaagtgctgctccggtgagcacatgaatgatgagaaagaaaacagccttatttcagatatggagaaagctttagcagtctggatagaagatcaaaccagcacagcattcctttaagccaaagcctaatccagagcaaggccctaactctgttccattctgtgaagattgagagaggtgaggaagctgcagaagaaaagttggaagctagcagaggttggttcatgtggtttaataaaataagccatttccatagcataaaagtgcaaagtaaagcagcaggtggtgatgtagaagctacagcaagtcactagaagatctggctaaggtcattgatgaagatgggtagactaaacaacagattttcagtgtagatgaaacagccttctgttggaagaagatgccatctaggtcttttatagctagagaggagaagtcaatgcctggctttaaagcttcgaaggacaggctgactctcacattagggacccatgcagctggtgactttaagttgaagccagtgctcatttaccacgtgaaaattctagggcccttaagaattatgctaactctattccacctatgctctataaatggaaaaagcctgaatgacagcacatgtgtttacagcatggtttactcaatattttaagtccactgttgagacctattgctcaggataggaaaaaaaaaaaaagagccaggcacagtggctcatgcctgtaatcccagcactttgggaggctgaggtgggtggatcagaaggtcaggagttcaagaccagcatggccaagatggtgaaaccccatctctactaaaaatacaaaaattagccaggtgtggtggcaggcgcctgtaatcccagctgtcaggagcctgaggcagagacttgcttgaacccgggaggtagaagttgcagtaagccgagatcacgccactgcactccagcctgggtgaaagaatgagcctccatctcaaaaaaaaataaataaataaaataaaagattcctttcaaaatattagtgctcatttataatgcacctggtcacacaagcgctctcaggaagatgtacaaggaggttaatgctgttttcatgcctgctaacacaatatccattctgtagcccatgagtcaaggagtaattttgactttcaagtcttaatatttaagaaatacattttgaaaggctatagctgccatagataagttgttcctctgttggatctgggcaatgcaaattgaaagccttctggaaagaatttaccactctagatatgccattaagaacattggtgattcatggccgggcgcggtggctcgcatctgtaatcccagcactttgggaggccaaggtgggtggatcacaagatcaggagttcgagaccagcctggccaacatggtgaaaccccgtctctactaaaaatacaaaaattagctgggtgtggtggcacgcacctgtagtcccagctacttgggaggctgaggcagaagaatcgcttgaacctgggaggcagaggttgtagtgagctgagatagtgccactgcactccagcctgggtgacagagtgagactccatctaaaaaaaaaaaagaacattggtgattttcctaaacccgggaggtggaggttgcagtgagccaagatcgtgctactgcactccagcctgggccacacagtgagattccatctcaaaaaaaaaaaaaagttggggggctgggtgcagtggcttatgcctgtaatcccagcactttgggaggtcaaggtgagcagatcacctgaggtcaggagttcaagacgagcctggctaacacggtgaaaccccatctctactaaaaatacaaaaattagccagtgtggtggcacacgcctgtaatcccagctacttgggaggtagaggcaggagaattgcttgaacccgggagacagaggttgcagtgagctgagattgcgccactgcattacagcctgggcgacagagcaagactccgtctcaaaaaataataataataataaatggaacattggtgattcatgagagaaggtcaaaatgtcaacatgaacaggagtttgaaagaggttaattccagccctcatggatgactttgaggagctgaatacttcagtggaggaagtaactgaaggtgtggcgaaaatagaaagagaactagcattagaagtggagcctgaagatgggactgaattgctgcaatctcatgatcagacttgaatggatgaggagttgcttcttatggatgagcagacagtggtttcttgagatggaatctactcctggtgaagatgctgtgagcactgttgaaatgcccacaaaagatttaaaatattacataaacttagttgataaagcaggagtagcatttaagaggattgattccaatgttgaaagaagttctgtagataaaatgctatcaaatagcatcatatgctactgagtaaacttttgtgaaagaaaagtcaatcgatgtggcaaacttcgttgttatcttattttcagaaattgctacagctactcaaaccttcattgcaacttgctgaaggctggctcagatgataatttagcaataaagtattttaaaactaaggtatacacattgggttttttttagacatatgctattgcacactattagtatatagtgtaaacatgactttatatgcattgggaaaccaaataatttgtgtgacttgctttattgcaatatttgttttattacggtggtctggaaccaaactcgcaatatccccagggtatgcctctgtgtgtgtgtgtgtgtgtgtgtgtgtgtgtgtgtgtgtgtgtttgtatttgaaaaattaatttgtacaattattggttttctgggtttttaaaaaaattattccgccacactagtctactgtatatgggttttgtttttgtttttcagacaacatctggctctgttgcccaggctgcagtgcagtggcatgatcttggctcactgcaacctctgccttctgacctcaagcaatcctcccacctcagccttccaaatagctgagactacaggcgcttgtaccatgcctgactaattttttgtagagatggggtttcaccatgttgcccaggctgattttgactcctgggctcaagcaatcgtcccacctcagcactcccaaataagtgagactacaggcatgcaccacgatgcccactaactttttgtattattattattttttttagtagtgtcagagttttgccatgttgcccaggctagtctcaaactcctgagctcaagtggtccacctgccttggcctcccaaagtgttgggattacaggcatgagccacgatgcctggtcaaaattatgtttttaaatttcacaagtaatatatgaatatacccactctgtaaaaagctgaaatattacaaaaagactaaagtccccacccaagccccacccagaggccaccactcttataaacttcatttctatcttccctgatctttttctgcacatttacatatatatccataaggaaactatatcatgtcatcttctgtgtacccctgcttacttctttctcccttccctttcctttccttccttctgtctccttccctccctccttctcttccttccttcctttcagtgaaatacatgtacatgaaatttaccattttaacctttttttttctttttttcttaaaacaacaaaaatttattcttgttctggaggctaagaagtccaatatcaaagtgtgggcagggcctcatgccccctgcagactctgggagggaagcttccctgatctcatctcccttcttttggctgtcagccttcctttgtgttcttgacttacagcagcatcactccaatctctggtcttcacgtgtgtgtgtgtttctcttctcttcctataaggacaccagtgattggacttagagcccaccctaatgaccttattttgtcttgtgtcttaattatatctgcaggtaccctgtttccaaatgagatcacattcacaggtaccagggattaggacttgaacatatctttttgagggaacgcaattaaactcattacattcaccatcattttaagagatgcttgaaggagggagatgatatgagggatgttagaccacagccgactacaattgtgagcaaaataaagacagttattcaaactattgtcagatttgtacggggacattcttttttcccgcattttcttattgtggtaaaatacacatgacataaaatttatcatttttactgtcttttggtgcacaattctctagcatcaagtacattcacattattgctcagtcattaccaccatccatctccagaactcttttaatcttgcaaaactgaaactttgtgcccattaaacactaactccgcattcctccctcccccgagccctggcagctaccatttcaccttctgtctctgtgaatttgattactctaggtagctcatataaatggaatcatacagtgtttgtcctttcatgactggcttatttatatacctagcaaagtgtcttcaggattcctccatgttgtatcatgtgtcagaatttctttcctttttaaggttcaatatatttcattgtatgtatataccatcccctactttttttaaaactaaagggatcatgcctatgtatggtctttctacctgctcaatatgtcagaaaaagagaggtagttaagagcatggactcaggccccaggaaggctaggtcagactcatcatttaacctttctgtgcctgtttcataacatataaaaatgaggtaacaatgaattaatacacataaaacagttaaaacagtgtctggcatgtttcccattttttcccattttttcaaacgtataagcacgttggattttttttaaaattatgattgctttttttcagatgacgttgtgtcaaagaaatcttgctctttcagtccttaaagtgctacccattctttctcattgttgcaatgcatttcatagtatgcatatcctttttataaaaaacacagatgagtggacttctggtttctggtcagggatgtaagaagcttggaagctgctactccatcctaacagcaagtaaaaagccaaacaaactgaaaaataaacactcttgctagatccatgagagacgtaaggtcacagggcaaactgctgcccccaaaattggagcgacagacaggtgagtgcagagaatcacaacttacaggagcagaaggaacccatgagcagaaacctttatgggaaccaatgcccaggcaagggaaaactgaattgtaattgacaaattgctggaggctgtgtggacaagtgtgagacattaaaaactcccaggggacccagtcattaggggggctcccacacttttgtaagttttacttcctgaagctctaccaagttcttacggtgaatattgaagaaaaatcccctcatggttctggcaagagcagggaaaaaggaacaattctgatgtatgccaggcctgtccttgggagaaactaggtgactagagcctaacctgctgggattatcagagagaggctaactgatcttgggggaaggaaactccatctgcctctagccatgctgtcccacctaaggagggcaagaaaaaaacagcaacaacttagaagcatttgtgaaattaacagtccagggcaaaggctcactaaaagacggagacctctttgtaggactatagaatgcttcccctcttcccacatcttaccaccacatcactaaaagcctacttacagcagtttcttttacccagtacattatttccagctatcaagaaaaaaattacaagggatactaaaaggcaaaaacacagtttgaagagacagagcaaatatgtgaacccggctcaattatggcaggcatgttggaattatcagaccaggaatttacacatataactataattaatattgcaatggctctgacaaataaattagcatgcaagaacagatgggcaacgtaagcagagagatggaaatactaagagaggaccaaaaataaatgctagagataaaaaacactgtaacagaaaggaagaatgcctttgacgggcttttagtagactggccatggctgaggaaagaatctctgaattcaaagatatgtcagtagaaacctctaaaaacaaaaagtaaagggaaaaagactaaaacaaactaacaaacaaacttgaatatccaagaactatatgatggctacaaaagttgtaacatttacatatttagaataacagaaagagaaaaaagaaaggaacagaagaacttttggaataataatgactgaaaatgtccccaaattattgttagacaccaaaccatacatccaagaagctcagagaacaccatgcaggatatgccaaaaaaaaaaagcaaacaaacaaacaaacaaaaaaccctacacctagacatatactcaaactagaaaaaatcaagcataatgaaaaaattctgaaacaagccagaaggaaaacaagaaacaaaccaacaaaaaacaacaaaaaacaaacatcttacctatagaaaagcaaagataagaattacatctgactcaaaaactgtgcaagcaagaagagaatggagtgaaatatttaaagtgttgggggggggggaaatactagcctagaattgtgtactctctgaaattatctttcaaaagtgaaggagaaataaagactttctcagacaaacaaaagttgagagaatttgttaccagtagacctgctttgcaagaagtgttcaaagaagttctttagagaaaaaaatgggaaacagtataggttagaagctcagatgtatacaagtaagggaagaatattgaagaaggaataagttaaggtaaaataaaaacttttctcactttgggaggctgaggtgggtagattacctgaggtcaggagttcgagatcagcctggccaacatggtgaaaccccgtctatactaaaaatacaaaaattagctgggcatggtggcacacgcctgtaatcccagctactcgggaggctggggcaggagaattgcttgagccagggaggcggaggttgcagtgagctgaaatcgcaccactgcattccagcctggcggacagagtgagactctgtctcaaaataaataaataaataaataaataaataaataaataaagactctgtctcaaaacaaacaaacagacttttctttttctttttctttttttttttctttttctttttttgagacgaagtctcactctgtctcccaagctacagtccagtggcgcgatctccactcactgcaacctccgcctcccaggttcaagcgattctcctgcctcagcctcccgagtagctgggactacagccatgcccaccacgcccggctaatttttgtatttttagtagagactcttgaccttgtgatctacccgcctcagcctcccaaagtgctgggattacaggcatgagccaccatgcctggctcgcttgcttgcttgcttgcttgcttgctttctctctctctctctctttctttctttcttccttttctttctttctttcttttttttttttttttttgagacggagtctcgctctgttgcccaggctgaagtgcagtggcacgatctcggctcactgcaagctccgcctccctggttcacaccattctcctgcctcagcctccctagtagctgggactacatgcacccaccaccacgccaggctaattttttgtatttttagtagagacggggtttcactgtgttagccaggatggtctcaatctcctgacctcgtgatccacccaccttgtcctcccaaagtgctgggattacaggggtgagccaccatgcctggcctttttcttttttttttgagacagagttcctctcttgttgctcaggctggagtgcaatggcacaatctcggctcactgcagcctccacctcctgggttcaagcggttctcctgcctctcagcctcccgagtagctgggattacaggcgcgcgccaccatgcctggctaatttttgctttttttagtagaaacaaggcttcatcatgttggccagcctggtctcgaactcctgaccttaggtgatctgcccgccttggcctcccaaagtgctgggattacaggcttgagtcatggggcctggcccattatcttttaatattacataaaaatctttttcaaaagagaaaaccaaatttatgtttgcattactgcatcttcaatgccaaggctagttttttttgtttttgtttttgtttttgttttttgagacagtctcgctgtgtctcccaggctggagtgcagtggcgcgatctcagctcactgcaagctccgcctcccgggttcacaccattctgctgcctcagcctcccgagtagctgggactacaggtgcccaccaccacgcccggctaattttttgtatatttagtagaaacggggtttcaccgtgttagccaggatggtctcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaactgatattctaagaaaggagagaaaaatggaatcatttaaaatgttcaattaaaaccacaaaagacaggaaaatagaaaataaaaaagagataggtcaacaaatataaaatagtaacaaatatggtagatgttaatccacctatagcaataatcattttgaatataatggtctaaatccaccaattaaaagagattatcagaatagattttaaaaaaagactcagttatatgttgtcttttaagaaacccacttaaatataaagacacatattgattaaaagtaaatgaatggagaaagttataccatgttaatactaataaaaaaaaaagtggaggctgggcgtggtggctcatgcctgtaatcccagcactttgggaggccaaggcaggcagatcacaaagtcaggagatcgagatcatcctggctaacatggcgaaaccctgtctttactaaaaaagtacaaaaaaattagccgggcgtggtggcgggcccctgtagtcccaactacttgggaggctgaggcaggagaatggcgtgaagctggaggtggagcttgcagtgagctgagatcgtgccactgcactccagccccagcagcagagtgagactccgtctaataaaaaaaaaaaaaagtagaaaaaaaattagccaagcatggtggtgcacaccagtagttccagctactcaggaggctgaagtgggaggatcacttgaccccaagaagtcaaggctgcagtgagctatgatcgtaccactgcactccagcctgggcaacagagccacactgtcaaaaaaaaaaaaaagaagaagaagaaaaggaaaaggaaatgagagtggctatattaatttaagacaaagcaaacttcatggcaaagaaagttatcaaggataaagagagtcattaccaaatgataagacataatgattcttaacatgcacgtgcctaacaacagagcatcaaaatacatgaggcaaactgatagaagtgcaaagagaaatagatgcatctactcttgtagttggagacttcgagacctctctatcagaaatggaaaaatccaggcagaaaaatcagtaaggacatagctgaactcaacaccaccattaattaaatgcatataatggatatctgtaaactacttcatgtgacagcagcaggatacacattcttctcaagttcacatgggacattcaccaagacagggtctggaccaaaaaacacaccttaacaaatgtaagaaccagaaattatacaatgtctgctttcagaacacattggagttaaaatataaatcaataacagaacgatagctggaaaataccaaaatacttggagattaaacaacacacttctcaataacacatggatcaaataaaaaatctcaagatagaggccgggcagggtggctcacacctgtaatttcagcactttgagtggccgaggcaggcggatcaggagttcaagacaaacctggctagcatggtgaaacctcacctctactaaaaatacaaaaattagctgggcgtggtggcacgtgcctgtaatcccagctacttgggaggctgagacaggagaatctcttgaactcgggaagcagaggttgtagtgagccgagattgcaccactgcactccagcctgggtaacagagcaagactccatctcaaaacaaacaaacaacaacaacaacaacaaaaaacctcaagataaactttaaaatattctacttatttatttatttaaattagtgatggagtcacactatgttgcccagtcttgcgtcaaattcctaggctcaagtgaactttctgcctcagcctctcaaagtgccagggttacaattgtgagccctaccatgcagccaaatattttgaattaaatgaaaatgaaaacacaacttacaaaaacttgagggatgacatgatagcagtgttcagagggaaatttatagcatagaatgcatatattagaaaagaagaaagatctaaactcaatcatttaagcttccaaattaggaagctagaaaaagaagagcaaattaaattcaaagtaaacagaagaaaataaataataaaaatcaaccaggatggtgactcacacctacaatctcagcactttgggaggccaaagtaggaggatcacttgagcccaggagttcaagaccagcctgggcaatatagtgaagcccttctctgcaaagaaataaaaaattagccagcttatactcaggctgaggcagaaggattccttgagctcaggaattgagaacaacctgggcaccatagggagacctcatctctaacgaaaaaaattagccaggcatggtggcacatgcctgtagtcctagctgctcaggaggatgaggtggaaggattgcttgagcccaggagtctgaagctgcagtaagccatgatcatgccactgcactacaacctgttgatgaagtaagattctgtctcaaaaaaagagagaaagaacgagagagaaagcagagaaacaaaagttagagcatcaggtgaattgaaaacaagaaatcaataaagaaaatcgacaaaaccaaagttatttttttgaaaagatcaacaaaatcaatagtcctctacccaggttaactatgagagagagagaaactcaaattggtaacatcagaaatgaataaagaggccaggtgtggtggctcatgcctgtaattccagtaatttgggaggctgaggcgggtggatcacctaaggtcaggagttggagaccagcctggccaatatggtgaaaccccatctctagtaaaaatacaaaaattaggttgggtgcggtggctcatgcctgtaatcccagcactttgggaggctgaggcaggaggattgcctgaggtcaggagttcgagaccagcctgggcaacatggagaagccccatctctactaaaaatacaaagaattagacgggcatggtggcatgcgcctgtaatcccagctactcaggaggctgagacacgagaattgcttgaacccaggaggcagaggttgtagtgagctgacatcgtgccactgaactccagcttgggcaacagagagagagactctgtctctaaataaataaataaataaataaataaacaaaaattagccaatgtggtggtgcacgcctgtaatcccacctacttgggaggctgaggtatgagaatcacttgaacccaagaggcagaggttgcagtgagccattgtactccagcctaggtgacagagtgagactctgtttcaaagaaaaaaaaaaaaaaagaaatgaacaaaaaaacatcactacagatcttgtggacataaaagggataataaagaaatgcttttttaaacaactctgtgaacacaaatttgataacctagatgaaatggaccaattcctagaaagacataatctgccaaaattcacacaagaagaaataggcaacataaataaacctatatctattgaattagtaatcaataaccttccaaaagagaaagcaccaggccctgatgggttcactggtgaattctgccaaacattaaaggaagaaattacaagaattctctacattctctttcagaaaataggaacagagagaaaacttcctaactcatttttatgaggccagcattacactaatactataactagagaaagacattacaaggaaaaataacctatagaccaatatctctcatgaacatagatccaaaatcatcaacaaattattagcaagtcaaatcaataatctataaaaagaatggtacaccatgaccaattgggatttattccaagtatgccaacctggtttagcattaaaaaacaattaatgtaatcgatcacataaacagactaaggaaggaaaatcacatgattttatcagtaatcacagaagaaaagcatttgttgaaatttaacacctattcacaataaaaactctcaatgaactaggaatgggggaaattttctcaagttgccaaaaaaacctacaacagacattatatttaatggtaagaaactagatgttttcccactaagatcaagaacaaggcaagggtgtcccctcactactgctttttgaaatcatgctgaaagtccttaatgcaataagaaaagaaaaggaaataaaaggaatacagattgggaaggaagaagtaaaactatctttgtttgtagatgatatgatcatctatgtagaaaatcccagagaatcaagcaaaaaaaaaaaaacaaaaaacaaaaaaacccaacctcctatagcaagattgcagaatataacgtcaatatagaaaagttaatcattttcctatgtaccagaaatgaacaagtggattttttttttttttttttttgagacagagtctagctctgtcgccctgtctggagtgtaacggctcaatcatagcttactgtggcctgggctcaaccaatcttcccaccttagccccctgagtagctgggaacatgccaccacacctggctaaattttttcatttttggtacagacagggtctctgtctgtttctcagactggaaaaagtgaaatgaaaaacacaatattattctaattaccacccccaaaatgaaatatttaggtataaatctaataaaatatttacaagatttatatgaaaaaaaataccaaactctagtgaaagaaatagaagaagagctaaaataaagggaaatatataccatgttcatgggtaggaagactcattattttcaagatgtttgttcttgccaacatgatctttagattcaatgcaatctcaatcacaatcctggcaagttattctgtccatattagcaaactgattttaaagtttatatggagaggcaaaagacccagaatagccatacaatattcaaggagaacaaaatcagaggattgatactacccccacttcaagacttaccaagacttactataaagctatagtaattaaaagtgtgtgagctgggcatggtgcctcatgcctgtaatcccagcactttgggagggtgaggcaggcggatcacctgaggtcaggagttcaagaccaacctgggcaacatggcgaaaccctgtctctactaaaaatataaaaaatcagcccggcgtggtggcgggctcccctaatcccagctactcgggaggctgaggcaggagaatcacttgaacccaggtggtggaggtggaagtaagccaagattgagctactgcactccagcctgggagcaagactcccatctcaaaaaaaaaaaaaaaaaaaaagattgtgtggctgggcgcaatggctcacgcctgtaatcccagcactttgagaggccgaggtgggtggatcacctgaggtcaggagttcgagaccagcctagccaacatggtgaaaccccgtctctactaaaattacaaaaattagccaggcttggtggtgtgtgcctgtagtctcagctactcaggaggctgaggctggagaactgcttgaacctgggaggtaggggttgcagtgagcctagatcgtgccactgtactctaacctgggcaacagagtgagactccaacgtctcaagagaaaaaaaaaaagacagtgtggtactggtgaaagaacgggcaaattgattgataggacagaatggagagcccagaaacagacccacataaatacagtcagttgatctttgacaaaggctcaaaggcaacacaatggggaagagatggtctctccaacaaatgctgctggaacaactgaatatccacatgcaagataataataataataatatggacatagaccttacactcttcaaaatgtttcacagacataaatgtgaaacctgtgaaactcatagaaaataatataggctaaaaaaagctagattaccttgggtttggcaatgactttttagatacaacactgaaggcccaattgttggtaagctggacttcattaaagttaaaaagttctgctgtcagagacacagtcaagagaatgaaaagacaagccacatactgggagaaaatctttgcaaaagacatatctgggccgggtgccatggttcacgcctatagtccctgcactttgggaggctgaggtgggtggatcacttgaggccaggagtttgagagtagcctggccaacatggcaaaaccccatctttactaaaaatacaaaaattagccaggtctggtggcatgtgcctgtagtcccagctacatgggaggctgaggcagagaattgcttgaacccaggaggtagaggttgcagtgagccgagatcatcccactccagcctgggtgacagagggagactccctctcaaaagaaaaaaaaaaaaagacatatctgataaaggactgttatctaaaatatacaaataactcttgaggcgggatgtggtaattcacacctgtaatcccagcactttgggaggccgaggcagtcagatcacctgtggtcaagttcgagaccagcctggccaacatggtaaaaccccatctctactaaaaatacagaaatgagccaggtgtggtagagcatgcctgtagtcccagttacttgggaagctgaggcaggagaattgcttgaacccgaaaggcagaggttgcagtgagctgagactgcacccctgaacttcagcctgggcaacagagcgagactccgtctcaaaaaaattaaaaaaagaactcttaaaactcaaaaataagaaaagaaacaacctaattaaacattgggcaaaagaccttagcagacaccccaaggaagatatacagatggcatgttagcatatgagaagacgttccacatcatatgcatctgggaaatacagtttcaaacaacaatgagatagcactacatacttattagaatggccaacatccagaacactgacaccaaatgctggtaggacgtggagcaacagtaactctcattccttgctggtgggaatgcaaaatgctatagtcatttggaaggcatgttggcagtttcttataaaaataaatgtactcttactatatgacccagcaatcatacaccttggtatttacccaaaggaataaaaaactcatgtctacaccaaaacctccacatagatatttacatcagctttattcataactgccaaaatttggaagcaaacaagatattcttcagtaggtgaatgtataaataaactatggcatatccagaatatagaatattattgagcactaaaaagaaatgaactatgaagccatgaggagatatggaggaaccttaaatgcatattactaagtccaagtctgaaaaggctacatacagtatgattacaattacatgacattctggaaaaggcaaaagtatggaggtagtgaaacaatcagtgtggttgcccacggttgggaggaggaagggatgaataggcagagcacagaggattttttagggcagtgaaaatactctgtatgatatgctacaatggtacataaacgtcattacacatttgtcaaaactcatagaacgtacaacaccaggagtaatccttaatgtgagctatgatctttgggtgataatgtgtcaatgttgtctcatctgttgtagcaaatatgccaccctggtgggggatgtcgatagtgagggaggctgtgcatgtgtagggtcagggagtggatgggaaatctttgaatattttactcaattttgctgtgaacctaaaactactcttaaaaaaagcctatttaaaaattgatgggattatactatatacagtattctgtaccttgactgcctttattttttaatttttttgtggaaacaagagtcttgctatgctggtcttgaacttctgggctcaagtgcttctcccacctcatcctcccaaagtactgggattacaggcatgagccaccactactaaccttctttttatttattaatatatcttagaagatcatgacaacatatacaactgtaccctattcaatcaaatggattaatactatgccatggcatagataccaccgtaagttatatagccagatgcctcttagtagacatgtttttggtcccttgttatagatggtggtgcagcgaacacccttgtattcatcctttgtgtataatcaaggatatagccataggataaagttgagtcaaggagtaagtacatttacaagagtgcacgtgccaccctcacaccccaaaaccaatggagatgtcctaccattacagtcgatgatggtgaccactcagtctaccttgtgaccttgagaagcaggtatcaccaagaggtgaagggacttgcccagtgacgcacagttaaatgatttttcccaataaatacacatgatacaaaattcaaaaagaatacaacattatgccagttaggactaggttcgactgcatgtgaaatgaaaaaccaaaataattgcagtttaatgacccaaggctgggtgcaataatttacatctgtaatcccagcaatttgggaggccaaggtgggaggatcatttgaggccaggagttcgagaccagcctgggcaacatagcaagaccctgtctttaccaaaataatttttaattagctgagcatggtggcacatacctgtggtcccagctacttgggaagctgaggtgggagaagcacctgaacccaggagttcgaggacgcagtgagccatgatcccaccactgcactccagccttggtgacagagcaagacaaaacaagtgacagagcaagacctgtcgcaaaaacaaaacaaaataaaataaaataaatgacccaaggttattatctcttatataaaacaaatgtccaggccgggcgcggtggctcacgcctctaatcccagcactttcggaggccgagacaggcggatcacgaggtcaagagatcgagaccatcctggttaacacggtgaaaccccgtctctactaaaaatacaaaaaaattagccgggagtagtggcgggcgcctgtaatcccagctactcgggaggctgaggcaggagaatggcgtgaatccaggaggcggagcttgcagtgagccgagatcgcggccactgcactccagcctgggcgactgagtgagactccgtctccaaaaaacaaacaaacaaacaaacaaacaaaaaaatgtcctagagtgaggcagtccagagctggtatgctagcccctgaagtcattagaaacttcctgctttatgctcaccactcctggggtatagcccctatctttattgtcagagatgcctgctggattcctgaccatcacatctgcattccaggcagctgaatggagagatggatgaagacaaatgggacaaagagtacccggtagcatccttatgaatctgtttatataaagttgtttccttaacgccacagaacacatctacatgtattttgcttagtcatatggtcacatctgactgcaagagaggttggaaaatgcagtctttattctctacagtcaaggtcttagctaaaaattgagggttctaaatactaaggaagaagggatgaatagatattgtggcaagatatttgtctctgtcatggttaaattgcaaaaaaataaacttacctccttccccaggcagccattgttaacattttttgaatatctagaaaaagtcctttgttcaggattattttcccactctgccaagagtcaccatgacctgctcacacgccacccttatgaaactgccgcgccacttctcagctcccatttgattctcacagaagctctacgaaatgggttgggcaaatgtcatgatcctcatttcacaggggaagaaactgaggcccagagggggaaactgactacctaaaattgccatgtaggccggcgcggtggctcacgcctgtaatcccagcactgtgggaggccaaggcgggtggatcacgaggtcaggagatcgagaccatcctggctaacacttgaaaccccgtctctactaaaaatacaaataattagccaggtgtggtggcgggcgcctgtagtcccagctattcggcaggctgaggaaggcgaatggtgtgaacctgggaggcggaacttgcggtgagccgagattgcgccactgcactccagcctgggcgacagagccagattccgtctaaaaaaaaaaaaaaaaacagtcgccatgtaaaggatgcagccaagcctcctgtggaggcaggacaaattggggtgtgtttcccaaacaccagacacatgcaagatgcatccggcagccagtggcgagcacatggttccatttccaatttcttccataactttaaggagaaagtttcagtttggtgctaatgcatctttaactcctctcacacttactaataggtcttttaaacaaagagaaatcggccctcaggctcagagcactaggcaggcaaaagtatctagctagattctaagaacattgttttgatttcattatacctacatttatagtgtttttctatttatggcaaatgatcctggtttccttctctttgaaagtaatttaagtttacttttcaagtaaatgcatcgaagttaaaatgtgagtttattcaaagaaaaacatgcagtaaggaactatctgtgcttgaatacagattcccccacttacaagctatgtgacattggataagacacctggtgcctctgagcctcagtttcctcattcgtataatgagggtggtattttttcccacctcatggcattttttttttttttgagatggagtctagctctgtcgcccaggctggagtgcagtggcatgatccccgctcactgcaagctccatctcctgggttcacaccattctcctgcctcagcctcccgagtagctgggactacaggcacccgccaccacgcgtggctaattttttgtatttttagtagagatgggttttcactgtgttagacaagatggtctcgaactcctgacctcgtgatccacctgcctcggcctcccaaagtcctgggattacaagtgtgaaccaccatgccaggctgaattttttaaattaataataggattaaatgagataatgaaagtcagaaacttagcactctggcacatagttaagcactcatcactgcttatttatttatttatttatttatttatttatttatttatttttgagatggagtcttgctctgtcacccagggtggagtgcagtggtgcaatcttggctcactgcaacctccgcctcctgggttcaaggaattctcctgcctcagcctcctgagtagctgggattacaggcatgtgccaccaagcccagctaatttttgtatttttagtagagatggggtttcaccatgttgaccaggctggtctcgaactcctgacctcaggtgatccactcgtcttggcctcacagagtgctgggattacaggcatgagccatcgcgccgggccactcaacactatttttaacaatagtatcacaatattaaaaatattaacattgttcatcttaattttgtcataacacctcctggctgcttggagcagagaaagtcagtaggaccgtggggtagctggatagagatatcccatcctagagcctctgcccctacaccagtggttttcagccagggataatcccctacattagggccttttttttttttttttgaaaccatgtcttgctctgatgcctaggctgtagtgcaatggtgcaattttggctcacagcagccttgatcttccggctcaagcgatcctcccacctcagcctcctgaggagctgggactacgagtacatgccaccatgtacttgtgcttttcaccgtgttttcaccatgttgccccaggctggtcttaaactcctggcctcaagtgatcctctcacctcggcctcccaaagtactgggactacaggcatgagccacccatgcccaactgacattttttaatcagtatgactgggtttggtggtgcccctggcatctggtgggtagaggccacggatgatgctaagtatcccacagtgcattggttggcccctcatgaagaatcatctagcttgaatgtcaaaagcattgaggctgagaaagcttgtgccatcctgcacccgtgtatgtgcctagcagcagctgggtcttcagccagcccattattccaaaagagactcgagcttggaacacaaaagcctcagcctcagtttcttcatccagcaaatgggaacactgaaccctgccttatctgcagtcattccatctcctgatggttggccctcttgggcacttccttggcctaggctatcgctactggtccctttctatctttcccctaggtgcaaggaacccatctaattggcttttcatttgtttgacttctgatatttcccattcccggagtggcctctggggccccacagccaccatctgaaaccctgcagcgtgagtgccccagccatctctgagtacccctgttattgtgggtggcagctgctagtctttttcctttgaagcacaccttgacatgtgtaactcttctatttatgtgttgacttgttggctgtattccttcccacacgcctctgccctgaagacagacacccagcctgctgtccccggcacactgcacagtgcctggcacatagtgggcatgcaggactgtatttgtgggatctatgaagtgagaggcaaaaagagaggataaggggaggggatagatatagagaagcgagaaaagaaatagagaggaggagggagttgaatgaatgttaagtgctgaaagatctaaataaaggggaaagcgggaggggcgggggtccagactgagacttgagcacaaggtagacaagccagagagagagagagggggggtgcgaagaaagatgaaaagggtggggaagagaaaggaatggagacacagaacgaaagagagagacagaggcagaaaaaacgtgcaggcggaaagcaaaaggaagaaaacctccctgaggcctcagtgctcaggttgcggaggggaggaggaccgcccgcaggagccagcgctgcgcagctgggagcgccgggatgcaggcccggtttccacggagacggggatgctcctggcgggagccacggactactgcaggacccgcgcctctggcaccacgggaatggacgaccagagaggtggcaaagggacggtgtgggtttgcccccttcttgggctcgttcccactcctgcctcttgctggagatttagagtccgggaatagggaggcaggagcgcacccgcctgggaaagggctctggggactccgagggcgggggaaggactggggctgagaccactcctccccctgccccgttgccttccttggcgtttgaccctcctttcctttcagatagggtcctggagggtctggcaaagtgcagcgctatgtggagagatgacggccaggccttctccgcaggcccctcttcctcctcctgccctgttaatgctggagcaccagggctcagtcctaagccttctcttcagtttccaccatgtccagtcctcgagatttaaatacctaaagtgcccagagtccccagatttgcatgtctagccccggttttcccctgagctctggcctgttcaaagttgctaattctttaactcatccagcttgttcccgccgcaggactttgcttttgccattccctttggctgcaactcttttcccagcccttaggtggtgagttccactggagtggataattgacttgcgggaggagcattggtggggggaggagccctgctgcagtgtctgttcgatcatagtattgtggggggagcctgcatctggaagaggagcacgtgttggggagagggggaggactggctggaatctggcagtgccacgatgagaaggagggcccactccgttggaagccggaagaggctggggcctgggagcattccctccatggtagatgtgggagggagctggcacagccaagggccccttcccaccctggggactagatgggccaggtggacagtgggcagagctgaccatcacccccactttacattgctgtcatctaaaacccaggctaagcaccctgtggacctggtgcaggctcaaggtccccacggttccaaacagagccctctggaacctttgggtctcagatacagtaacccaaatgttggcaggactggcaatacgagggccccatcaagccggtgatgcagagctggtggaggggaagaccccatctctacagtggcctgctgaatctgggggttctgactgccctgtgacgcagcaggtgccactctccaagccagtcactcttaccagaggagtgcaatgtgctgatcagctcaggcttgggtctcatccactaggctaagtgctggccaagggcccacctgggcggggattgggacaggtgggttgctaaatccaaagcaggtggatgctagctagggaaccattgccaaggcccttctgagcctgccccttctcttcctctttgcctttgtcctcctcacctgaaaccaactctccgaattactttcttatttgtgtaattattacttttggcattatgactggttttgataacagctaagatttacccagaacttactgtgccaggcactttacactttgctgccttccataatctttacaaccacttgaggataccatcattatccccattgtacagatgaagaaactgaggcttaaagatgaaggaacttgctcagtgtggcatatctagaaaatagctgagccaggatttgagacccagccttcttaatcgctttgctattacgtacctctctccacactacattgcaagctccatgcagctaaaatccaagtctccccaccccgcaggcctggtctagtgcctggcatatggtaggccctggataaatgctacctgagtgcctggcaccgtgctaagtgttttgcacgcattacttcatttaatcctcctaatcgcccttgaggtaagtacaatggtattgactgaaacaggcctgttcaggttcagcggcatctgccaaggtcatacagccaagttaggggaagaactaggctaagtcctatcattggcactccatagtctgtgctcttagcaaagtgctcaactgcatgaatgaaagtatattctagcatcgtgaataaaaggaaaatggtgcccaataaacatttgatgggtgaaggacaagaatttaaaaaataacaatgagggcgggtgtggtggctcactcctataatcccaacactttgggaggctgaggtgggcagatcacttgaggttaggagttcgagaccagcctggccaacatggtgaaacctcatctctactaaaaatacaaaaatgagccggacatggtgggaggcacctgtagtctcagctactcaggaggctgaggcaggagaattgcttgagccgggaggtggaggttacagtgagccgagatcacgccattgcactccaccctgggcaacagagcgagactccgtctcaaacaacaacaacgacaacaataataataataatgaggatgggagagatgggagagggagttggtcccgatgctagaggaagttgaaggaggtggctgtgggtggctatgttctcatattcccagaatgcttcctggaggaggagttgatctcatggggaagggagagggcattgcgggttccagaaagtttctgctacccatcgtagacctctttctctctctcttttccctgcccctgccctctctttctccctctgtggaagtgggtaacaagcacgtggttgggttgatgtgccctcaatagggtggggcccagactgcagacactagggagtaatggtcttttctcttccttcctgaccgtggtggtgggcccggtgctctgcccctcagctctgtgcctcgtcctgggctgcatgatctttcctgatggctgggatgccgagaccatccgggacatgtgtggggccaagacggggaagtactccctgggggactgttcagtgcgctgggcatacatcctggccatcatcggcatcctcaacgccctcatcctctccttcctcgccttcgtgctgggcaaccggcaaacagacctgctgcaggaggagctcaagccggagaacaaaggcgagtgtgctgtgggctggggggcagcggcgggagccaggcctggtcctgggaggcaggataatttcaaataaaaggagtaagagggttgcatgaattggaaaccctggctgggcgtggtggctcacgcctataatcccagcactttgggaagccaaggcaggtagatcgcttgagcccaggagttcaagagtagcctggtcaacatggtgaaatcccctccctaaaaaaatacaaaaactgggctgggcacggtggctcacgcctgtaatcccagcactttgggaggccgaggcgggtggatcctgaggtcagaagatccagaccatcctggctaacacggtgaaaccctgtctctactaaaaatacaaaaaaattagccggacttgggaggctgaggcaggagaatggcatgaacccgggaggtggagcttgcagtgagctgagattgcgccactgcactccagcctgggagacagcgagactctgtctcaaaaacaaaaaaacaaaaaaacaaaaaaaaacaaaaactagctggatgtggtggcaagtgcctgtggtcccagctactcaggaggctgaggtgggaggatcacctgagcctgagaaggttgaggctgcagtgagctgtgattgtgccactgcactccagcctggactacagagtgagagcctatctcaaaaaaaaaaagaaagaaaagaaaagaaaaaaagaaacctgcctgacagtacaaccaccttttaaatgatttgatgttctgcctcagatctgatcatttgcctgtgacccagcaaacccacctcgggtacaaacccatgagaagcgttcaagggcgctggtggctgcagcttcactgtagcaaacagctataaacagcccaatggccatggacaggaggccggataaatacacgtgacatgttcacatcacagagcagctcacagctgtgaaaatgtcacacttcagttatatgtaccacagtggatgtatctcagtaatataatgttgagagagggggaaaaaaaaaaacaagttccagaagatgacagagtgatatatttattgagctcgaaagtaagcaaaactaagcaatgtattgtttaaacacacatgtatttgtggcagtattttttttttttttgagatggagtctcactcagtcacccaggctggagtgcagtggcgcgatctccactcactgcaagctccacctcccgggttcacaccattctactgcctcagcctcctgagtagctaggactacaggcacccgccaccacgcccggctaagtttttgtatttttagtggagatggggtttcaccgtgttagccaggatggtctcgatcttctgacctcgtgatccgcctgccttggcctcccaaagtgctgggattacaggtgtgagccaccgtgcccagctgtggcagtatatttttttaaaaagcaaagaaataataaatatgaaaggtaggattatggtcatctgtggttatgatggaaggggaggaagtcaagtatatgagctggagcgtggaggtatatgcaaattatgggtagcgttagagtccttttttttttttttccttgagacagtgtcttgctcagttgcccagggtggagtgcagtggcacggtctcggctcactgcagcctccagctcctgggttcaagtaatcctcgtgcctcagcctcttgctcttgagtacctgggattacaggcatgttgccaccacacccagctaactgttgtattcttagtagagatggggtttcaccatgttggccaggctggtctcaaactcctggcctcaagtgatctgcctgcctcagcttcccaaagtgttgggattacaggcatgagccagcacacccggctgagttatagttattgaatggtgagctcaccagtgttgattattgtatttttttaagagattgggggagggggcctcactctgctgctcaggctggagtgcagtggtgcaatcatagctcactgcagcctcaaactcctgggcttaagcgattctcctgcctcagcctcctgagtggctgggactacaggcatgcgccaccacgcctgactaatttttgtattttttgtagagacgaggtttccccatgttgcccaggctggtcttgaactcctggcttcaagcaatccttccgccttggcctcccaaagtgctgagattacaggtgtgagccaccttacctggcacattgtatgctttataattagtgtattgcatataaactttcatatatatcaagtagcattaaaatacaataaagaaaaaaggccaggttcagagaactccagagctccagtaatttgcccaaagtcacttaagtggtgaaggcagaatctgaacccaggtccaagtccaaagtccaagctcttcccccctgtctcaacctggtgaagccagagatttcctgcacggctttgggagctctcctgggatgctgatctgctaacctgtactcagaggcaggttctaaatacctgatgcagtccctcagaccccgggattactgtggttttggtgtgaagtcaaggcctgccctctggcggcagctttcagaagtgcaagacagactgagatctggcctttctcaagaaggggtgtggggatgtgactgatgtgaagtgggccccctcggtgtccttctcctcccttcccaaagccccctaacaactcagtgttaaaaatcaatgtaaaggagccccagttttcctcccttcagtgtccagggagtctccgtccctcactgggagttcaagatgagtgagcctcccacttcagttttaacccaaagacctccgagccaaaagccatggcgcgcacctgtggtcccagctacaggctgaggcaggaggatcgcttgagcccacacgttcaagaccagtctgggcgatgtaacaaaacccagtttctattaaaaagaaagaaatatatatatatatttaaagaagacctctggaaccaaagaaaaaatagataaataaattgcttccatttccagcatattctatgaccaaacactgccaagtccttggctgtcattatttgtctctttttgacccttcggaattaccctgtgaggtaggctatgatccttattttgcagatgagaaaatcggggctcagagaggttaaatggcttgctcaaggccatcctgctggtcaggtgaggctaggatttcagcgcttgtgcagtctgcccctctgcccctctgaccttttttttttttttgagatggagtttcacactttttgcctaggctggagtgcagtggtgcaattttggctcactgcaatctctgcctcctgggttcaagcgattctcctgcctcagcctcccaagtagctggaattacaggcatgcaccaccatgcccggctaattttttgtatttttggtaaagacagggttgtgccatgttgatcaggctggtcttgaactcctgacctcaagtgatccacccgcctcagcctcccaaagtgctgggattacaggcgtcagccaccgcgcccggcccctctgcccacttgtgccctggggaatgtgcaaggaaagcctgaatgcccaggcagcctctgactttctctaattctctctccttctctctctctctctctctcttagattttgtgggctctacagtaagctccgtgttgcggcccgggggtgatgtctctggatggggagtccttccctgccccgtggctcactcacagggaccctgaaaggccaggatcacagcccagtaattggcctgacctcagcttgtcctgccttctgccctctcgtcactccattcaagctctgagggaagaccctgatctcagacttacttctcaccgactaccctgcaagctccaggctttgaggagaggaaagcctggatgtggcctgggggagaggagaggccctccaaaccttgggagggtctaattcttgctcctccctcaatttgacctaagggagcctgcatctgcgtaggcccttgggcttctcctctcctctctagactggcctggaggtccctgcagatccccagggagagcggagctgtagttccagctccccaggccccctcagtctggagggctgccgcctggctgtatccgcacctcttctggtccctgcctcttcaagaaatttattctagatactgctccagggtgggctggactctttcctactttttttttttttcttttttggctgatgttggttccaccacatctgccacaaagctccaggtgccaccagtctcccctgggacctcctctgctccattccggcctgctcccagctcaccctgagggagagctgcaccgagggatgcacagggccctgctgtcagctgcagaccggggccctgatcagcccagagtcagaaaagactttcaggctctggaggtagcgggagggggtacgtggcctcggcagttggagcttagaagctgctcagcccgggctggcctggcctcctcttcctctctgctggaacatctcactgatgactgagcccttgaccttggcctcttttgcccaggcctcctctctgctgggatgtctcaccaatgactggacccttgaccctggcctgttttgtacagcacagacttcttggccctgttgtcagggttgggggtgtggaggggaccccagaggtggggagttgggggatgcattaccccttctgccccttttcatgccctccataccccaggcgtctaccaagggcagagactgtcttgtctctttgatacttttctgcataacttgaacttgcaggtcatctctgaacagggtacccctgtcccccttcctaagccttgttaccctgtcccagcctcttcctcctcctggcccacctctcgccttgcgatatgcccagggtctgcacctatgggcagtgcttggagccgaggcatgagtgtatgtgtatgtgggtgaaatgtgtgtgcgtgtgtgtgcgcgtgtgagcgtgtgtgtgtgtgtgtgtgttgggggacaggtgagaagtttctcccccctccacccactgtgggggcgtctcccttccccttggcagggagcaggtgagggagactcctggtattttttgaacacccgtcattcccctgtgggtctggcggcagagccatctctcccggggagcctccctgccctggggcctggacagctccctcagcactagttgctggtgcagaccggcttcgtccagcgccccctcctggcggcctggacctgcagggaaggggcggtgccctgcaggatgccaggggaagccgcctcgggcctcggcggaggggagagggtcgcttgagcgccatgtgtttgccaaccttgtgttcatttccacaggacttggacctgagagttagggtttccaagaaagaccctagaagtcccctgcctgtctccccactctggaccctagccggaatcagatgttgggacctagtgggttcctgccacctggaacttaccaagtcccgacttcactcctccacttactcctcccgggcaaagcctccccgcagtgctctggtcccagcgctgggctccccttccccgccggcgccttcccggacagtccagtcggcctggggtaggggcgctgcgggacagagggtccgagttaaatgcgggaggatgcgggagccccgtgggagggagttggggtaggagggagttcctcaaagatgcaaaccaagcccagcgttggagggggagagcagagttaggagagagtgaggggaggggcgcagcaagcgactgggaatgggagaagacactggggtgaggagaagaggggtgcagagacagggagatgagagatgattggagaaggagcgagggggacgcacaggcacagagaaacagcgcgaggaggagagatcgagagagacggggcagaggtggagagagatgagagaccagctgagaggctgcccgagagcttggggtgggggaggggaaatggatgaaaaggcggaaaaaggactcgggagcggggaagaggtaaatggagatgtgggttgggggcaagaatgggatgcagaggaaggagaggaggatgaaggagccaggatgcggggcagtggggagggggttgctatctgggcactgggtgaggggagagcttgttcccccaaggacgcctgccaccaggtgtccttgccacaccttgttccccaaggacacccaccaaacctgtgccctggtgcgggggatagaactgacctttcagaggctggaggcccggggcacaggcagccaaggccgcatccttttgggaagaactggagtgaaggaagccacttcagaggacgtagtgggtccagctgacttaggagtgggtcagcgccgggtggagaggagggaggctagttccctggtggggtagcctggcaacattcccattccaccgcacctggccagctgccatcttggcagagccagggggagatgcaccagggagtttggagtcaggaaggcagagttgtgtgggctgaagtctgcgggaaccccagggtgacacaggcaaggggtagaagtcagagtggggaccaaaccatagactggggccctgggttctgcagaggtgtggatggggcaggtggcaggtgctccagtgggggccccaggtgaggccctgatggccctcctggggcaataaagacatcatgggaagggggctttgtggtttgcctctgctctcgtcgggcgatctggctttagccttcaggaggaggtaagcagaggagatcagtgcctgtttctgaccccaggagggccttgttgggctccaacctagagccttccggcttcaggtcccaagagaagtccccccctaactgtgacccccctaactgtgatcaggggtctgccattgcccgcttttctctgcctgatctggggactcaggagaggccacggcagccacagcctaggggtggttcagtccctggcccacagtctggtcagttgagtccttctgggaaccggggctatgaaaactttcgtctttggggaccggtacccatgaaggaaaactttcctgagggggtgaggaccaaagaatcaagatccttttcaggcctgatagccaagatgatgagaacttttagataaggctgtggggagagtccctggccttttgagcatcctgcttgggcacacggggaataacctttctccagcttccagtgtgaactgagaaagagaaagggaaaccctgtctttggagaagctgggatcttcccagcaccagaaacttctgcaggcccctgcctggcccacggctaacctttgggtgggactggagtttcctgaacagggaacaagggagccttccgcagagctctgatgggcaggcctccgagggcctgtgctgtgtgctgttaggatagcttggtgttgtctataccccattagtaagttttgtctgagtgtgtcctcgctgttcattgtctaatttggtaacatttattttggtcctgaccccttctgctgctgctgggtttaagcttcagtgcaggtggaatgacattcaaataaagaaacactttctatcacccacgctggctgccacttctctgagtcactgggatcaagaggggtaagattccaaccctatggatcaggtttgtctggtattaacagaaccctactactgtggcttaacaagatagtttattttaccatcacattaaaaaaaaaaaaaaaaaaagcctggaggtgggtagatcacggctgatatggctctcagtgttatccagaacccaggctcctatctttctgcactgccattttcaatcctggctacatcctcaagaacacctcatggcccaacgtgggctgctggagctccagtcacctggtccacatttcatttgaagacttctggaaattccataggactgtgtcacttggaccacataacagtaaaggaggctgaaaaagtgtggtctgttatctcggcgcattgccagcccaaataaaactggggttcttggccgggcaaggtggctcatgcctgtaatcccagcattttcagaggctgaggtgggtggatcacctgaggtcaggagtttgagaccagcctggtcaacatggcaaaaccctgtctctactaaaaatacaaaaattagccaggcatggtggtgcgtgcctgtaatcccagatactcaggaggctgaggcaggagaattgcttgaacccaggaggcggaggtcgcagggaggtgggatggcgccattgcactccagcctgggcaacagagcaagactccgtctcaaaaaaaaaaaaaaaaatagggttctgttacaaaggagaaaggagtgaatagagagagggatacagtaatctctgcacacctctgacagcacaggcacgacttgtccaagtccatacaggcagaaaagagtagagcctcatctgctctagccagagtgctcagtccagtcactttgcctctctctaaagccccattgaataaatagagaaaacaatagtgactcccccaagggaagctgtaagcaacataccagggaatatatgcactttgctctgcagggtatctggcacgctgtaatgtgcgcagtaccaggtagctacattgaagacttggaaatggagtcctcttccaacacattttaagcacttagtgtatgctaagcacttaagctagaaaaaaaatgagcaaaacagagatgctgtcttaagcataattctggttggggagatgaacatgtgaaaataacgcatgacttgccacatgcagggtattgtgggtatcctaggcaggaatactttaaatggcttttggtgacgtgggcagcgtaggaggaggtcttgctgtaggatgagaagttaggcaggaggggtcaggaaggtcaaagagaaggcagcttgaggaaaaagactgaggtaggcagcagaactgtgtatggaggacgaaaagcaacttagtttgaaatgtgaagtacgaggcagggaggagtcagagatgagtctagagagacaggcgagggccagaccatgagaaagcttgggggccatggacaggagtttggacttaagagcaatggggaaccactgaaggatttgaagcagaaggaaaaatgactcaatttgcattttagaaagagcactctggtggtagcattagggggctggattaggggtagactgttagcccatttctgcattgttataaagccatacctgagactgcatcatttgttttatttatttattttgagatggagtctccctctgttgcccaggctgcagtgcagtggcacaatctcagctcactgcaacctcagcctccctgattcaagtgattctcctgcctcagcctcctgagtagctgagattacaggtgtgcaccaccacacccggctaatttttgtatttttagtagacatgggatttcaccatgttggccaggctggtctcaaactccgggtctcaagtgatccacccgcctcagcctcccaaagtgctgggattgcaggcataagccactgcacctggcctgcataatttatttttatttttttgagacagggtcttgctctgtcacccaggctggagtgcagtggtgagatcacagttcactgtagcctcaactcccaggctcaagcaatcctcccacctcattctcccaggtagctgggaccataggcaccaccatgcctggctatctctttttttttttgagatggagtctcactctgttgccaggctggagtgcagtggcatgatctcagctcactgcaacctttgtctcccgggttcatgcaattctcctgtctcagcctcccaagtagctgagactacacacgtgcaccaccacgcccagctaatttttgtatttttagtagagatggggtttcaccatgttggccaagatggtctcgatctcttgacctcgtgatccacccaccttggcctcccaaagtgctgggattataggc

SEQ ID NO: 575 - DNA, 710 bp, Homo sapiens
cccgggccggcggcccccgccagccgccgccgccgccggccccgcctccgggcaccatgctgccctcgcaggaggcctccaagctctaccacgagcactacatgcggaactcgcgggccatcggcgtgctgtgggccatcttcaccatctgcttcgccatcatcaacgtggtggtcttcatccagccctactgggtgggcgacagcgtgagcacccccaagcctggctacttcggcctcttccactactgcgtgggcagcgggctggcgggccgcgagctcacctgccggggctccttcaccgacttcagcaccatcccgtccagcgccttcaaggcggccgccttcttcgtgctgctctccatggtgctgatcctcggctgcatcacctgcttttcgcttttcttcttctgcaacacggctacggtctacaagatctgcgcctggatgcagctcttggcagctctgtgcctcgtcctgggctgcatgatctttcctgatggctgggatgccgagaccatccgggacatgtgtggggccaagacggggaagtactccctgggggactgttcagtgcgctgggcatacatcctggccatcatcggcatcctcaacgccctcatcctctccttcctcgccttcgtgctgggcaaccggcaaacagacctgctgcaggaggagctcaagccggagaacaaaggcgagtgtgct

SEQ ID NO: 576 - protein, 236 aa, Homo sapiens
RAGGPRQPPPPPAPPPGTMLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFSLFFFCNTATVYKICAWMQLLAALCLVLGCMIFPDGWDAETIRDMCGAKTGKYSLGDCSVRWAYILAIIGILNALILSFLAFVLGNRQTDLLQEELKPENKGECA

SEQ ID NO: 577 - DNA, 41219 bp, Mus musculus
  misc_feature (1)...(41219): n = A,T,C or G
cccaaagtgacagccagaaacctagctgcaaaggagtctcgtgccaatatctgtagtggaggagcccaggaacattgtaccagttgtggttgtaatgaaccgttacactcacttgatcagcggaaaatattaagatggagaacaactgggatagagaggggagataagctaatgacaggaggaatagagagttctgatgagtttgaacagagcccaattctccattttaaaaggccaaatatttttggttattattggtcctgacatagtaaaactaaagttaaatccacacgagggtggtgttctggtggaataaatatgaactaagggttgagagagagccatgcagcaatgttctcccaggttctgccactaataatgcccccaccctgggaaatcacttaacatctctgtcttcagttttcccattgataaaatggggagagtttccataattctctgctaacaggaattaacaagaaataggaacatcaaaactcatcacttgtacatagttgtacacaaaacagctaatcagtctgcttaaaggagcgaaggaagatcttcatagtatttgtgtggcagccaacaaactcctttcccaataatacagtactacaacttcgctaggataatacagtactacaactttgctaggataatttgagagcagtggctagtcactgatagaagataaaaggagcaatgatgatggagttcagttttctttggagatgtctcttcccagctttcctcccacaacatgttaccgaaatctctcatcaggcagcacactgactggccaggtaaacagagaagagagccagagcttcgcattgtttgccaggcgttgtgctcagccaaggtgagcgcttggcaagggaaatagtcttcatttctcaatgttcatgaatatgtaattcatctagtcacaatagatatgtttcatgcagttttggaagccacgtgttgtttcctttctataatggcctcccctgccctacttagcgggtcggcagttcctgaaggtcacagtaccactgagcttcagaacccagaaggtggagactgtgcacagcttattaataagcacgggacagctgtttgactagttcaagctgagaattttttcttggtgttctaatctttttaatgtgtggtagctttcaagagtttgaatagaaatatgaggtggtctttggcttggaatatgacccatgcaagtgtgttatagaagcctaagacctttgacattgactggataattatcttagaaggtgtttgaaagaactaataaaggcaaagcagaaactatggtaaagagccacttgcaggtcactaaagagaaaagtgaactgttgagtgtgattgatggttcctgaaaaggacctgggttcagttcccagcacccatacagcggctcacagcacctgtaaactctagttctaggggatccaacaccctctcccagcctttacaggcagtaagcacacatgtggcacacatacatatgtgcagacaaacgcatacaagtaagataaaaaatgaatggcctctttttattaaaagaaagaatgagacacagaagtatggagcctgaacccatgatataggattgagccaaagggagtctcagaagccattccctgaggacctttggcaccaacaccagtacattttctagaagaatagtttcccagttggcaggcaggtggtatccagaaaggactttctaaggaaatccattgttttcaaaggcttgaaaggaacacgagcatcatcaaaaactaggtctcctccacaaccagaggcaagattagccaggatgtgatgcccaggatggataagctacagaagagcactccctaaacattccaatgaacaatgcattgaaaactcacagagtgaggaaagacccaagacgtcttctgcctaaatatgcaatcatggtcttactggttcactgtctctcaacctcttgacagctgctatttttgttttgttttgttttgttttgttttgttttgttttgttttcattttgcctaagcaagctcaatgctcatgaagcatctaccatacggaggtgaaagttccaacaaaggcatgagtattaatcactaacaacacctttgcccactaaatattttcttattttccttgagttgcttacagggattttgaaaactgctttattaattattctaaccatttgccagttacttaggttttgagaaggctgttatgtgctttaagatcacatttgtgttaaataccaatgtaaatgagccacggaaatgagcagaaatgctgtagtgctggcttgtgttcgcagagatggtgggtcctcccccacttcgggctatttcactctgaggacattaaaccattattaagattggcttcccttcaggcctttaattctgtacaattcagacttgatggctaatagcaataacgctgaaggcaagcatctggactcactgcaggaaatcacttccttcactagagttgggaccccctccccccccccccccagtgaagggagtaaaagagcttcggtgcctcagtttccagcccagaaacaaaattcgaaggtttgctgtgaagtaagtagaaccagtggcaagaacggacggacacagaacttccgagattatttccgctcctttcaagccgtgattttgccattcttgtgtttagaaaacatcagggcaagctcttccattggnnnnnnnnnnnnnnnnnnnncttactcagtgtggcttgtttttgttctcagtacctgtttatgacagttgtacttgattactataattatatagtttaattaagtatcacacaaactgttcgaatatgagcataaaaggagagttgttgtttctgtgaaagctaagttaaatgcgttagaaagacacgcagagtccaggaagtgggtggagatccttcttaaattagctttaagcaagagaaatgtaaaagattgtgtggataataaaatctaaatgaatacaattaaaattttacttcacagtgtcttcatatctttcattttaaagtagctgaaaccgaaaattgaacataatgtataactcagagtgggctttttacaagaaaggtaaagtcacacttaggtttaccacaccagtgctcaaacgaggagtcttagccggatgaaattttgcaagtagatgtgtatgtgttttaagtaaaaatatgcataaatacagtatacatcatgtccactttctttttctagtatgttagttacaaatattaccctcgttggagaaggagatatttacaataaatattattttgttttgttttagtttttttttgagacagggtttttctgtgtagccctggctgtcctggaactcgctcagtagaccaggctggcctcgaactcagaaatccacctgcctctgcctcccaagtgctgggattaaaggcgtgcaccaccactgcccggctgttttattttgagatagggccttgttttgtggctcagaatggcctctgcctcttcattcttctgcctcagctcgtaagtgctgagatcaccagtgtagtgttccaccaagcccagtaggaaatacttactagcatggccatttggttaccattgatgtcccttgttggcctgtgagttccactataggagacatgcatgtttattttagtactgtggtttcagtgcttaatgctagcagcattattctgaataaataaagacaatttctctttaattttatgctgaacatacatagcagatggtatggctatttttttattatctctctctgaaggagggtcaaaaattttcactatttgaaaaaaaagttgtacttcaaaattcttctaagcagtaagttgttaggcatacttgagaataacatggtagaatgtgtttgaagagtagctcttcctgttggctagttgccctgtctgtctgaacaggcctccctgatggcgtgggtatgcatcagcgagccaggggaagcactgcatcttcnnnnnnnnnnnnnnnnnnnntgagcagaaatgctgtagtgctggcttgtgttcgcagagatggtgggtcctcccccacttcgggctatttcactctgaggacattaaaccattattaagattggcttcccttcaggcctttaattctgtacaattcagacttgatggctaatagcaataacgctgaaggcaagcatctggactcactgcaggaaatcacttccttcactagagttaggaccccccccccccccccccagtgaagggagtaaaagagcttcggtgcctcagtttccagcccagaaacaaaattcgaaggtttgctgtgaagtaagtagaaccagtggcaagaacggacggacacagaacttccgagattatttccgctcctttcaagccgtgattttgccattcttgtgtttagaaaacatcagggcaagctcttccattgggggccctgtgttccatccaatagatgactgtgagcatccacttctatatttgccaggcactggcatagcctcacaagagacagctatatcagggtcctttcagcaaaatcttgctggcatgtgcaatagtgtctgtgtttggtggctgattatgggatggatcccctggtggggtagtctctagatggtccatcccttcgtcttagctccaaactttgtctctgtaactccttccatgggtattttgttccctattctaaggaggaatgaagtatccacacgttggtcttccttcttcttgattttcttgtgttttgcaaattgtatcttgggtattctaagtttctgggcaacaatatgaactaaccagtaccccccccccccgagcttgtgtctctagctgcatatgtagcagaagatggcctagtcagccatcattgggaagagaggccctttggtcatgcaaactttatatgccccaatacaggggaataccagggccaagaagtgggagtggggggtgggtttgggggagggtatagaggactttcaggatagcatttgaaatgtaaatgaagaaatatctaataaaaattgaaataaatacatacannnnnnnnnnnnnnnnnnnntgctgggattaaaggcgtgcgccaccgctgcccggctattttattttgagatagggccttgttttgtggctcagaatggcctctgcctcttcattcttctgcctcagctcataagtgctgagatcaccagtgtagtgttccaccaagcccagtaggaaatacttactagcatggccatttggttaccattgatgtcccttgttggcctgtgagttccactataggagacatgcatgtttattttagtactgtggtttcagtgcttaatgctagcagcattattctgaataaataaagacaatttctctttaattttatgctgaacatacatagcagatggtatggctatttttttattatctctctctgaaggagggtcaaaaattttcactatttgaaaaaaaagttgtacttcaaaattcttctaagcagtaagttgttaggcatacttgagaataacatggtagaatgtgtttgaagagtagctcttcctgttggctagttgccctgtctgtctgaacaggcctccctgatggcgtgggtatgcatcagcgagccaggggaagcactgcatcttcctcttcatgctgtgagaaccctatgctcttccatgatcctgcttttgtgattttaacagacgggcttaatccataaaaatgaaaaacatttcccatctcaaaaccatttcctgcctcccaaggtaaaataaaactctccctgaggaaatgatataaatgtgctggaatattctaaaatattgttttgaaataagccatagctctttgcattcatatttaaaaacatgaatgaggtagcagaaaaatgcaggtgggaagagatgctttccaatctccatgtcatttgtgattttctctaagccccagccccttgtctgtacaaatgggatgacaaaagtgtatatcctgtcacgacaaattgtaagcagtcaattaataaagagtgatatgagtctacactgctaccctggtatcaccacaatgtctactagaccccattctttcagcagcttcaatgcctgacctgttcctttatgactagcaggcagcacattggttcctttccttcagcacagacacaagccatctcctcttatactcaaaaggagattagagggtactgattctggagttgacaacaatggtctggttctaacagatcttctggggagatccatggaacactcaaatctcacctcacctcacagtctcttaaagatggataaagagagaagctggagtcaaggcccctgtggaaacagtaatttcactgccagtgtgagtttaaactttaacagctttggtatccatctgtgaaatgtcatttctgttggttccatcctatagctcaaacaatagaaaaatcacacacccagccctgtaaaactctgcaatttctctataatgtatggccactcaagctacactaatttattctacaatttcttttttttttttagcatttttatttgactcttatactacataattaatggtgtttacatggaaaggttgtttaactaatgtaaatggcataagtggattacttgagcaagccttaaaacaaataagcacttttcctctttgaaatttgtttcactctcctctaaatgtctggcacaagagcagagtttttgaaaatgtcaaaggagatatagaaatcaggtttctgaggtccattctttcctggtggaacaggcttataattctgtttcctcctgcaatgattggcttggaggtagtcagcaatgacccaatgacccaacacatcccagactcagaagcacagcttttctttgggaggctgccactgtttttctccatgacctgaaacataacctaatatctggccctttcagatcatttcctgcagttggaagtaacctagaaagagtgacggatgagataaacaaatatactcatcataaacccagaaaaacaccagggaactcctcccaaggtctctgaatatttctaccattgcatcacccaacagtggcaattactgatagtccctcctagtcaaagtccaggttccatgttctttgagtggcagcacaaacccaggttactgtaaattagggcaggcacgatgatcactccctgccaagatattgctttcttaaagcattctgaaggaaacacttttgtaccaacagccatttctttacttctgcttttctcagagacaaagccaaggggaaagaatgaatctactgcctctcacacccacacgtctagcccctctgaggccataaatggaagggctgactctaagtcatttctggaagcaccgataaggcatcatctaaagttatctaaggagttgcagaccagccctttcaagcaggcttttcctggagttatgctgatacctcagacataagcactgagctaactgtcttgaggtctaagcataaaactcaggttccaacgtcgtgagaacacagatggccacttcagttctcaggacaaacgctagaactggagaccacagaggacaatacatcagtcaaaggcctgcaaaaagaatactcggagtaaacaaaccagacacacccagtgctatctaaagaccttcagtcttcccatcacatcctttgaaacatactaaaagctggaaaatatctcctgtttaatattctttccataaaaataaatttgtaattttgtttttgagattatttagctgaagtaaccaaaaaatccactagagtgtctgagtgttcgtggcatggtggtagctctcatgtgttcagactgtctcaacaaagacttgttttcagtgaatgctaagtcaagccattgacactcacacaatgttctactttgtgacccttgaataaatgttgataattttgctgtggccaaaattttttttgagataatcatttttcctgttcaaactccagaaattttctcaaacaaaggtcctatgcttggcacagagaggtgggaaatgtggacctagaagccaaactattcaactgggataaaggccttaacacagacattcccaagatgactgggctctgacagctgaatcctcggcgtttcacagccatttcagggaacttccattctcaaatgaaactgtttatatacattccaagtcctgggctactacttaaaaactgtctaatcacccccaaagggtcttactaattaaacacaagctctggaaatgaactttgactccttgaggaaatttacctgtaaccagcactgcaaagctatcatcatgacctttgagagagacgttcctgaaacatttctcttcagttcacaaaggcagacaacccactgaccatacaaagcttcattttccagcaaataaacatgaaaattggaagctgacctggagttccatttctaggaagtttttctatcatgccacaaaatgtacactatgcatgccctcccaagatacgtatagctttctagacacaacattagttcctaagaaacactctagttgtaactgttatagagtgacattttctgctcagaaagattaggacttatcagagcatatcaacaacaacaacaaaaaataatcataggtctttttaaaggtcccaaatcctgtttcggctgtcggcaaatgctgaagtgataaagtatgaacttgaaaattccactttcaaattgtgtcctctactaatatcatataatcaatatggtttgtttagtgtaacccattactaacctgttttatcttttttctttttaagcactgactacaaagtgcttttatttcaatgatgagcccacaggtactgggtgcagaaatggaattccaatatgctattttctaccggtgaggatacaggcaagtaagttattaagcctctatttcatcatctttaaaatggtacttaataaggctattcacaggattaaatatgttaatgagcaccaagctttgggtaagctatcaataaatattagagtattatactgattacccatcattttcttattacttacaataccaccacacctgtagcctatacttcttagtcaccccctgtcgttcctgattgctccacctatactaagccattatcttccgaaagcagggagatcttcttagaaaataaaaacaattattccggctcccctttctaaagagagacacagtcaatcagaaaacattccagcggccccttacacacacaaccctgccgtagctatctggccttactcgggcgtatacacttctgcttcttttcatcccccttcccccattcccttaaagttttagccatactagtcactctgcccctgtcctaggtgtgtcagatgacagcacaaaagctacttctctaactagccgatacgcctatcttctcacaagtcatatcccttcccatcaaaatgcttaaccttaataaatgcataaactattaaaaggataatttttccccacgtctgttttgcctacaagattataaggttgtaaatgagaggaggtacagctcccagttttgctcatcctgttccttataacccagttcagccccagcctaaaggaggaggaagtcagtaaatactatcttaataaatgaatgaacgcatacagggagtggttaaaatggccagtctcaaaacgctgcctcccaacccccaggctgttttctaaacacacagagcctcttctctagtccttcccttcctcccttcctttcttctcttcctcttttctctcttttcaatgcattttagctgggctttctctccattctattatgccagcaggatccagcaaaccagggaacagaaaaggacctgggaggaaggaaggagcccaggcggcagggcggcgcccgcgggccggaagtgcggcgcacggcggaagtgcggcgggcggaagccgcagcctggcggcccgagcgaggcggaggtgggtaatggcgccggggctacggtgagcactgcaggtgcccgggcgcccgctcgcgcccgcaggaaaaggccgcgagccctccgcagtgcggcgcgctgcagacttccatggcagttagcggggatttaattaagccgggagctataaatccctgagccactggggggagattgtaaacgcgcgctctgggaactgaataaatgacggaagggagaaattcggcttctcgaagaaagcagaaaatgtcttaactcatgcttctcccggtgattcacagatgccctggtcccgggtttaattgaatcctatgaagtggcaatatcacacttgacagcctgctgagttgactgcctttttaaataagtggttttgagcagccacgttgacctttaattggggtgaaaaggttgaaaagagcaggagggaactttgtgagtgctgagcccctctggacccggctgtctggaccccatctttgctttattgggtagaagcagccctctgggcctgtggacaataaaagaataaatcagacttcacagttcccaactagtatttggccatgtcactcacccctgacaaacaccaactaatgcactttttaataagacacaaaggtagaaaatcgtctgattttctgattagttgccactaatgtgaataggtatccaattgtttctaaggctctctttaagtgggtttttgcctatctttatccttattcttactaactgtgtttttggaaaactatcttagtgctctttaaaaaacaaaacactgttggcccaaagactctcagttccttacacgcagcaatggtgctgagactatattatatcccaaaactactagtacatttctcaacctaatacgggctctgtaacattggctaactggtcactccctccagctgtcttggttggacactgaacaagttgagacgactcttaaagaccacagccatctcatttagtactattttgtggaatagcttataaaagtgcacatgatgctctctgccaatacttagaagtatatgcatgaggtgtatgataggtaaagaacagaggataaaatgcaagaggaacagcgcagttgtggttcttgcctccagtcccaacactgtggtttaggctgacagacctcaagtctggaccagccctcaaagcatagtaagagccttgtctcaacaaaccaccagcagcaacagaggcatgaaaacaagtctttcctggaaactgctgagttactgtttctctgggataaggcagaactaatcatggttcgatttgagatgttgaaacctaatcctgggtcctgctgtactgaggaattgcctgggaccagaaaggcccagttgtgaaaattaaaatctctgggctactttaaacaggcccccaaaatatcctctgtttgctctggtccactggaagctacctgccagaaaaggatcaataatttttgtctctcttgctagaggactgtgcagctatgtagttttatttagacagactattgacaggtgagtaatagaaatgaatatttttctaactcagaggatttattgagctgtgtttctgttttgttccagttggttgcttgtattgtactcacaggaacactacccagaggcactgtggagagatccctccaaataagtttgttttaattaaagcttttgtagttcatatcttgtatatattctagcaggccaatctatttagtttctagtgcttgtacttgggattttcaaacacagtaagacattgaggtggtatggtatgaagtagtgaggggttttatgttccttattgtaaatctaatttttttgcacggctttattcaagggatatacatcagaagaaaccaaaagccagctggaatagttcctggatgagattttattcctgtttgcagttgttttgaggggggataccctctggatcaggtatgtgtggctctacaagtagcaggactgtgtgagctcctataactcttccctttgtatatgtagcaagttctagggaaaaagctattgagggggggatatgtaaaannnnnnnnnnnnnnnnnnnntgggggccctgtgttccatccaatagatgactgtgagcatccacttctatatttgccaggcactggcatagcctcacaagagacagctatatcagggtcctttcagcaaaatcttgctggcatgtgcaatagtgtctgtgtttggtggctgattatgggatggatcccctggtggggtagtctctagatggtccatcccttcgtcttagctccaaactttgtctctgtaactccttccatgggtattttgttccctattctaaggaggaatgaagtatccacacgttggtcttccttcttcttgattttcttgtgttttgcaaattgtatcttgggtattctaagtttctgggcaacaatatgaactaaccagtacctccccccgccccccagaggttgtgtctctagctgcatatgtagcagaagatggcctagtcagccatcattgggaagagaggccctttggtcatgcaaactttatatgccccaatacaggggaataccagggccaagaagtgggagtggggggtgggtttgggggagggtatagaggactttcaggatagcatttgaaatgtaaatgaagaaatatctaataaaaattgaaatacatacatacatacatacatacatacataaaagaaaacatcagggcaagagaaacagagtgtaaaaggttttgttgtattttaagtagctcaaagaggttccaaatatagctaaaaaccctgcacggcaccctaaaaagactgagagagccaagtgatgggaaatggtttttctcataattatattgtacattgcagttcaggtccaaccaaaagatgttgccaaagccccagaccagggactgcagaagctaacatatatatgactgtctgagggtacagaggggtggcacggatattcagtgatctttctcccagattccctgtctatattgaattgctctctagaagctctctatgatctcggccttcctgtcagcagctccaacactgggaccaaggacttctctgtggatctactttttgcttgccttctcatctccactgtcaaaacactgttagcacatccacagctgacagggtaaatcaccgccatgagtactgaagaaagactctgtaagaaaagcatttgagaccccttatcagtgcttcattcaccccacctctagcgacttcagcttataaagcaccccagatacctaacctcacatggtttttctgacccttcctacctcctttccttcgagtctgttataggctctgggatttacccgcagagccccagatcccaatacctgcaaatgggaaatagagtgtttacaaacaaaagcaagctaaggtgaaggtattaaggcagatgctaatccaatacaacaatattctttatgagaaatcaatatggaggtgcagaaaggatgccatgtgataatagtggcagagctgcatggacgtcgctgcaggccaggaacagcagggatgctggccactagcattaagagaatgcaagaaaagagacgcatagaggacgtatggttctgctgacacttcggcttccaacttccagcctccaaaaataagagaatttaataaagagctgttgctttaagctgctcactactgtgggcttggttgtagcagctctgggaaataaatcctctctccctccctcttattttccctgcagagatatttagcatnnnnnnnnnnnnnnnnnnnnactgtgcagctatgtagttttatttagacagactattgacaggtgagtaatagaaatgaatatttttctaactcagaggatttattgagctgtgtttctgttttgttccagttggttgcttgtattgtactcacaggaacactacccagaggcactgtggagagatccctccaaataagtttgttttaattaaagcttttgtagttcatatcttgtatatattctagcaggccaatctatttagtttctagtgcttgtacttgggattttcaaacacagtaagacattgaggtggtatggtatgaagtagtgaggggttttatgttccttattgtaaatctaatttttttgcacggctttattcaagggatatacatcagaagaaaccaaaagccagctggaatagttcctggatgagattttattcctgtttgcagttgttttgaggggggataccctctggatcaggtatgtgtggctctacaagtagcaggactgtgtgagctcctataactcttccctttgtatatgtagcaagttctagggaaaaagctattgagggggggatatgtaaaatcaaaagctgtggctaattcacgttgatatatgcttgcacctgtctaaccccattcctgtgctgggatcaggaagtacaaagactgtattctttttatactagttctttttcaagagctaacttcccagggatgtaagaaaaaatgaaaatgtctgttgtatttagaaagtatccgacttcagctcatggttctagaggctgcaagatgtaaatccgtggatgctaaagtctcggcaagggtcccctggctatggcccatcacactaggaaactagaaagggaactcacatgttcagaaagaagcaatattaacaccccttcccttttacttcccatagatctccatgatcagatatcttctaggctctacttcttaaaggttctgttacctcaccatcgccatattgggggttgaacttccaacacttgaacctgctcagtgtatccaacacatgacgtcagtagcatctagtaatggtgattttactttattagtcttcctttctgtgctgctgtgttgtgaatcttccctctgccccaaggtcattaaggggaagggcagtgtaataatcacttttatgtttctagtacctgactcactgcatacactcagttcatgctatggacatggaaaggcagtgtcccttgggggaagtctatacctgtagagaacatgaaaacatctctgaggaagcagcagagagagaggaaaaaaaaaaaaaaacaaggttctaggaagtgaccaagtgctattataagtactgtgttcattaacagcttggaccagggaagggtatggttgaaaatccacaaactgtcaccaaactgacacctgagcagatccacccggaaaactgtagagcatttgttgagctagatacgcagactgagagggcaaaagctttctatatctgcactccttccagacttacagtgcccatctcttcacccaaatatctgtccagccaatatttgaagaattatctatgaaggtatgccaaattactaacttacccaggccaccagcatcttggcttgatcctgtctcagatcctgtctcaaggacctattgtgttacttattctaaactaaattgctcaaatgtcagtgtagaaaatccacaattaattttttgtctgtttggttttttgttttggttttttatttcctttctttactaacagcatcctggtggagttcaaagttcagaggtttaatatatattacctattatatagatagaaatatatataaaacaggaccgtggagggctacatactgcagtctgtgaacctgattgcatccaaaaccagaatgttacagctataaacataagcatcctcttattgctccagtactttctcatattaataataaaataataggaaaatggatttaagttcagtcaggagggaaggacatgacattgagttatttgatttttttcttcttaatatgtatgtttttgctaagctaagagaaagaaactattacattactttatagaaagtcagctaaggccatctgaaatatacacatggaaaaagaggtcttcatgttcaaatagaaactaatgcgaatcttcttagacttagagattggaaaccttatttatactaagagactttcctgtctgaaacttactccttttctcttatgaaccttaaaatagccttaaataaaacatataagcatatgcccttgttcaaggaaaaaataggaataaacaaaaatatattgtacaaaagaattaaacatggtttccttatctaaagtcacttttcagttccaaagtatcagaatattctactgatatctgtgaaagaacaaaataagactcgggagactgttgggtcttccagggcctatcgtgggtagtacttagcattcaagttagactctgtgttgtacaggcctatgatttagtgatagtgaaagactaatgaattattggatttgcagcaaaataccttgcaggtcttatgtggtcatataaattagaaatgaatagaatatcagtgacaaatggaagacattttgaattgcaaatttgtttttagcaattagactggtattactatcttagtataatgtgactaaaacgttttaatgaaattgtcttctttctgagtcagtattaaaaatcagaggaacaaggtcatgttgggtaagaaggataaatgtcaaaaggagtctgcataattccctatgcactttgtgcccgttccctgaactagatggttttgccctcagtcttaaggttatcgttatgggaggatggaactttgaaattagtttttaaactctgttaaagccctatgtctaatataagctaagcacattatttaagttttcttgctttcaggaatgggtttgcagccattatgtcataactgagctgaacattgttgcactctgaattggactgtgctgctctggctctaggccagttgctgagtcagtatctttgggatggaggatagaagggagaaggcagcatgcgcagaccccattgtgataattggtctaggattccctccggaatctgctggatgctatgaggctcatactgtggagtacatgacttttcttggttagcattgttttctttttcttagctggatgttttctggaaaccttttcttgacattgtcacacgcaccaattccactctagagtagactcctctgaaggaatgatctggaaggagtgactgctaagttctaaagattctaaaacacttacctgccctaaagactcttttcctgtcagcctaccccacaccaaggccaaggcgacagtgcttccgcacaaggggaggagtgccaagatgagtaggatatgtcgtttaaaataacattttaagtatgtctaatagaatgtccaactcctatgattaaacagtttccggatgaacgcttgaccactctgctatcagctccccacttcccagtgtagtggtttctgaaaccactgcttcccagttatgagtaaagagagagagaacagttgacagtaagcaatggttgcacttgtgcatggatctcaaaaggatgctgagcttctccaaagagctgcaaattttcagcttccaaagacagaaaattgttcaaggccttgtgcaggcatgggccattcctatgccagttcttcagtgtgggattgctctttcttgggtcacaaggacatttgagacctaaaacctgtgaacatgcttctcttgagtctctggaaaatgagagatcaggacaaatagtagaatttccatttcacagttggcaaaactaaggctcaaagagatgagtttctttgtaccttagaacatgttagtgacagctgtgtttctctttgggatctatgcttgtgaaatcttcacaaataaatgaataaataaataaataatgaatcccacagaattcatatgtaaactctacatgaagatgaactcatagctgtaagtgaacaattatgctacttatgcttaattcctccgattgataagtttgagtgtgaattgtgtttatttaaaagtattttgatctctccagcaaatttactcagaactatttggtaagatgatgaataatgtcaacttaacactttccttagggggcttctgttcggatatacactgcttgaggaaatcattactattatagtaatgactactttttctacccataataataaggcaagcacagagaaagggccactggaagaggattgtcttttgtttaaaatctgtcagtgggaaaattatttttgaaaagctcagattgggtgtccggtttgtgattttctgaaagtttctgagtgacgtaatctgtgacctgagggcagagtgtgtgctatccggtcttatgtagacagtgctgtccagtgtacgtagtgttcaccgcctgaaatgttgagctggagctgaagtgtttttcagtccctcagtttctcacttctgacacacctgttgctaagaatattaagtcttctgctgggcccaataaaaacaaagtttcgggaaaaaaaatcactgtctttagttataaaatcctcttagagttatttcataaccaataattaagcattggttctatattgtttttacttatacagctttttaaatgtgttgtcctttttaagtattcacttcaagatagtcaatctttgtctccactctttcctccatcagttatctctgtccatacccaagatatctgttagcttggtaaattaggcagaaaccagcatggttgtggcatggtagcacattggttataggattaatgcctttggagcaacatcaggtgcgtatcttctggttcatgtgtctcatttcactgtcccattctagacaagccctcatcactgctgagcaatggactgctcctccattctggaagcccttcccactggcctctatggagacatactctctggctttcctcttacctcctcagtggttatacggcttgtcctagcttctctctctccaatcactacaagttggattgccgaaaagatctacgttgagccctcctcttctgtcctaccgagatcatctcatctagtttcatagctgcagatacaatcattataccaagaactaatttttatcattagctctggctcttcacctgagtaccaaacatttatatgtcaccaccgacttgagtctcaatgattctctaactactaacaagttaatcttccaaaatttcataaataaacattgttcaaacccatcagtggttttgaagacatacatgacaaatcatacatggcttgacaactattgaaaattttgggagtcctatcctgggacttaccagcttatttccattattccttatctctttgctcaattcatgtttccctcaaaatttgtatcaagtgttgtctagtcagggtttctattcctccacaaacatcatgaccaagaagcaagttggggaggaaagggtttattcagtttacatttctacattgctgttcatcactaaaggaagtcaggactggaactcaagcaggtcagaaagcaggagctgatgcagaggccatggagggatgttctttactggcttgctcagcctgctctcttatagaaccaagactaccagcccagagatggcaccacccacaaagggacctcccaccttgatcactaattgagaaaatgccttacagctggatctcatggaggcatttcctcaactgaagctcctttctctgtgataactccagcctgtgtaaagttgacacaaaactagccagtataagtgtacttcctattttgtttatatgtccataaatcctaagtgatttcaaatctttttgtgacactatccccaaccttagcccacggtactcatctttccctttctcttgaagctctctgtatgccccattgttacacctcctgccttccttgtttacctgtctgtgcatgttaatattctgaccatatttttaactcttcatcagtgaggatcatctcttatttactttcacctatttatttcctcatcactgtggaattaatgagtaaatggtcatgagtttgctactaatataaagcatgatataacttttatctcaactaagaatcacccttctgccttggtcctatgaaggctcaatgcccatgtaggggaatgccaaggcagggaggtgggagtggatggggggcggggacgcaccctcatagaaacagggggaggggaataggatagggggcttgtggaggggaaactaggagaggggataacatttgaaatgtaagtaaataaaatatccaaaaaaaaaatcatccttctaaatccataaactccatctagaattcttgttgctagtatgcagtgtatgaagttgatgtaagttttattttgagagaaacaaactaatcgctagaatagatgaaggaaaatgtaatggcttaattttactgagaattagaaggggtgttcatgtattaaatggtaggtatgtaaattattactttaataaaatcgtgatcttactgtatagacaagtcctgaacttcaaacagccaaaggacattttcaaaacattcttgcagattgattatgtgtaaatgcagttgaatatggcaccaaagaacttgaaacagagatatccagtctctattccatgatctaaggggagccaaggaagccgtgagtaaatgtgtcctgtatccaagatcttaagttccattccaatttattcagaagcgattaagattcaaatacagctggttgcagactcaaagatgagtgctggggcatcatttgtccctaataggctatgtagaacccagtgacccaagtcaccacctcagcaacctcacctgattacatagcccccaaaatatggggtttgttcctaaaagaagggtgtgtgtttcttttcatttgggtaaaaatagaaatgctataccaagatggtaatgcatatgaagtggagcatttaacgtctcacatggcacaaatgactaaacagaagccttgaagctagctctctatagaacataggttcagcaagagctatgataatagtatttggttaatgtcagctcagcattaaatttacattatagtcttgtgcagaagctccagtgttatctgttaataaccaaggtggtacctgggcttagatagacttcttgattttgcacatgaactaacactgcagcttgctgatgaatgattatgtgagcttagagctttggtgtgccaaaggcctctttgtatgaataaaattctggtcagtgaaggtcagtttctctactcaagcgagaacaatgttgtttccctcctaatcagatgcatacagtgtttgaaagatccaggagccctacataagtgatgtgcagccatagcctgggcagctcgtcatgctgaaatgactaatccttaataaaggctcaaacaaccatagcatcttcctgtgctataatcagttgctttcatggtgtgcccttcagtgcttctcagggaaacactataaagttaacttatcttctctaccgtgcttcaaggaaggctgaactggtccaatcagtcctccccccatgttgtatttgattctgccataaagaccaatgaagtctgcctgcgttgtgttggaaggccagtctccctttctcttttaggggagccgatcctctgagtagcactggacttgaagcagcaggagtcaccgtctttattgttaggcttcaggattttctttacgcacattctaaatccagtttatgctttttctactttcttccagtctgtgacaaaggtgacccaattgtgcttctttgatattatgagcgcagttctttgtgttcctgtcacagagacatataacaaaatacagaggataaaactctatctgtctgtataataggaacactcatttcatgactaaagtgacataattttaaaacaatgctgtcagtaaggcctagtcatacaagtttttaatctcagctgctcagaaggccagggcaggaggagtgcaggttcaaggccaacctggactacagagtgggtcaagggcaggctggactatttagtgtaactcttaaagcttttgcccagcatttatgagtccctaggttcggttccagtatagagaactgggaggaaatgttgtcaactcacaattaggagctaataggcagagaccgcttttcaggatgtttttttatagtactaagatatggttcaaaaataatcgaactaatgaaaatgtcacagtgatagagtagtccacataaagattttacttcaagaaggcataatttggtgaatgtgactttgacagcaatggtgttggggtttacagagttagtcaaatgatctcagaagagcattaaagtgttcccattggagtatatcattttttcatttaatttttacagccataagtgaacctcaagaattaagaaattttagctttaatatctgtctaggtaaagagtaaggagctttttcttcatatcagactctaatataaatttataatacactactgtgaaagaaataagttaattgaacaatatagtaaaaatgcatataccataggccattaaaatatgcaagttgtaaaactgcatagcattgatgccttgctcaggaaataaacgtgccaggtttaagtaattaaaagtgcatgagaaagtagcagtggggaggagagcacagcggtagttgtaagctgagtggctgcagcatcactgaagaccctgcctagctctctggttattgaacaaatattccacccgatctggaatgcatggcagctctgtttactgtggcaggctttatttgtcttggctgcagtcgagaccacatgctgtgttttgtcatgttggaaatactgaagccggtttccattgtggatgtgagtttttttaaaagccttaacacctcagtctcaagtcagctagtaataagttttcctttcctttccagccaaacatcaataaatcttctttccctccaccaaagcaagtagctgcagttcacaatcctggttatagtctgggtacactgctaaggaaggccccatccttcccattcccaaggactctacctctaccatttataaagctagttttttcatttacatctcctccatatgtagtacaatttctttaataccgtcttattttacgagagagtgccactggtatcatagagtccttccaaatccagtgatccagaaatgtctgtctacccactaaacgtcaattgcctatgcttagaaatgtggggcgaatagataaatagctacctataaaattcaatttcccccttcatttatgccctgtgtagtcaaagctgtatcttcaactacattcaccttttggagttgttgatgctgtggaattcacagaaaatgtggctgctaagacttaacacttagttgagaatctcacagaatattgtggcattgcttccattcactttccaaattctaagtagcagatccctgcagttcggctacttagcagggaaatctgggtagaagtggaagggtagaggcttatgaggaaagggaagatcgttgctttcatggatcagtggctgagctttttgtcctatggtctttattgtagtttgatataggttggtagttttttctaaagtcctatcgtttggtctgaaataagtttaaagctaatttacactgagaggcctactagcacgtaatacagtcatcctctgctctgggaagtagggcacaggagatttgaagtggtggcagtgccaactgcagctcttcagtccagagtcaataggcaccctgaggagcagcaacctttagtttagagggaggctaaagaatgactgctgtccacactgagtaattgagcagaggagagattaggagggaaaggctcactctagtgtttcagccctcaagcaaatatataagtacctgttgtgtgcacattgactgtgtgtgctgaggaatactggtgtgagcagtgtctgttcttatagagctctgctgtagtggaaaaggacagaaattgtaagtaggaagggaccgcctcaagtggaaacacttataataaaagtatgcattaggttgattcacaaaaatattgtgaatatgaggatggggagttacatgctggccagcattggtaaggtagactcttcaaggaagggatttgagttcgagggcaaaataaggagaaagtatgtaagcttcctatggagaaagagcaggtgcagtgctgctggtggggatgggctgtggcttgtaaggatagacggagagtcgccacagctgccgctggtcaacctaaagaaggagaagctgggaaatagagttggagaggaaaagggaaggtaagaaataggatcccaggaatttcatcttggaaatagtgctaagtgggaaaggtaactaactatacatgtgtgttttagaagttaaattgtaacacttatagctttagctacaaagctaggtgggataactaggaataatagggtgtctcagtcaagcaaagtagcagtctgagggagcttcaaagcccattgtctgacatgctgctattaaactgttccttctggagtctctccaataaaaacaccagtgtgtttgtgtatgaagcgtttgaaaatcatggcacttcccttttagaccgcttcttaaggggtggaagagacttttcctcacaagttaacccagactgattctctgttagtttctctacctacagctctgtgcttctccatctctttcagtgtgagacagagatctccttggaggtgccttgttctttcgggtttaccatggaagggctgggtggtgctgcatgcttgccagtaagagtgaacccaccatcttaggactaaaagccatctcaggacatctccacttataaggagttatcaggatgcttatagcatttgcagctgaaagttaatttcatattcaaattaacaaactcatgaaatttgcttctagaaaccaagtgattaggtacaaaagtaatagggtttggttttttttttttttattgtttgttttgggctttagttctaaattctgttttgcctggagtacagtgaatttattatggacacttgccaaacatctgggcctctctgacactcctggattctgagctacaattctgaaactttcagattcaatcatgagtttgcaagttcctgcttgtattctaaagagcagagtcaatggtgtgttaactttattggcttatttttcttttggcagaattaaaatgctctggtttcaaggaaagagcctgcagattgccaaatcctcctttggactcttgagaaatctctctgcctctaacagagctctgcctgtgttgaccttattcacaaaggtaccaaagggaaaagcaaaattacaacttaaaaaataacgtgttatcactgttgggtgaaaaggttatgtatgtccctgagaaggggtcaaatctgtaaagaaaagaagtgggaagacctcttttgacctggtcttcagtttttcttcctgagacattatcatttcattgtttctcagttatcaagggtacactaatacacatggtagttattttacccctacatttaaaaaagaactatagattatagttaggatgattaaaattgtcctatttagaaataagtcagttcttgctatttgtagtagttatgtcctagaaaacaccatcaacattgagcaaatattaaacctaggaaagtactggattgggttcccataagcccctgggcacagtatttttgtgaaccaactaaatgcataactttagtttatgtgagtttctgtttaaagatgtcttcaatacgtactgtttagtagtaattagcattttgctcatggccaacaacaccacaactcatgcctaaatgaagcttgtctaacagttgagttctctccatgaggcacatcacagctttcttttagcaccgtgcttaggggagtttgtttgtttgttttaagtcaccaacaaaaacacaacagcaaataaataaatagaaaatgccattaccaatataacagcacccatgggagtatttaagagaatactagtttatgtttatagaatgggtgctaaagcaaggggcaaagcattccctcattggacctcactttagaaatgtcaggtcaactggcaactcaaactttttatagttttatgcatgagcatgttcgtgtttgactgtagaagtgcttccagtattgtttgggggttgcaaactttattacataggcaaagtcacaaataagaatgaatagcgaagactgaagaagtgcttgttttcttatccctggcactactgtaagctacaggggtggtttaactgtgtgagtgtgtgtgtgtgcgtgtgcatgtgcctgtgtgtgtgcgtgtgtgtgcatgtgcgtgtgcgtgtgcgtgtgtgtgtgtgtgtgtgtgtgtgtgtgtgtgtgcaggaggcctgaggttgttatcaggagtcttccctcagtcattctccaccttattcgtggaagcagggtcaatcagttgattctgccttacaagcactggaccttggcaagccagcgtggccaccaagcatttgcaagggctctaaggatcggaaccccagtccccaagcttgcactgccagtgctttaaccactcagccatctcttcccagccttggtggaaaatgtttcaagagtttttcaccctggaaatttggagtacgaacatcagtaatgtctgtttttgttaattagcatcactttgtggaatttataatcaaaaagaaacatgaagacatcagaagttacttttttaaacacagaaattcaaacaaaaggtctttcttgataatttttcagattttagccatttcatagtttaaatcctgacaattagcttataacaaagtctgccagttgtgatggtccacacctgtgtcctccagcacttggtagtcagagtgaggcaggaggattgtagcatgttcaatacaagtctaggccacatagccagtaccaagccagccagggctacatagcaagaccttatctgaagccctccaccaagtgcaaaataaaacaaatttttaaaaatgaacttcttgttgagaatatttcatctaaattgctttttacatcatcaatatatgttgtactgttagaaattatagaaccaaaaatattcttttatctgagacagtagcccctgaagttagctattgagacagtagcccctgaagttagctattgagacagtagcccctgaagttagctattgagacagtagcccctgaagttagctgtatttggactgtggttgccatccatatttttggttccaagagcaggtgaaatagccaagaacatttccagaaaataatcaagcaagcaaacaaaaacccaatctcccattcattcttaatatgtatatagaaccctgtaaagtatgtagcaagatataagcaacaggcatccaataaaataagtagaaaagtgaggaatttgtcctttttctatgacaagtagtagagtacactttacagattgactttaaaacaagagatttttctgggtagttttggtttctggttccagggagtgcttgattcaaaaaataagattattattagtttcagctttgtatcttctggattaaatttatcaccatattggctctttttgattggcccactcctgagccaatcataggcaaaagagacaggatgtcctaatggtttgcagccgtgtcaagtgctcacctttcttgcttaaagatggaattagccacgtgacaagagtagttcctagggaacaaaaccatagccttcttgctacaagaaaggaagggtgtgttagcacacagttcaagaacaagatgaataagtgccacggagaatcctcagaaaagccatcctgacggcggcctcctttccgatgagcctcttgccagatacacactgacatatttgcattattaatttgtacaaacttccacaaacctgattcttaagatcaaaacactctcctcaggcctctactctaaaagcgaactataaagaagggcatttggtacatcttcacttagtacagtcttgtttggtttttcttttaagctcttactttgactttttgacactctcagaaaatttttgttattgccctgcagtaacaaactagccacagtctgtttattgttaatgctaatagcaatttatgagctgaatctggccaaaaagatctagaaatatccaaatccttatttcaaaacatgctctgagttaagccaaaggaaaggcctgtcttctacgtgatagcttaactctttgtaatatattaaaaagcagtttttacccaagcagcagcagcagcagcagcagcaatgctgagcctattttcagcttacagaagagaacctatggctagactctaggcacagtgactaagagacctttaatgactgccgatctgtgttctcccccacctttcccacaaggcagttgcagagtacaaacagcagcgaggcctatgcttcgggtagaacattagtccactgtggatacctgtaatactaaaacagaaacaaaacactgtgaaatgctacagacactcatctgaatcgaagaaaaaaatccctctctccttttaagggtagagcagtcactatttcacggttctctgatagaattcttcctctggactgagtaggaaaacgggctgatgcagttcagtactctcaggtcagaaaagacacaagccatttaggtcaattgtatgaagccaccaaggggctcctcacttaggaaaaggcagagcccttagctcggtagataggctagtgaaaaataaggagcatgtaatgtgcacacataagcacatgccagtaggtacacatacatacataaaacaataaaaacaacaaccgaaaaatgcagagagccaactatcatggaatagtagctatttatgagattctatagttataatttgctttggaaataaagccgtataattaatctgatagaaaactagcctttaaaataagtgtaacatgcttctgatgtggggttttttcccttttggcatgggggaggggatgttataccaaacccctgcctttgggtctaacatcttgttcttcctgtaggccccatgcccgctgtgtgatgaagctaaagaagttctccagccgtataaagacagggtaactgtcatgcatacgaacggggcgggtctagtttactgtatggcctggatctttcccttaggaaaagagttaatgatttcatttagagtttgcttctgttcctcagagagccgggtactgattcccacggaatccattacctgaacagtgctcggcttctctctctctcactggctgtgattcagagttaactatggggtggggtgcgcgcttactttaaacttgggtcccactgcttttgtctttctgtaacttccatggtatgttttcctttagcaagccacagtagcttggctattcttacaccaagacgcttatgtcctgatttctaggcaacttcccagctgggacacgttttacttcatcgggaacagagcagagccctgctgctggatggagcaggtgtgactgaaaaggatggaaatcagaatgtagagtaatggaatcagtcagactttgtaaatgtaggccattggcttgctgtggggctacaacaagcaggagaaaactgtcagccttacaaagtctgggccagcatatcactgcagttgttgcattggtccataaagtggagtgctaaatcctatccttgttttagtttattttacaggaggtggacatcacacttccagagaattctacttggtatgaacggtataaatttgacatccccgtcttccatttgaatggccaatttctgatgatgcatcgagtaaatacctcaaagcttgaaaaacagcttcggaaacttgagcagcaggtgctggctacaaactgatattttctcattgatgcaagtacccagatgagaagtttacttctaggcatcttgtgaactaagaagagtacattgtagagcggggaagctgtagggacgaagaggactacttgctgagtttacttttccctttcgtgaccgtggatgtacttcccatgctggacagtgccctggttggaagcaggctctgcagtcctgctgccgagcagccctggagcctaactttagcggagtaaatgttcttacactcgttaaaatagaatgtgaattcttaataactgtgcactgagaaagggatgttttaatgaacacatctgcatgcagcctattttagtggaatttaataacacctgtttaaaattagtgttcacttttgtggagtagaatagaataattgtcctagccaaaaaggcttcacttcagaaggagaaaagagacctaaacctgcagactgtgtatagcagactcaggtgttcatgtcatcatgggattgatttgtaatgttgaggactgcattaagttatcaattaagttaattcaatgaattgtaacatagtaactttgtcaaatttttgtatcttggaaattattattttaatcataactgaacatacctaagcataaagtatcgttttatataaagtattaaacatgtgtttttttactctgatttatattttgtcaaatttggcaaacatccgaatgaattctcttaacaccaaaactgtcttttttgcttaaatcgcctccctatgaagttctgtgaactgtctgagtgtcagtaagtgctcagggtgagttagtgttagaattacagataatgtagcccaccaaccttagacattgtccttacattatccaggaaggagaatctaaagctcaaagagttggaggaacttttccatggtcacccagccactcagccactgggccagaatcttgacatttctaatgttctctggatttatgtagtggttcaaatacagcaattccagctactgtgggtacagcacaaagtaagccctccaaagtcactatttaaaaatattatgcttagtattgccatgttgtcatagtagctaggacaggtagagactaaagttaaaatagtgcttcatattttgctttatatttgtttatacttgctttataattgcttatatcgagctacagtattctataattctaacaccaactcacactgagcgcttacaggtccagtggctcatgacacccaaacagttcacagaagttcatagggagctgatttaagggaaaaaagacaattttttcttttaagtgaataccttctaatacatgccaaatctgacaaaatacaaacaaatataaaatatgaacaaaaatggtagacttttctcaaactgaagaaatctacaatatggctagatgcagtggtaaacacctttacttccagcactcaggaagcaaaatcagacagatcagatctctctgagtttaaggccagcctctacatagtaagccccaagatagcctgagctacgtagtgagaccctttgtcaaaaataaaaatacatctacaatgtacttacaaggtggtcaaactgaagtgggaatttctagtttctttgaagaatcaattgtatcatgtgatgtttttctggaaacttatgagagaatatttttgctgaagcagacatgtgaaagaaagttttgctgagaatagacatgtagtgtttttctggaagcagcctggaaagtgggtatgtgacgttttgctaaagtggatacttgaaagaacacatgatgtttaaaaagggtattaagtataatctaacagacaatggacactgttgtatggcattggttcaccttgccactcttttctggtcattgtttgtcatgacttcatagaaaaaaaaatgccaccaaaaacttctgttggtagttttctgcccacttcttgtcacttccactaaggccaactagcagagcctcgtggtttcttggatctaacggccactgctgattcatgaatggtgtttgaagtggatcgagctggtgctgctgatttgtgtgatctgaactgctgctctcctgacagcgcacattggattctctccaaagaaacatttctaaacaagtccacatcctcccttgacctattaaccttttcttcctctacctctgctgggcgatgggctaaagggaagtttaaagcatttaagtacccttattaaaagtaggctttaaaaaaatcaaagcctacatcaagctaagttattggctaagacattaaaaaataataatgctaagcccagaaactattaagtcacatcaaggaatatgggagactgaggagaagatactgagagcgtttgaaaaaaataataataataaggtgggccctcacttagttccctccaaaattaaaagtgtggagttgtcagctaacaaaagagggctgtgagaatgacagcaaactggatataagtactgagtaagaacacagtagtctaactatgtttttggtagtcatctaagagatgagttggcaagcatatttgctgtcataaaggaagttacaattctgtttttccagagaagtaagagtgtgtgtgtgtgtgtgatttgtgtgtctgtcttccctgaccaaatgggggccaagcatgaaagaaagctggtgtaaggtacctttcagaataaaattaattatatgtattttaactatatatatttttatatataatatcatatatgatctcattatagctgtcccatattctgagtattgattacatagacctaatgttgattttatacttataaatttcaacaaatttacttttcacttgagagagaggtggttatatgataaagattcctaatattcctctggccccagtagttggtaaagagaaaggcagatacctagaaatgtgttatctaaaaaacaattgggttatgctgacaagtatcagaatgtctcttacagtcattttcctctgattagtaacaacaggcacttgtcttaaatcctaaccatggattgatttgtatttatgtaaagatttgtagcacaagctcaatatctacccccaagtgatgaagcgttcccttttctcattccctttaactagtactttaggaagggtcagaaggaacatgagtttgggtcttctgttgctactctcaaaactgtcattcagtccctcactgcaatatgcttaggacttactgaaacacatactatttggacacttcatttgagaaaacaagatttgctcaaaggggggctttggtttggttttggtttaataacgtaacaacttaatgggcatctacaacagaaatcacaattcatcatgctcttaggagccacgggaaatgaattctgccctcgcacagtgccctggatccccccgccccccccttttttttcattctctccaggctcccagctcccctgctcatacactaaaactccttctgcaaagttgcagcatgccactgcccataattccttctgagatatctattcagcattacaatgttctgaccagcttatgaccaactcccttcatctcagttttgaagtctttggagaaattttattcatattttacaaccagccacccagattgtaaagtcgttcgctaaaactatgagataagctacatttgcgacaaaggtaagtccctggcccagttggttgtggtaaccaaggtcattcatgcagaccataatcatagtccctgtccatgcatcagaggatggaagcagagtaggaaatagggatcagtaactggtatccatgcaaaacatttaagagtgtgtcattttggtatgttcatcaaaagtcaagagagtcagggtggtaagtgcattagcaagaatttaagacggggtgactgaaattcatggctgattggattttggggaaggtagtgatagagagaggtttgggagacagctgtgagggctcagtggatggccagtgcctttgctttggttgttgaataaaacaaggtacttattccctgagacagagggtggataagaaagttggactttggttgtgtttgatggctagagaaaatgacacatggttaatatgccatactgtgggacatccaggaacagattacaatccaaagtgcaaaccacgggtctaggtttggggtacagacttaagagctacagggtatggttggaatttcatccatttggcatattaggagcatttacctggagtatgcccatctttacacacaaaagtagaggaagtcaccagggatggggtaagagatgacagaactggaaaaggtaggatcttatccactttctgttatgtgatagctgtgatttgatagcacccgcactgttataagcactggcgctagcacaccaaaccagatagccagagatccttctcccaggggcttgcattcaagaaggaaaagcacttgacaaagacatacatttgtctcctcagaagatgcgctttttcctaaagtaccgatagtttgaaatatcaagagatttaagacagggactgaagagacttcagggttgaaacaagggaattggtgctgccataaactgaatattctccaagatacttgggtccttgttcccagactcaggcatgtcacttatagtgagaaggaatttgaaagtgtggcgcatctcagcatggagaaatcctattacccacatttaatctcatgtctatgtaagagggagacaggaagtttgactgcagaaaagaaaggaagacgtggctatggaagcaagaggttagactgataaaagaaagaagccccaagcttaggaatcttagcttaggaattccagacactaggcaaagcaaaaggtcagcaatggcaccctagaacctggttctcagcctgtgggtcaggtcccctttgaggtgtgatccctcagcttcctcctccagtggcctgctgtcgtgttttcctcaccctgatgggcactccgtctgggaccgtaactggaaagaaacgctcctgtaagttgcttttggttatagtatttaatcggtgcagtagaaaagttactaataagcaatataggagaatacatttgtgttcttttaaaccactgttaccatagcaataggaagtagttgcagttgttgagattggaagaacagaagtaaactggaaggaattatagtaaaatgagtcagcgattcagaaagcatccatttcgctcactgtgccctcccacactccttcccttctcctccccttggctttccccccaccctggcacttcaagtctctggaaggctaggcacttcatctcccactgaggccagacagggcagcccagctaaaagaacatatccttcatacaggcaacagcttcagggatagccctgttctagttgttcaggacccacatgaagaccaagttgcatggctgttagttgattctgttggttttcctgtggagtccattattcccttaagggctgcaatcctgtctcctattcttccattagagtccccaagactctagtggatggccactcttttgctgagggtgtaggcctctgtctgagtcagttggtgggtggggcctctaagaggacagccatgctagactcctggtctacaagtataacagagtatctttaatagtgccagggattggtgcttctccatgggatgggtttccagttgaaccggttattggttggctattccctcaatctctgctccatacctagtccctgcatttcttatagacagggtaagtttggggctgaaagttttttgggtggattcgtgtccctatccctctactggggttcctgcctggccacaggaggtggcctccccagcctccatatccccaatgctgtgagttacagcttaggataccccattgattcttgggacctcccctatcctaggtttctgtctcttcctggagaccacctcacccccatcatttgctgttttccactcattctcatggccatctgggccacccccctgcccctccctacactaccccatgccccaccccaatttccctcctgatcacctcttccacccagatccctcctatctgcctttcacaaccattctatttcccccttccaagtgaggctcaagcatccttgcttgtaccctccttcctgcccagcctccttgggtctgtggattgtagcaagggcatccgatattttatggctaatgtccacttataagtgaatgtgtactgcgcatgttcttttgggacttcatgacctcactcagaatgatattctcaagatccatccatttgcttgcaaaattcatgatgtctttgtttttcatcgctgaatagtattccatcatgtaaatgtaccacattttctttattcattgttcagttgagggacatttaggttgtttctagtttctggctattacaaataaagctgctgtgaatgtagttgagcaagtgtctctgtaggatagtggagcatcttttggttatatgtccaggagtgttatagctgggtcttgaggtagaactattcccagttttctgagaaaccgccaaattgacttccaaagtgtttgtacaactttgcacttccaccagcaatggagaagtgttgcccttgttccacatactcgccagcatgtgctatctcttgattgtttggtattagccattctgataggtgtaagataaaaatctgagagttgttttggtttgcatttccctgatgactaaggactttgaacatttctttaagtgtgtctaagctatttgaaattcctctgttgagaattctgtttagctctctgccccatttttttaaattgggttatttgaattgttcgtatttaatttcttcagttctttataaattttggatattagccctctgtcagatgtatgattggtgaagatcttttcccaatctataggctgccattttgttctattgacagtgtcctttgacttattgacagaagctttgcagtttcatgaggtcctgttttcagttgttgatcttagagcctgagccattggtgttctgctcaggaatttgtctcctgtaccaatgagttcaagagtatttcccactttctcttcaatgagatttagtgtatctagttttatgttgaggtccttaatccaattggacttgagttttgtgtaggatgataaatatggatctatttgcattcttctacatgtagacatccacttagaccagcaccatttattgaagatgctttcttttttccattgtatggttttgtactttttttgttatggaggcatatatactcttagtacttctttcattgtgtcccataattttgggtatgctgtgccttcattttcatttgattcttgaaagtctttatttctttatttcttccctgactcagagatcattgagaagagggttgttcaatttccatgaatttgtaggctttctggtgtttctgctgttgttgaagtccagctttagtccatgatggtctgataagatacgaggcattatttcaattttcttgtatctgttgaggcttgctttgcgaccaactatatggtcagttttggagaaggatccatgaggtgctgaaaagaaggtatttttttttttatgtttgggtgaaatattccataggtgtctattaggtccatttcattcataatgtctactagtttctttatttctctgtttagtttctgtctcgatgacatgtcaattggtgagtagggtgttgaagtctcctgttaatgtgtggggttcaatgtgtgatttaagctttagcagtgtttcctttatacgtgtgggtgcccttgtgtttggggcatagatgttcagaactgagatatcatcttggcagatttttcctataatgagtgtgaagtgtcctttactgtctcttttgattaattttggttgaaagtttattctttagatattagaatggttactccagcttgcttctttggtctgtttgcttggaaaacttttttccaaccctttactctgagataatgtctatttttattgctgagttgtgtttcttgtacacagaataatgatggatcctgttttcacattcactctgttagcctgtgtctttttattggggaattgagtccactggtgttgagagatattaatgaccagtgatttttatttcaggtattttgctgttggtagtgttactgtgtgtgtttgtgtgtatatgtgttgatgtgtgctttgcttgctttttctggtatggagttacttagttactatgttttcttggatgtagttatcttcctggagttggaattttccttctagaatttttggtagggctgcatttgtggctagatattgcttaaatttggatctatggtaattgagagctttgctgagtatagtagtctaggttggcatctgtggttttttagaggtttcaagataatctgtccaggtccttctagcttttagagtctctgttgagaatttgaatgtaattctgataggtcagcctttatatgttacctgtcctctttccctcacagcttttaatattctttctttcttctatagattttgtgttttgattattatatagcaggaggattttcttttctggtccagtctaatggtgttctataagctttttgtatgtttataggcaactctttctttaggttgggaaagttttcttctatgattttgtggagagtattttctgggccttggagctgggactcttcaccttcttctcattcagttattcttaggttaggtcttttcatggtatcccagatttcctggatgttttgtgtcaggaaatttttagttttaacattttctttgactggtgtatcatctatgcctgagatcctctcttccatctcctgtcttctgttggtgatgcttgcctctgttgttcctgttctcttccctagttttccacctccagggaagtttatgttttctttattacttctatttccactttcaggtcttacacagttttatttatttccttcatctgtttaatattattttcttatatatctttaagggattaatttgtttcctctttaaagacatctacatgtttgattgtattttcctgtatttctgtaagggatttatttattacctctataaaaagcctctatcatctttataagatgatatttaaggtcattttccttgtgcttcagttgtgttaggatatccagggcttgctgtagaagggtatctgtcctctgaaggtgtcatagtgccctggcttttattggttgtgttctttcaaggacctttagctatctggatggctttggtccctggatattcctcttgtagtaggtattgggaaggggtgtaaagtatccatttcttagaaagttttcacagatacctcattagagtctcaaaaaaaaatcagaaaagatctgaaaaaatatctccttagtcccaggcagtaccaggactagaccgccttcatcttcagcctatcttggaaatgattagtgcctagcaagggcattcaggaacccccagggtggccctaactctggaaagtaaattatgataacccttcatggtccagagacacatggctcttattcaccatggagaccagtatattttataccatgaccctaagtacctgccatagatgtctgtttatgaacacagaaatacatgttgaccttggaggcagagccagcaaagactggcctttggtcagtctggtttaggaactgatgctttgcattttaacatccctctggttgaaagaaggtaactactatagcttacattctgaattgagcaatctgaaatgtaaaccttcaggaaagaggagaaatactagagtcatacaacagatggggaatagcaacactgaaacacaatggctatcaatagactagaaacgagtccagccagggtaccttatgagagttgagaacatgcccctttcatattaaaatgctttgtatggggtattagtgatagaatactttctgtccttagaaatggggtagactgataacagagactcttgaatgattcagtaacagcaggatgtagagatgatacaagctaagggcaggttgaatctttgaccaaattaagctacttacattcatcaacatgttataaattccaaactctgacagcagtgcaggactatgttagtcaaaagaccccagccatcccgagccaccaccacagtgtcaacccattctctggccttggaagcaagagataaaattttattttttaaaacttcctcgaaagaaagaaagaaagaaagaaagagagagagagagagagagagagagagagagagagagagaaagaaagaaagaaagaaagaaagaaagaaagaaagaaagaaagaaagaaagaaagaaagaaagaaagaaagaaagggaccagtgaggtgacttgtagataaaggcacttgctgccaagcccggtgacctgaattcagtatctgggactcatatattaggagagaaccaactctcgaaagttgtcttctggtttctacacgtgtatgtgcgcatgcacgcacacacatacacacgcacacacatataaatatcagggggggaggagaaacttaatgggtggcaagatggcttgatgggtaaactgcttgccaccaatccagatcacctgagttaattcccagaacccttagggtagaaggagagaaccaactcccacaagttgtcttctgacttccttaggcatggcacatgtgtgtgcacatgcagagagaatacatgaaaacaagcagtcaaaagtgttcaaatacacaatggcactaagctaactgtgggttgggaagctcttatcagagcaacttactccttggcctagtaagtaaagcattgctctgtgttctttgttatgagtttaagaccaagaagagaaaatagatgctgacagagacagagttgggattgggggtggcggaggggtgtgtgtgtatgagaaagaactgcctgaggatctgaggtttaactatagctcatccaatattgctttgtcaatttattcttaaagctagtctcactctgaaggttcaaggaattaagacattcagagactacaaattggaggatttgttcccactgtgactactggcttgtagtatcagcccttcattctgtatggcatctctttcttgccttgcaaactagcaagatccttgaatttggcaaggatcctgctctgtgaagcattttcaagttaggggttttagcagtggaagatttctcaaagccagtaatagagacaaggtggagaggactatggggctgcgagttcccacctg

SEQ ID NO: 578 - DNA, 1562 bp, Mus musculus
ctggcggcccgagcgaggcggagggatatacatcagaagaaaccaaaagccagctggaatagttcctggatgagattttattcctgtttgcagttgttttgaggggggataccctctggatcagaattaaaatgctctggtttcaaggaaagagcctgcagattgccaaatcctcctttggactcttgagaaatctctctgcctctaacagagctctgcctgtgttgaccttattcacaaaggaggtggacatcacacttccagagaattctacttggtatgaacggtataaatttgacatccccgtcttccatttgaatggccaatttctgatgatgcatcgagtaaatacctcaaagcttgaaaaacagcttcggaaacttgagcagcagtgccctggttggaagcaggctctgcagtcctgctgccgagcagccctggagcctaactttagcggagtaaatgttcttacactcgttaaaatagaatgtgaattcttaataactgtgcactgagaaagggatgttttaatgaacacatctgcatgcagcctattttagtggaatttaataacacctgtttaaaattagtgttcacttttgtggagtagaatagaataattgtcctagccaaaaaggcttcacttcagaaggagaaaagagacctaaacctgcagactgtgtatagcagactcaggtgttcatgtcatcatgggattgatttgtaatgttgaggactgcattaagttatcaattaagttaattcaatgaattgtaacatagtaactttgtcaaatttttgtatcttggaaattattattttaatcataactgaacatacctaagcataaagtatcgttttatataaagtattaaacatgtgtttttttactctgatttatattttgtcaaatttggcaaacatccgaatgaattctcttaacaccaaaactgtcttttttgcttaaatcgcctccctatgaagttctgtgaactgtctgagtgtcagtaagtgctcagggtgagttagtgttagaattacagataatgtagcccaccaaccttagacattgtccttacattatccaggaaggagaatctaaagctcaaagagttggaggaacttttccatggtcacccagccactcagccactgggccagaatcttgacatttctaatgttctctggatttatgtagtggttcaaatacagcaattccagctactgtgggtacagcacaaagtaagccctccaaagtcactatttaaaaatattatgcttagtattgccatgttgtcatagtagctaggacaggtagagactaaagttaaaatagtgcttcatattttgctttatatttgtttatacttgctttataattgcttatatcgagctacagtattctataattctaacaccaactcacactgagcgcttacaggtccagtggctcatgacacccaaacagttcacagaagttcatagggagctgatttaagggaaaaaagacaattttttcttttaagtgaataccttctaatacatgccaaatctgacaaaat

SEQ ID NO: 579 - protein, 150 aa, Mus musculus
FLDEILFLFAVVLRGDTLWIRIKMLWFQGKSLQIAKSSFGLLRNLSASNRALPVLTLFTKEVDITLPENSTWYERYKFDIPVFHLNGQFLMMHRVNTSKLEKQLRKLEQQCPGWKQALQSCCRAALEPNFSGVNVLTLVKIECEFLITVH

SEQ ID NO: 580 - DNA, 41950 bp, Homo sapiens
gatgatgaaagtttctactgaggtgcgatgtgttagccaccaataatacctttgccaactgcaaattttctcaatttccttgaactgcttacagaataaacaaaaacctgctttattaattattctaaccatttgccagttacttaggttttaaggcggctttgatatgctttaaaaccacatttgtgttaaataccaatgtaaatgaagcacagaaatgaacaaaaaggctgcagtgcaggactgtagttcatggagatggtagttcttcccccacttcaggatatttcactctgaggacattacactattattaagattgtcttcccttctaggcctcaaggatggatttaattttgtacagttctcagacttgatggctaatagcagtaatgccgaacacaaacatctggactcactgcaggaaatcatttcctttgttctgagagtcgaaccagcaacctgagtgaatggcgtggaagagcttcagtgcctcagccagcgatccagaaataaaacgttaagccttactgaagtaagaagggaaactgacaagacctaaaaactgaacttcagggaacattctcccaccatcaaagtgatcgtctattcagaattttgatatttggaaaatggtagggcaagagatgtagaatacaggatttggggtgtgtttttcttaagtaactcataagcactctaaatatagcgaaaaccctgcactgtaccctcaaagggttgacagcaccaaatgaagaggaagatttttaataactatatttgaaaccctggtccttgcccaacaagatggagataaagtttccaaacccgcatgctagagattgtggaaattcaatatttctctgaatatctgggagaccaggacacacgaacagtggtttacaatcacagaattactttttcccgccaccctccccaacccccacccccacccccaccgccagtaattaatgggattactggatctaatggtagttctaagtcctttgagaaatctccaacatctcttgaattgttctctggaggtttcctatgattgcatcctttatgtcagcaaccctaacatgggacccaagtccttctcggtgaccccacttgtcttttgccccctcatctcctccaccaaagcatcaacaaacacatgtgtaatagaagtgtcactgaaaaggtgggagtcatcaccctgggcacagtggggagacattttgtaggctgtcatgtcttacaagggaagaaagatactttacttatttatttttggatcagatctttatttttataattttgactttcattttagattcagggggtacatgtgcaggtttttttacatgagtatattgtgtgacactgaggtttggagtacaaatgagcccatcacacaggtagtaagcatagtacccaatcggtagtttttcaacctttatccactccctcttgccccgctctaatagtccccagagtctgtgatttccatctttatgttcatgtgtacccaatgtttagctcccatttataaatgagaacatgcagtacttggttttctgttcctgcgtcagttcacttgggataatggcctctggctgcatccatgttgctgcaaaggaaataatttcattctcctttatggctgcgtagtattccatggtgtatatgtaccacattttctttatccaatccaccattgatgaacacctaggttgattccatgtatttgctattgtgaatagtgctttgatgaacatatgagtggatgtgtctttatgatacaatgttttattttccattgagtatatactcattaatgggattactggatctaatagtagttctaagtcctttgagaaatctccagactgctttccacagtggctgaactaatttacattcccaccagcagtgcataagcattcccttttctccacagccttgctgcccttattattttttgacttttaatagccattttgactggtgtgaagtgatacctcattgtggttttgattttcatatctttgatgattactgatgatgagcattttttcatgtttgttggctacttctatgtcttcaaaaagcactttaaaatgcattattagtctgctcagccattccaccaccagcaatttcttaatggctgtagccaccctaaccccttaacatctcatgatttttctgatccttctcacctctccctgtttacaccagttatgggtagaattgtgtcccccaaaaagatatattcaagtcctaacctccagtgcatgtgaatgggacattatttagaaaacagggtctttgcagatgcaagcaagttaagatgaagtaatttcggtggaccctaatccaatatgactggcatctttataagaaaaggagaagacgcacagacagagacacacaaggaggatgccatgtgacaacagagtcagagctggagagatggagtcgcaaaccaaggaacaccagggattgcacaggcaccgggagtaaccaggaagaggcaaggaaaaaatctgtccagagctttatagagggaacatggccctgctgacaccttgatttcagacttctaacctccaaagtggagagaataaatgtctgttattctaagccactcagtttgtggtactttgttaaggcaggcctagaaaactaatacaaaactccccttccttctctctcactcgcttttattttctcagcagagatatttagcatctctttattatctcaacacctatcctcagatcttcatctctgacccacaagctgccaatgaatgcattttcctgaataaggacagttcccttcctaagagaaattctgatgccagaggtcaagaaaaaaaaatttttttctccattacctatagtgtatttagattaggaaaatatacaagccaagtatgcaaattagatttgggggtctaaactctacaaattggctgttgctcttgatcaaataagcacactctcacttcacatgcattggcagcttcccgctgtcgatagagatgaagatcccctgctcgtgagagcccggaaagcttgcatgaagtggcctctacctccttctgcctcatccaggactgctccccagctgccacactctgctccacccacactgccttctttgagttcctcattttcaacacatcctccctccaccctcacaccattgaccctgctactcctgctgcctggaacgctttctccagattcctgccccagcctgtctctgaggtaactctaatcttcgtctgatcttaggtcaacagtcaagtctttcctaacgccccaggactgtgatgtatatatcacatcccccagtcacagacttttatggcacccaccgcttttctttagtaatatttattcgttgttaattataacagaagctctcttaattcagcaccgcagggaattaagtgatgctttcaaatccctttgtaaaacgtattgatggattgcccggatcacgatcaacacttgaggcttctgccacctggtaacctcaaggcctctactcccaccagctgagcttatgcttactaagagtgggttgtttttgttcccaaacctgtttatggcagttgtacttgattactataattatgtagtttaattaaatatcacataaactgataaaatatgagcatgaaaagagagttactgtctctatgaaagctcagttaaatgccttggaaagacctgaaaagctgggggaaaataactgctcttaaattagttgtaggcaagacaagtgtaaaagattgggggaaaaaataaaaatctaagtgaattcacttagtgaagacacttcacaagtgtctttaagttttccctccactttagagtatctgaaactagaaattgtagatgataatgtatatcccatcattttgagtgagctttatgcaagaaagataacgtaaactttcaatgactggacagatcctaaaagaaaccatcttgactctaacaaatttagcaaatgaatgttcgtttatgtattttaagtaaaaaaataaaatatttatatatatataaccatacctatatgattaaatatatatatatcaaatcatatacatacttcccactttaactgcattttccaattaactagttactggtcttactcccattggaaaatgggttttctacagtaaatattgacatgatcatttcattaatatttgactgtgagctctattacaaggggtacgtgtgtggttcaacactaacattccaagctgggtgcggtggctcatgccagtaatcccaacactttgggaggcccaggcaggtggatcacttgaggtcaggagttcaagagcagcctgtccaacatggtgaaaacccatctctactaaaaatacaaaaattagccagacgtggtggcgtgtgcctataatcccagctactcaggcggctgaggcaggagaatcacttgaacccgggaggtggaggttgcagtgagccaagatcccaccactgccctccagcctgggtgaaagagcaagactctgtctcaaaaaaaacaaaaacaaaaacaaaaaacattaacattccaggaagggcacagtagctcacacctgtaatcccagaactttgggaggccgaggcaggcaaatcacatgaggtcaagagttcgagaccagcctgaccaacatggtaaaaccctgtctctactaaaaatacaaaattagccaggcacggttgtgcatgcctgtaatcccagctactcagcaggctgaggcaggagaattgcttgaacccggaaggtggaggttgcagtgagctgagactgcgccattgcactctagcctgggcaataagagtgaaactccgtttcaggaaaaaaacaaacaaacaaacactagcattccagcgcttgactatggcacatagtaagtagtcagcattattctgaataaattggaaattttcctttattttgtcctgtgcagacacagcagataatatagtaaaatatttaaacatatgtctctgaaggaggttcaaatatgtgcaaaaagattatccctcagaattcttccgagcaataagtattaacttcaactttgtggaagactgctcagtatgctggggcatgtttgagggccacagtatcttttctttctgactgataggctggctgccctgttttgtctgaacaggactctctggatgggggtgaatctgaaccagggaataaaggaggtgcattttactctcctctctttatgccatgagaaatctatcctcctccatgacctagccttagtgaacataacagatgggtttaatccataaaaatgaaaaacttttcccatttcaactccatttcctgcctgtccaggtaaaacaaaactttccctgaggaaatgatgtaaatgcactcaacattcttaaaagatcctacatagcacaaaatattgctaggaactgaaccatgtttctcttcaattacatttaaaaagaattatgaatggggtaatgaaaaaaatatagatgggagttaggaaatgctttccaattccagcttcattgtgatttccttcatgaagcttcaattgccttgtctgtaaaatgggactgataaaaatgcatgccctgtctatcttacagaattattgtgaagaatcatattaaatgatatctataaagatgcttgcagtactacaaagggtgacacaaatgtgccctggtattgttactacaaggtcccctatgccatctttcctcaacagtgtcagtttctgcccttcttctttgtgcctggcaggctgcactcaattcatttcctttagcacagacacaagtaatcttctgttattacaggtgaaaggaggttggaagctactgattttggagtagacaacaatggtcttgctccaacaaaccttctggggaaatccacaggacacttcaactcctatcttgccccacaatcttttcaagacagataaagaaagaggcgtgagtcaaggtccctgcaaaaactgtaatttcatcaccagtatgggtttaaactttaacagctttggtatccatctgtaaaatgtcatttgttggttccatcctagtagctcaaacaaaagaaaaaacacacatctacttccttcaataaaatgtaaaagtctacagtttctctatatttgtgcactcaagccattctaatttattctacaatgacttttattttttagcatttttatgtggctgttatactacataattaatggtgtttacatggaaaggttgtttatgtaaatgacctaagtggactactgagcaagctttaaaacaaataaatatttttctccttttaaaatttacttcactctcctctgaatgtctggcagaagagcagagtttttaaaatgtcaatggggacataggaatcaggcttttgagattcattctcccctggtgggtcgggcttataattctgtttcctgtaatggttggccttgggggagtcaacagtgaccccactgacccagcacatcccagactcagaagcctgtcttttctttgggaggttgccactgtttttctccatgaccttaaacataacacaatatctggcccttagagttcatttcctgcagagtttgcagacctgaggatgggcgactcatgagataaatatgctcactataaagtccagaaatacaccaggaaagaaaacctaccaagtttctgaatacctccaccaaaacaatcgcatcacctaattgtggcaattactgagactgtccctcctagtcaaagttcaaattgcacgttctttgagtggcaacacacagccaaattactgtaaaacagagctggcatgacagtcactacttgccaagacatacattatttttctaaggcattctgaagggaacatattgacatcaaagcccacttctttattcctgccagaggcaaagctaagaggacaggagtgaagatgcctccctccacacccacacaggccacctttcagaggccttaagagggaagcctggctccaggtcatctctggaagaataggtcatgtgtcctctaaagtacctttggagttatgtcaggagttacagatcagactgtgacagcaggctttctctacaccaggcttctgcctcagagatgaccattgaaaaactcaacccagttgagttctgaacattctagcacacagatatccctgcatcagtcctatccagattggtagcgcatagcctagaattgcagtccagacctagaggaggacatgcaagtcaaatgcctaatgacaagcatgttattttgtttgtttgttcatttttttgttttgttttgttttggagacgtagtttcgctcttgttgcccaggatggagtctcagctcactgcaacctccgcttcccgggttcaagcaattctccagcctcaacctcctgaatagctgggactacaggtgcccactaccacacccagctaatttttgtatttttagtagagaaagggtttcaccacattggccaggatggtctcgaactcctgacctcaggtaatccgcccacctcggcctcccaaatggtgggattacaggtgtgagccatcatgcccggcgacaagcatgttttgaatgaacaaaattgtacaagatccagaactgtcttaaggccttcatattcttaaaacactcacatcatttgaaacatattaaaaggtatatacatttcacacttaataatttttctataaaaggatttttaaaattttgcttgtgaaattatgtggctaaaagttaaaatataatttctctacactcatcacatatactcaggaactctcacttggtgagagcatctcatctaaaaattgttttccaatgtaatgaagttgttataaatgctaaacccatccattaatgaagctgacacagtgttcaattttgtgatcatttaataaatgttcattaattttgctatgagtgtccttttttttcttttttggttttgtagacatttttcctggccagactccagatattttcccaagcagagctcccttccccagcactgtaggccctggacctagaggctaaactggtcctctgagctcatggcagtcagccaggcactcccaaagagggtatcaaccatagtgagttctcagggattcctagacattcgacaggactccctctaaccaaaacaataatgtggaggctccaggtcttccgctatcacttacaaacccaagaaattcttactgattaaactcaaattctgaaaatttatgaacttttggctccttagagaaatttactcataaccagtgctaaaagccttcattgttggccttggttgaatccattcttttccttcagtgggtgaaatcaggtttcataagtccaagtgattttataaacctttgttttccaacaataaataagatttggaagctgatctggagttacatttctagtaagcttttctgtcactccacaatatctaagatactcatgccccaccaaggtgtttataactagatcccagattccttctttaaaggtatcctatcagcaactgttaggtggactgtgctttatcaattgacttttttttttccagaaaaactaagtcttatcagagtgcatcaactcaaaaataactataggtagtctgttgacagtcacaaaattccctctttagcctatcagaaaatgctgaagtgacaaagaacttgtaaattctactatcttaatgtggcctctagcgacatcacataatcagtgtggtttgtttaaagaattcattcctgaccttggtttgctttgtatcttttttaaaaccactgagtacacattgaatttatagtggtaagcttaaggcgtcagacagcatgagatggaattccaaatctaccgttttgtaactgtgagaacttgagcaagttattaaacctccattacttcatctgtaaaatggtactagtaatacttaattgcattgttctcaggattaaacagactaatgagtataaagcttttggtgagcaatcaataaatgttagctttgagtattactataattattatccatcattttctcattatttactgtaccaccattcaagccaccacacctagaacctggaatgctcagtagcttcctcacctccctgcttgttctactcttgcctatcctaaacccttcccatctacttcccaaagctaaggggtcctttcagaagggaaaagcaatcagttcaatccccttcccacataaaacagaaatgccccccggctacccttagcacaaacctgaaaggccctgcatggccagactctcgcttaccctctctagcctgtttccacctctcttccccattccctctaagtctcagccatactcgtcagtcttccgcatacaacccatactgcacatcctccaccagacccttcccccagcctgcagagctctgtccccaacccacgcccttcagatcccagccccaaagctacctcttcaacgagatcccactcaggtcttttctcatattccttccctgcaaagcacttagctgaataaacccatggcctatttaataagggataatttcctaatatctgctttctcacacgattttcagtttgcgggagggtacggctgccagttttgctcatcgcattccccataacctagttcagccaagacctagtggaggaggcagtaaatattaaattaacgaaagaatggatgcatgcagagcggttaaaatggctcggactccgcagcctcaaaaagttggctcccgcacctgaggcctcttattaaatggttcccaaacatgcggggtcacttttccgtattttgttttttagtttggccttggtttgtgtgtcactcttcacgagtaaaggttcaggcgcggccacccttgagagcgtagacgggacaccacctgagatagaacgcccagcggcagtgctgccggcgtggggcggaagtgcggggcctggggccggcgcctggtgggtgcgggcggaagtccccggcgcagggcggaagcagaggcgttggcggcgtgaggctcaggtgggttcccttagtcccgcgccgagggtgagcgctcgcgggtctccgcctctgagctgacgcgcaggctggcgggggttcgctgtgccgcgtgctgcccatttggatagtcgttatacggaatttaattaaaccgggagccataaatccatgaactacttgggggagattataaacgcgtgtgtgtgtgtctgtgatagcgctctgggaagtaaataaatgacgggcgggaaaaggaagctttttttttttttaagagaaagcagaaaacatctcgagaaagcagaaaacatctcaacttcatactcctccagtgattcgccgatgccccgtcccgggtttaattgaattctatgaagtggtagtgtaatcacacttgggagcccgctgagctgactgcctttttaaataaatatttttgagcagccatgttgacctttaattggggtgaaaaggttgaaaggtgcagcagggaacattgtgagtgccggggctctctggatgagctgtctggatctcctctcagccttattgggcaaaagcagccctctgggtactgaacaatgagagaataaatcagaaactgtacattctcaacagatattcacttctgacaaatagcagctcatacagttttttaataagtccaagggtagaaaagtccccactaaaatgtcattgtgagttaggcttgtgactgtttctaaggctgtctttcacagggaatgttttgcttgggtgatctttattcttgtttattaataaatagtgtatatgtggtactttatattttagtgcccttaaaaaaaaaatccatagtatggccttagcttgaccccaagattctcaattcctcaaggacagagatggtgtctaagatctgttatatcccaatactttctagcgcatttcccagaattagtatacattgtcttgtttaagcagccactagagctatgccttggtgcacaatgctgaacaagttgaggtgtctattagaggtcgcagtcttctcatttggtcatattctgaggactagcttataaaaatgcatgtgaagctctctaccaatatttggagctgtatacattggggtgcattataggtaattagaaagatttaaaacacggggaaaaaagatacaccctggaaatattggataattatgataatactggggcaaagcagaactaatcatggttctgtgtgaaatatcgtagcccaataacctgcgtcctgctctgctgaggaattgcctggaaccagaaagaccctgttgtgaaaattaagattggtggggctggtgctttaaacaggcaggatcctcagattgtctttcttccctcctgctctggcagcagtagccacatgccaaggaaggatcaatatttttttgtctccttcatcagaggaatatgtggctgtgtggttttatttagatggactgttggcaggtaagtaatagaaatgaggatttttccaacttgggagttgattggactgtgtttctattttgttccagatgcctggctctaaagtactcagaggcactatgagaaatccctttaaaataggttattttttattattaaagtttttttatttcataacttgtatatactctagctggctgatgtattcagttactctaatgctaggccttggggtttcaaacatagcaggaccttgaggtgatctggtacaagtagcgaggtgtttttatgttccttatttaaatctaatttttgctactgctttattcaaggactgtacatcagaggaagccaaaagccagctggaatacttcctgaatacagttttaatcttgtttgcaattatttcgaaggggagaaatcatctggatcaggtatgtgtagctacacagcagggactaggtgagcttcctctatccttcccctagtattgcataacaaattctagggacaaaatcatttggggaagaatatgcaaatgaaaagttttggctaagtttatcttagacatgattccacatccctaacttcccatcccagtacagccacggagaacaggaaacatgaaaatgttactctctttttattccaatccttaccaaagttaaagttcctagatatggaggcaaactgaaagaacctacctactatttttagaaagtatccatctccaaggatttcagaccatttcaccagtaatatctagtaacagcctttttactgttgtagccttcatcactgtggtattgtgttatttgtttgtgagtctttctcctgctcaaggtgtgagtttcttaagggcagtgacaatatcttaatcacttttatatttctaatacatggcacagcacctggcacattgcaaatgctcagtacaagctatagaaatgaaaagatagtgtccctgaagggaggttggatctataaaaagtataaaacattgagaatgtaacaagatactgaaaagaatataaagcagtcacctcctttcaggttgttactagagacagaagtaatgctttaataaacagcttggagcagggaagagtgtatttgggaatacattagatgctcctcaaactgccttccaaggagatctggcctggtcagttgtgggtcctttgttgtttagaatatgcaagctaaaagcttccaccagtcctgtctccacactttctccaggcctgccatgcaacgcctcacccaaacacctgtttagcaaatatttgaagagtatctgtttgaaagtgtgccaaattattagcttatgtagggcaccagtatcttggtttggtcttgccttaaggatagaggacctctgtagagtcactatcttaagtctggtcactattttaagtctaggttgcccaaataatattgaaggaaatccacacttgtcttttctactttactaacaacatttcaaaggagttcaaagttgacagctttttgtgttgtaataggacagtggtggtatatgctgctgccttctgttgccaatgggattgcagcagaaatcgcattgttacaactggaaacaaatgaatttcctctcattgttccagtgctttttcatgttaatcatgaaataatggggaaatgatttttagtcaggagggaaggacatgacgttgaattatttgatttttttaaaactctttgtttcttaaaacacatagtccttccatccagtgaagaaaaatgattctattatttaatagaaaactcagtaaattcagccatttctccaggttcaaaaatgaaatggatgtgaatctttttagatttagagaacagagcctaattcttatggtaaaagaattctactgtctgaaactgagactttcctcattctctccatccttaaattaagccttatacaaaatgaagtgtctgttaattggtatactctgaggattaatatgaaaagtgttttgcgattttttgggaagaaagaggattgaacttggagatgccttctagttctgaaattctgtgttgatctcattatatataaaaatatgccattgttccaggagaaaatacagagaaatgaactaaaaaatatagtatgaaagactttaagcattagtttccttatacataaagcaaggggaatctccaaagtcacttccagttccaaaacattaaaaaaattctatcaatgatagctattaaaaaacagaataggactcaaaagattgtagaatcccacataactgagggatgccacagcctaatgtcaagcaagagtggatggctcccaacattcagattgaagactgtatttctacaggcctgggtcttactgttatcacaagtccagggaaatgctggatttagcaactcaatgtccaaagtcacttgctacaaaatggcaagcaatgaatgaaacatcttttaggttttgtgggggcacaaagataactttatctctttgacaagataaattgaaagtgggtggaattttagggacaaagagaagacattgcctgggtggatggtttttgaattgcaaacagttgtttttggaaatgggattatgtgctttttaaatagcagggaaacttgcattactagctgggtacaataagactaagatgtttaatgaaattgccttctttctaggtcagtattaagtataagagatatcgtcaaagggaatgggtcatgttggttaagaaggataatgtggaaaggagcctgcctaattccttatatacttttttcccatcccttgaactagaatgattttgccctcatcttaatgctatctttatggaatgaaggaattttcaaattggtttttaaactctattaaggcctcatgtatgatataacccaaccacattattcaggttttcttggctttcaggaacagctttgcagccattatgtcataattgaaccgagcattgttgcacactctgaatttggaatatgctgctctggctccaggccagttgctgagtcagtatctttggagttgaggatggaggggaggggtgtagtgtgtgcaaaccccattgtgttaacaggaattagtccagaattccctttggactcttgggaactagagggggtatatggtgagcgtacattactgttcttgattggcatcattattttattttcttagctgagtgtttggaaactcttccctgacattgtcatgtgcaccaaccccattactgagtagactcctccaaagcaatgatctggaaagtgtgaatgctaagatctacatattctaaaacaaaatcttgcttatactgaagactcctctccccttccactttacatttgtcagcttgccacagctgaggcaaagacagcagtgtttctggatgggaaagagaatgccaggatgaagaggatctttcatttaaaatcatctttaaaatgtgtttaatagtaagaaagagaaattcattattttttctttgtagggagagttccatcttggatgcttagacagttgcaagatgagtgccttagtgtcaccttccccattttccagcttggttccttttgacaccaacacttcccagttatgattgagagtgagaaaagagagtatgcagtgaacaagtatctttacacttctgcctggatctataagtgaatttgagtcctctttaaggggctattttaggctcctacagataaaaactactttggattttttattcaaggccttatttagtcatagactattcccatggcatttgtttagcatgtgatttccccttctctgatcaggagaatgcttgaggcccaaagccccaggcacagttcctttgggtttctaaaatgagagaatgggacaagtggtagcatttccatttaattgtggctgaaactgaggctttaggagatgaggatttgcctccctctttgggttttatgtttatgaaatcctcacctaaaaatgcactcagggaagtcaaacatgctgaatttcaacggaaactctatgtgaagaataacttcaaagctcaaaatgaagaactataccatttatgcttaattcctctgactgattagttagtaggagctgtgttggtttaaatttattttgacctctctagacaatttactcagaaccacttggaacaagttttgtctttaaagattatcaataaaatccacctttacaattacctaggcggcttcttttttgacgtgcatgaattgaggatatccttggtaaaataataatggtactgaatttttccctgtttgagaaataaaaacaaatattgggaaaaaccaattggaagggaactggcctttgcttaaaacccatcaaggggaaaccttgatttctcaaaatctaaatttcagtaccttcataattttgtgaaggctgagtaagtttaagccaatacctggtgccaaggtatttgctagtcagtcttacctaggcttagtgacatccttaggtgcagataaatatgttgaatatttaaacagtcatatcttagaaattcctgtttaaataatatttgtgagaaaactttcagttatttctatttgaaatttttttcagttttgcaattccgcatttctgagactgctgttaatagagatttaaatgtttcatttgatgccagtaaaagcacatttcagtcaatagaatcattattattaatagtgatctcttacttttagtatttttagtaatcagtacttaagctttacttttctattctgctttataacttacacagagatttttaccttcatcatctctttttaagatacccaatcaacttttgccttcactcttcccacccttcccactccatcttcaccagaaagatctccttttagttaagatgttaaattgggtaagaaccacttaaggtagttcattttaggagtaggcattggttgaaagatttcattcctttgaagcaacattagatgcatctcttctgatttgtggtagattgtttcactgtccctgttctagacaagccctcatcagtctccttgacaatggacaattctgtcattctggaaacactttctcattgacttctgtgatgacacacttttcaggttttcctcctacctcaccagctgttctgtctgcctcatttgctggttcctcttgatccaacctctaaatgttggattgcttcagagatctatcctgggccctctttttttttctgtacaattttagatgatttcacctagtttcatagctgtaaatataatccttaaaccgatggagactcaagtctttatctttagacccggatttttttcctgagtatcaaacctgtgtatgtcattctctatgtgagttctgacatgtccctaaccgagctcttggtccgacatattcttcaatctgttcttgcctcagttttccttattttagtaacaggcactgccacccacctagaggctcaggaccaaaactgagattgaccttactgccctcttttcttttctttaattcctcatgtccaattcattggcaagtcctgttggctctgtttctgttctagtccataccatcccgtctcatccaaactaatgcagtagccttctacctgcgtccctgctccactcttgccccccaacaatctgttcttcgcacagcagctgaagtttccttttaaaaatgtatatgagatcatgtcatttccctcctctaaatctaactgtacttagaataaaatctcaattctttaacataacccacaaggcctacgtgatctgatgcctgcttactgtgggttaatctcgtctcctgattgtatccccttttccttggtgtactctgcttaagccatacaatcttttctgtttctttcaataaatcatttgtcctcacttacaggcttttgcatttactgtttcctctccagtgcaaacaacacctgctcagagaataccttaattaaagaacctgcctcagtcagcatcacatcactctgctattatctctcccctgtatgtatcaccatctcaagtggcctgacattaaagagtctcttcactagcacatggaccccatgaaggcaacgtaccttactttcttgttcatcaccataccccagcacctataatagtatctgatacatgcaaaatattagataattgttgaataaataatgcatcccacacctagattttcataactgacttctctttcccacctccattctccttttctcaacagtcttttctgcctgctgctgccagattaatctttcaaaacactgattttatcacatcactcattcagaacccttcagtggttcccaagacatatacaacacatcacacattgcttaaccaccattaaaatcctccacaggcttatcctagtccaccttccaaagcttattttccactattattcagcagaagtctctttaccccgttcaaggtttcccccatcagatagccatgtcattcctacctccattacctttgtgtctaaccctgaatttggaaagctttcccttttttctacatatccaaattctcaatgaaatgatttaagatatttctcttgtgaagccacctccaattttagcctatagtactcttctttcccattctcttataacatttgaattatatggccctgttacagtatttcctgtatttctaatttacctgctcatatacatgtcttaacttctgaccagatttttcatgggttgggatcaacccttattcatttttaacccatctttccatccccattgtggaactaatgagtgaatgatatcattgattcactaatcactgtgaagcctgacataaaactttattgttttagttaagaattcaacacctttctcctgaatctgtataactgaaatacatcttgttattcttgttacttgtatcaaacatgtggagttgattagtccatctgagagctttatttagaggtgaaaaaatgagctaaacagcaggcaggatacaaaaaaaaaattaatggcttaatgttactgagaactagaagggtaaggggatgtgcatctactaagtgaaggatatgtaaatgctgtataccttcagtgaaattgtcatcttaggcaaggcccacacttcaaatagctaaagaatgttttcaactgagcagtgtgttgaatacaaattaatgtagcacccatcgagtccaaacagtggaatagagacatccagctacttagaaattgtcatggtaataacttgaagggaaataaagagtttttgtcccaggcactcatgtgaccaatcctttctggagactgattctttgctggcttctctcatcccctgtgtggtaaacctgttgacactgaaatctggaagtagaagctgcatagagggagtggtatgaggagctgcgtctcagtccccagggctgggccataatataggcctattcatagtttaatgtgttgtgtggaagcaaatctgcagtccaaactgtgtagtcagaatgaagctgagcgtgacaccatgtatagccgggcccataggtgggtggttagctcaggatctttgttgcaacattttgtttgagttggctctacctccttaacacttccacctggatgctaaggctgagacactagaaaagcacctctgatctcacctatgccagtgagttagagctgcactccaggttgggccttctactcctcactccctgtttctgttccaaagcttcattttccctctgtgtagccccttggaattgacatatcaaagtatttactcaattttcagttttggttttgtccctatatggcacctcttcttgtcactcttggctccacgagagtcattttctctcttgcccttgaacccaagatcccaggctaggttcccacttgtttgggagagtgagaggtttggacaccaatgactgaccaaaagcacagaggcacactggggaggcatcaattgtccctgtttcgctggattggtagagcccagtgacccagatgtgtcccctaagagcaacctcacctcattacataaacttccagtaatctaaaataatggttttgttcccagaagaggtgtgtgtgtgtgtttgtgtgtacatgtttccagtcatttgggtaaaaataggaatgttacacttagatagtaataaatgggaaatagagcacttaacttctcacatggcacaaatgactgaacagaagccctgagtcttctttagggaatataggttcagtgagagctacagtaatagtatttagttaatgtcagctcagcattaaatttacattatattcttgtgaacaagctccaacattatctgttaaataaccaaggcagtacctgggctgatgtagactttttgattttgcacatgaactaacactgcagcttgctgatgagggatcacatgagcttgaaaatttggtgtgccaaaggattctttgtatgaataaaaattctggtcggtgaagggcagtttctctactcaagtgagaataatgttgtgtcccttctaatcagacacacacagtgtttgaagaatccaggagctccatacaagtgatgtgcagccatagcctgggcagctcctcatgcaagaaatgaataatctttaataaagactcaaacgaccctggcttctttctgtactataatcagttgccttaatggtgtgccctttagtcccttgcagggaaaatactataaagttatttttcttatgttgcttcaaggagggctgaattggtccagtcagtcctgctcccatgttgtatttgactctgccataaagaccactgaaatcagcctcagttttattgaaaggccagcattccctttctctttcagggtgatccatgcctccgaggggcactggacttgaaacggcaggagtcaccatctttattgttaggctgtggaatttgttttaagcacattctaaatccaatcttatgttttttgcttttttttttttaagtctgtgacaaaggtgacccaattgttcttctttggtattgtgaacacagctctttttgctcatatcatagaggcatataacaaaatatgaaggataaaatcatgtctgtgtgtgtagtaaggacacatatttcatgactaaattcaatgacataatcaaaaaagtgttgtcctctcacagtcatgagctaacaggcagagaccatgtttcaggatattttttatagtgctgagatactgttcaaaaataatagaactaatgaaaatgtcacattgacagagtagcccatattaaaattttacttcaagaaggcatgattcagtgaatgtgacattgacagcaatggtgttagggtttacagagttagtaaaatgttctaagaagaatattatagagttcccattgaagtgtatcatttttcattttatttttttctttctaggattaagtaaatgttagaaattaaggaattttagcatactatctgcctagaagaggtatagggagctttttctatcaggctctaatataattttataatacagtgcttccaaagaaataagttaatttaacaaaatgcatataccttagagtatttgaagaatatgcaggtagtaaaattgcataatatggatgcatttctcagtaaatagatgtgccatgtttaagcaatttaaaatgtgtaaaaaactagaaatggagaataacagtggaaaagagaactagttacaaacagaatggttgtagcatcactgaagactttacttagctctgtagattggttgaacaaatcctccagcaaatctggaatgaatagcaactctgcttactatgacaggttttatttgtcttgggtgcaaccaagaccacatgctgtgttttgtcatgttggaaaaactgaagcagatttcctttgtgaatttgaagtttttaaaaaagccttaatacttcagtctcaactcagccaggtaaaagcaatgttttccttttcttatcaaccagacgtcaataaatcttaaatcccttcaccagaagcatgtagctgcagttcactgccctggtcgtagtcagatcaccaccacagatggcctaatcctcctcatttccagggacctttaataaaactaatttttctttaatgaagttaattcttctgcctttaataaagctaatttttaattttctttctcttagaagggtgtgtcaccattagcatagagactttccacatcccatgatgtataagtttctacctagagtaaacatggctaacaattctgtacctcctccccatttttatagcctgtgtagacaaagctgtgtttagaaggtatgtctctaactacatttacctattggaaaattgttcattctgctgaatctataaaaatatgtatgtaccagtgattaacacttcgttgagagtagcacagaatgttatgaaattgtttagatctactttttaccttggaacaactggatagcagatccttgtaaaattctcatcatattccttttttatgcatttatcaggatcatttagttggcagagagatccaagtagaagtggaagagtaagggctgaagaataagggaataatcattgttttcatggatcagtatccagtctttttgttctgtggtctttattctagcatgatatgggttggtggttttctctaaagtcgtatcattctgtttgaaatgagtttaaggctaatctcacactgaggagccttgtctctagtgaagattagcatttaattaatatagtaatgctctgtgaagcagaggagggcaagatttgaggtggtggtgaaggagttagaaccagttgcagtaccccaacccaaaattttgtgggtaccctgaggagcactgatctttagttattatatagaataggcccaaatagtgactgctgtacatactgagtatctaatcaggggtagaggtgagattaaagaaggtgagaaaagctcacttcaatacttttaacatacaaataaatatttgagtgcctattatgtgccaggttaattgtgggtacttggagatacagggttgaacaagtacctgttcttatagaacttgcattgtagtggaggggacataaataatttttgatagtaaagggcaaaagaaaactacagcaagatgtgagggtggggagtgttgggctgactaacattggtaagttagtcactaaacctccaaggagattacatgaggcccaggccaagtgaggagaagctacttcagagcttttcatgcagaagtaaagcaagtacaaaacgaggaagaaatgatattgggtatacaaagaacagaaagagaaactttgcagttgcaacttgccaaggcaagggaggggaaagtgatagatgaagttgcagagatacagtaaagcaaagtttaaaaatgatgatctcaggaattaattcatcctagaaatactgataaatgatgaagccaatagtgcacatgtgtttttaaagtgaaattataatatttacagttttcaggacaaaactggagactcagtagaataactaggattaaacagaatgactgtagcatcacagaggacttatgtcttatgttgagcaaagtagcaggatgaggaagcttcaaagcctagtgtttgagatgctgcgatcaccaagctgttcttactggaatatgtccagtagaaacacaagtacatttgtgtatgaggtttccaaaagttatgatgatctccttttgaaacacttcttaaggagttgagtagatttttttttctgacaaggtaattcagcctgattctctcctatagttcctgtaagtaagctttgtggtttttgttcttgtttttgttttttttgagatgtagttttgctcttgttgcccaggttggagtacagtggtgcgatctcggctcactgcaacctccacctcccagattcaagcaattctcctgcctcagcctcccgagtagctgggattacaggctcctgccaccatgcccagctaatttgtatttttagtagagacagggtttctccatgttggtcaagctggtctcaaactcccgaccccaggtgatgccttggcctcccaaagtgctgggattacaggcgtgagccaccacgcctggccagctttgtgttttcttatgtctcacagtggagaagcataggtctcataagggatagtctgaacctttacctggggacttatgctgcttagctgcttacccattgtttctttttctttttctttttttttttttttgagataagatctcatgtccatcccccagactggagtgcagtggtgcaatcatggctcactgcagccccaacttcccaggctcaggtgattgtccaacctcagcctcctgagtagctgggactacaggtgtacaccaccacacccagctaattttttgtatttttagtagagataggttttgccatgttgcccaggctggtcttgaactcctgggctcaagtcatctgcccattttggcctcccaaagtgccaggattacaggtgtgagccatggcatctggccctcattgttttctttaccatggcagtggctaggtattgttgaatgcttgccagtataataagctatccatgagaataaaagccatctcaggaaacctccatattttaggggatcatcaagatgccggcaaaatctgcagatgaaattttatattcaaattaacaaacccatgcagtttactttcagaaaccaagtgattaggcatacagctaattcataacaagggatttttttctattctaaattctgtttcgttcggaatacaatgaatgttgaggcatcagagagacttgccaaatttataggtctttccaacactcctggacttgaagaaacaattctgaagcccgcaaattccatcataagcttggaaattactgtccatattgtaaggaacaaagtctagggcacataagtttactgctttatttttcttttggcagaattaagatgctctggtttcaaggaaatagcatgcaacttgccagatcctcctttggactcttcttgagaaattgctctgcctctaagacaactctgcctgtgttgaccttattcacaaaggtacaaagtgaaaaagtaaaattgttgggtgaagaaagttgtacatttaagaaaaagggacaaagttgaaaggaaaggcaatggaataagctttcttcagacctgctcttcaatttttctatcagcacaacagcagcaactcagttttctacccagataccttattatctcccaattagcaaagagtaaattgatgtatttaatggtcatctggcccctacattgaaaaaaatgaagtataggttataatatggtgtttaaaaatgtatcatttagaaatacaatcaattatttttatttgtggtaattatgttctataaagtcaccttgaacgctgaattaatgaatattgctcctaggggaaatacacagttaggttcctatgagtctctggtcataatattttcatcagcctaccaaatacagaaccttattttatgtgtgattctatttaaagatactttatttttacatttgcaccatggaatactatgcagccataaaatagatgaaataatgtctttgcagcaacatggatgcagttagaggccattatcctgagcaaattaacacaggaacagaaaatcaaatactgcatgttctcacttataagtgggagctaaacattgagtacacatgcacacaaagaggggaatgatagacaccagggcctaattgagggtggagggtgagaatcgaaaaactacctatcaggtgtatgcttactacctgggtgatgaaatcatttgtacaccaaaccccagtggcatgcaatttacccatgtgacaaagctgcacatgtacccccgaacctaaaataaaagttgaaaaaaaaatttttttaataaagataccttatttagtatatattgttgattcattaacactaaactcacagccaatagcacttgtgtataactcatgcctaaatgaagcttatcgaacacatgtattttctccataaggcacatcacagtcttcttgtgcttaggaacactagccagcacttcagcactgtgtctgggggcttatttaaacagtgaaatcaccaataaaaagcacaaaaatgcaaaaatcctggcactatgcacaccatgaaaaggacactagcttacatttacagtatgagagctaaaacaagaaggcagagcatcaccttgtttgacctcagcttagaatgaatgctttgggtaactgaaatctctcaccagtctatgcatgtgcatgtctgtgaatacctgcaaaagcgcttcaagtattgacttgggggttgcaaggaagttttagcaattaggcaaattcataaatatggaatccataaataatgaggactgattatagttgttttcttatccctaacactagttttaagccataaagctagttttaaaatatttaacagctttatctccctgaaattataatacagacattactgatttctttttttgctaattaacatcactttgtgtgatttaacaaaaaagaaataaagtgcaggttaatagaagtaactttggtgaataatactgcaattcaaacaaaaaagatctcttttcaataggtttttgagatttcaggcattttagcaatttggatatatatgacagttatttaataacaaagtttaatgagttttaaaaatgaatttattgatgaaaatatttaatctaaactactttttatatctgtaagtatatattgcactgttggaaattatggaaccaaaaatatttcatcatctgagagtctatgatgggaaacccatgtgcaaaccacagaagttaaataatcccttaaggctggtgttgctcactcagcctaacagttctgcactgttcttcggtttgggcagcagtttatatagccagaaacatttgttaaaaacaaaacgaaaaaaccacaccaattttccattcagcttaatatttatacttaatgcttattctgtaccattaggcacacaagaagatggtactcccacctttggcagcttataatccagtgaagtaaatgcttaaaagtacagtatcagattgctatcagttatgaaaaatagaaagtacttcccagagtgagttaaacaaaaagattttggagttgctctggtttcaggaacagcttgatttaggaactaaacatgttaacaatctcttcagctttgcatcctcagggttaaatccccctctagttcttctcatgtgatatggtttggctctgtgtccccacccaaatctcatcttatagctcccataattcccacatgttgtgggagacacctggtgggagatgattgaattatgggggtgagtctttcctgtgctgttcttgtgatagtgaatgggtctcacaagatctgatggttttgaaaacaggagtttctcagcacaaggtctctctttgcctgctgccatccatgtaagatgtgacttgctcctccttgccttccgccatcattatgaggcctccccagccatgtggaactgtaagtccaataaacctctttctttcataaattgcccagtcttgggtatatatttatcagcagcatgaaaacggactaattcatcatggatgactgcagccatcccaagcctcagatctcacatctcagtcatctacagaaactccagcaaaagccttatagctacccactggctctgattggcccattcttgagggataggatgcactgattgcctgagcctaagtcaggtttctcacctttgtttttctgggatggagtcagccacatgctgagagtagttcctgtgaagcaatattataacacgcttgctacaagaaagggaagtgggtggtggacagccaacccaacaaatgcccactatggttagggacagagtaaataacaagtgccatggaaaatcctagagaaggatatttgaatggtccattccactggtatctttttttggttctttattgttttaaaatttgatgagcctttcctcataaaaatatatacacatattttcaggtataatttgcatagacttctgtggaccccaggtctaaaaaacaaaacaaaacaaaaaacccaatctagattcttctaaagttcttaatataaaagcaaaattttagcacaattggtacttctgtaatttagcatgctcttggttttttttgcttttaagatcctgtgttgagtttttgaaactttctctgaaaattttaggatgtttatcttaaaacattacaaactatccataatctatgtattgctaatgctaataataacatgataagccaattctctgttctaggaaattagggccagaaagaccctttaatggtgtgattcttatttcaaaacaagctgtgagttaagctggaggaaagccctctcttttacataatagcttatctcttcctgtcatgttaaaaagaaggttttatataagcataagtaatttggggtctgttttgagctcatccaagagaacctatagcaggtccctgttcagtcagacctttaaaatctgccgatgtagccttgtaatatagtttgaagtcaggtagtgtgatgtctccagctttgttctttttgcttaggattgtcttggcaatgcgggctcttttttggttccgtatgaactttaacgtagttttttccaattctgtgaagaaagtcattggtagcttgatggggatggcactgaatctataaattaccttgggcagtatggccattttcatgatattgattcttcttccaagcctacagtaaccaaaacagcatggtactggtaccaaaacagagatatagacaaatggaacagaacagagccctcagaaataatactacacatctacaaccatctgatctttgacaaacctgacaaaaacaagcaatggggaaaggatttcctatttaataaatggtgctgggaaaactggctagccatatgtagaaagctgaaactggatcccttccttacaccttatacaaaaattaattcaagatggattaaagacttaaatgttagacttaaaaccataaaaaccctagaagaaaacctaagcaataccattcaggacataggcatgggcaaggacttcatgactaaaacaccaaaagcaatggcaacaaaagccaaaataggctaactggatctaattaaactaaagagcttctgcacagcaaaagaaactaccatcagagtgaacagacaacctactgaattggagaaaatttttgcaatctacccagctgacaaagggctaatatccagaatctacaaagaacttaaacaaatttacaagaaaaaatcaaacaatcccatcaaaaagtgggcaaaggatatggacagacacttttcaaaagaagacatttatgcagccaacagacacatgaaaaaatgctcatcatcactggccatcagagaaatgcaaatcaaaaccacaatgagataccatctcacaccagttagaatggcgatcattaaaaaggcaggaaacaacaggtgctggagaggatgtggagaaacaggaacgcttttatgctgttggtgggactgcaaactagttcaaccattgtggaaaacagtgtggcgattcctcaaggatctagaactagaaataccatttgacccagtgatcctattactgtgtatatataaaaatatatacacatattttcaggtataatttgcatagacttctgtggaccccaggtctaaaaaacaaaacaaaaaacccaatctagattcttctaaaattcttaatataaaagcaaaattttagcacatttggtacttctgtaatttagcatgttcttgggtttttttgcttttaagatcctgtgttgactttttgaaaccttctctgaaaattttaggatgattatcttaaaacattacaaactacccataatctatgtattgctaatgctaataataacatgataagccaattataaatcaaaggattataaatcatgctactctaaagacacatgcacaggtatgtttattgcgacactgttcacaatagcaaagacttggaaccaaccccaatgtccatcagtgatagactggattaagaaaatatggcacatatacaccatggaatactatgcagccataaaaaaggatgagttcatgtcctttgtaggtacatggatgaagctggaaaccatcatttggagcaaactgtcgcatggacagaaaaccaaacacagcgtgttctcactcataggtgggaattgaacaatgagaacacttggacacagggtgtggaacatcacacaccggggcctgtcgtggggtgcggggagcagggagggatagcattaggagaaatacctaatgtaaatgactagttgatgggtgcagcaaaccaacatggcacatgtatacatgtgtaacaaaacggcacgttgtgcacatgtaccctagaacttaaagtataataaaaaggtataatatatataacatatataataaaagtataataacaaaatataggagaaagtgggaaaaaaataaaataaaataaataaaatctgccgacgatccatagtattctcaacagacttctctgctagatggtttatgagtgcaaacaatggacactaaaagttgtttgctcttcaggtggagaatttgtccaggaaacctattgttgacacttgtaatgagaaaacaggcggtgcaataatcatctgaagtgaatagagatttgttttactttttaaagatgaggcaattactatctgactccatcctaatgggtttcttcctgtggactgattaggaaaaacaggctggcaaggctcagtgcttttcagtcagagcagactttaagccatcctcgtggtgtcagccaggccaactgtatgaggccacaagggtgcacctgacctaggaaggacaaagcccttagatcagtgaaaaagagaaacatctatatgtatgtattatatatacacatagatagatggcttgatttatggagaaaaatcagaacaaaacaaccaaaaaaatgcacagagcctatgaaatattagttatttataagattctatggtagtgttttactttggaaaagcagtgtaactaacatggtagaaaactattctttaaaataagtataatctgcctcttatgggttttttgttttgttttgtttttgtaagggcaaatgccattctttgggtttaatcgcttgggttttttttcttcctgtaggacccatgccccctttgtgatgaagccaaggaagtactcaagccttatgaaaacagggtaatataatacagtgtggcttttatgtatatggattgcatattagatgtggtataaagtatctgcctggatccttcctttaggaaaagagattaaatgatttttcttttaaattttctttctgttcttcagagagagagtttagtgcttattaccataaaactcattacacctaagtgttttcctctgagcagtactggttttcttactctggctcttactgagtcaaagttaactagcaggtgcagcattcatgttttctttaaacttttgccccattccttttatcttgttttgcagtttgcactgatgtgttttcacgtaacacaccatcacacctttccagttcctgtaaccaaaacatttctgtcctgattctcagtcagcttcccaactgggacatgttttatttcattggaactgagtactgtcctgatgctgaatgtaacaggggtaacagaaaagcagcaagatcaggaagtagagaatataatgaaaccagtcaagttttggaaatcagggacattagatcactgtggacctaaaacaaacaaacaactataaggaaaatggcattagaaatggtctggggatcagtttatcactgcagttgttacatcaccccatggtctaaaatacagagctttagtctgtctctgtttcagttcattttacaggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaagtatcagtgtgggaactgtttgcttaatggcattttataaaataagaagagcatattagcagggagggagatgatggagggagggagaagtccatttgtcttatttatcctttttgtattaatagagaagcacttcacagtcactgggcaatgccatttataggaagaaggttctgcattcctgctgctgccccggagggcttaactttttaatgaaagaataaatgctcttccactcagtagataaagtgaaatgtgaattgttaataactgtgcacggtcaataaagcgatgttttaaggaatacatctgcatgaagcctattcagtgggatttaataatacctgtttaaaattagagttcatttttgttgagtagaagagaattattatcctagccaaagaggcatcatttgagaaaaacaaaagaaaaacttaaactccttaaatgtatataaaaatctcaacattctctacacagtcattgaattcatttgtagtatttgaggactgcctttcatagttattcagttaccatcaattgagttaattcaacttattttaagacagtaggtttttttaagtcaaattttaatatcttggaaaaagtcactcctaaatatgtcatctaaagataaaatactctttgccattctatgtaaagtgttagaaatgtatttgcgtacccttatttatatttagtcagattaagccagtgtagaaatggattcacttgaaaacaaaactgtctttcctcttaaaatcttaccactgcaattccatgtataatgaaattattttttaaactatttgaatgaatttggatattgtgagtcactagattttaatttgatcaggatgattcagtcttagtgtagaatattagagctagctgaccttagacattgtctagtcccactcccattttatatatgaggagaaatctgaaattcagagaatatcagggacgtaacccaaggtcacacagccagtcagttggcaggccaggtcttgccccacagccccagatttccagtactctctggactcattgcagggggctcctgttatctcacatacagcatccccaaccattttggatccaacacaaatctggaatcaacttaaaaagccttttaagctgagtacagtggtacatgcctatagtcccagctacttgagaggctgaggcagaagagcccagaagtttgagtccagcctgagcaacatagtgagactgtgtctcttaaaaaaaaaaaataaaagagaaaagaacaaaatcttagcaattgaatagcagtgtttatcatttacaaatttctggaacatttatttgacataaatattgagccctggggtgggcagaattctaggataaccccagtgatccccactcttggataattccctgtccctttgagtgtgggtggaaatatcactgctgtgattatgttacattatatggcaaaagggaaattatcctggctgggcctgacgtaactgggtgagccctttaaaagcagagaattctctctggttagttataaagaggaaagtagagagatgtgctctagcaagcctggaagaaagcaagcatcatgtgaattgcctagtggaaccacatggcaagaaactgggtagcctctgggaactgagtaattctcggccaaaaactagcaggaagatggggacatcagtcctatagcttcaaggaaatgaattctgccaataatcagtaagcttagaagaggatccccaacgacagatgagaactgcagccttgaccaacatcttgatttcagctcagtgagactctaatccaagaatccagccacaccaagcatagacttctggtttacagaaactgaaagacaataaatatgtcttgttttaaactgctaaatgtatgataatttgttacatagcagtagagaatgaatacaagtccttacagcattgaagcaccgtagtaggtgatgggagtacagaaatgaataaatcatagtccttgtctttgagatactcactatctattaaggagcaaggagagacaagtgaataaagcacagcatagtgcaatgagggctggaactgacacatgtcaaatggtaccaggtgggaaaagtagcaggaatgattcacagaaaattagacttaagctaggtcttgatggctgaatagaagcaatggatggggattgggagtaaggagggtattctacaagggaacagtatatgtaaaatatgagggtgtggaaggacacagcatattcaggaaatgctaggtggctttgtgtggctggagtaaaggggaggagagtgaaggagatgagactggcaaggtagattgggatccatattgtgaaggccttagctaatgtgcttttggcccagcatcagtagcctcccatgcttcctgcctttatccatagtcagtccttctgactcctgactactcaggggtgtctggcctccctaccccagcctgttgcagtccttcttcctgtccttaagcatgctgagctcaacagtcccttctagtagtcctgtaggacaatcccactctcaatacaaccagggatgccacagacaaagtcctccacttgtgtgtctgggtgtcctgtgttcattcctgccttctccaggcagggtgagaattgtgtagcccctaggacccaggttgctgattcttctcctagaccaccagttggaaaggttccaagagtttctttcagtgtctgctcaactaagatggagaaaatccattggttcccttcaaaaagcatggctggccagaaagcctagagacgtttgttctcttggagcacttcttacctgagtataaccatgtggttatagtgtgcaggaagtgcagagactaaaggtgaaacagtatttcagcaacaaatttctgacactagaatttcaaacaagaatcccatgatataggatgctcaaactaaagtactggctaaggcactaagaaacaatagatgctacatttcaaggaaatactagatcatgtggaggattattatagacctgggagagaggatctttggaggagttttttaaaaataagatgtcctctcactaattttctaccaaagtagaaaggttgggagtcacttcatatcaagagggaggggcataagttggactcactggaaagcgaatgtatgtccttgggtaagaagaacatagcggtctaactctcctgggaaatcaggcaagagatagtttagcaagcagatttggctgtacagtgaaggcagctgatgctgtttctctgagtttgtcccagggaagtaaagtaagtttgtgtgtgtgtgtgtgtgtgtgtgtgtgtgtgtgtgtgtgtcctcatggaccaaatatgaaccaaatgtgagaggggactggtatgagggcaccttcgttgcaggcaggcctcagaaggggatacccagagggaaacactgggttccgaggggctgaggggtctgctcgaatggagagcccatttgcccaaatcagggaactgcaggcaagacatcgccagtaattggtacagtctcccaataacctgcacagcctgtaccaagtgtggtctgctttaactgtttattgggtccagaaagtaggccagtatacaactccaccactgaaataagaacattctcacccctctccactttttctttctcccatagcaaccctacaaggatcagaagctgccaggaacaaggagaagacgctccccttcctcaccttcccacccccacatggcttctcagtcggggaaaagatacaacttaactttaaaccaagtcttaagttttgattatgacatgggattagatgcaccaaaaacaatttcaagtgactgtggggcattctattgcctgagaatgttcaagagtcctgatatgacctgttgtttttatcctaaacagtgaaaaattcatccaccaaatatataggaatagagggagacagaaagatgctttctgaaggtatcccatatttagagtattggttacatatacctaatgttggttttaacctatagctcttcaataaacttactcatcaattcttatttcagagaggaatatggtcatgtgactaggaatcctgcagatcttcagcaaacccatgggtcccaacagctggcaaaatgaaaggtagatacctacaaacatggcatctaaaaggtggtttgattatcccactgtcaagtatcagtgttatgtcacctattactgtgattttcatgtgatgtttgtagcagcaattacttttcctttctgaaattatgtttgcaaagatcaatttgtttttatataaagattaactttgatataagaagctcatcattcacctccaaaggaaaaggtgatacaagcttcctttttttcccccttcaagctaatgccttatgaaggagtggaatagtttgggacttcatattgctgctctagaatagtgcctctttcttccacatgtctcttcataacattatgagcttactggaacacatagctctttggccagtttattgcacgaaacaagggtatactcagactggggttttttaaataatgcagcaatctcatggacatctgacagtaggaatcacaatacagccaggcttcagaagtacaattaaagaaccacccaaaactgaaacatcacccttctcacagtgccttggcttattttcttccttgttctctcctggctcacagctcccctgcttacacacactatctgcttcctcatagctgcagcctgcttatgcccatcattactgctaacctttctgttcagcaatacagcaccctgagcctctcaggcttctctattctgaaatcctaaaaggaattttactcagcttatattttacaaccaggcacccatgacctaagttggctgaccaaatctatagaaggagccacctttaggacagaagcctatccctgggccaactggctatggaagcggtatgcaaatcacagtcactgcccactggcagaggccagaagcaggacaggcaatgaccagcaactctggcacgcctccaaaaagcttaagaatgtgacattctaccatactcaagagaagtcaggagggacacattggtaagttcacttatatcctactccataggagtaataaggacatgaaccaaagcaatgggagtcagacagaaagagatatcaggagatatttaggagtgaggttgacaaaacttcatgactgactggatgggtcggtagtgatgtggagaggggagtagagagaaagcatggattctgggataactcccagttttcttgcttacactactgggtgaattctgatactttttattccctgaggcagagaatgtaagaggaaggaaaagttagttttgggctgtgcttggtggatgggaaaggtaagacatggtgaattctccatgcttgtgggatatcaaggtaaagataaaagttagaagtgcaaaacaaaggtctggggttaaggtatacatttgagagcccactgagtatggttggaaatgtggccacctggcatataaggagaaaagcaagctattcccaaaccatggagaatactaatcttgacccatgagaatagaggaagttgctagtgaaggaaaatgagagagtggtggtggaactaggaatgggagaagctcatccaatttacattacgtgatgccttttgtgatttgatagtggcaggtattattccaagcactggggataaaacaacaaacaagatagccaggattcctactctcagagtcttgcattttaagggagagacagacaataaagatatcgtatcagaggaaaataatcatgaaagtcagggaggagcttttcccagagtaactgacagtatcaaatagcaagagagttaggatgaggactgaacagaagacatcagatttgaaaattagaaaatcagtgctgctataggaagaatagtccccaaagatacccaggtcctaattcctggaacctgtcacttatatgcataaaggactttgcagatttaagttaaggatcttgagatgggaaaattatattgcattatctaagcaggtcctaatgtaatcacaggtgtctctataagagggagtcagaaggagatttgactagggaaaagagagtaggaaattcgacaatggaagcaaaaggttggagtgatacaagaaagcagccatgagccaaggaatgtgaatggcctccagaagctaagaaaagaaaaagaaaacagattatcccctatagcctcccgaaggagcaagccctgctgacacgtttactttagttctgtgaaactgatttctgacttctggcctatagaactatgagagaataaatttgtgttgttttaagccaagtttgtgataatttggtacagcagcaatagaaaatgaatacaaatgtttccttgaccttattgagaacaacttttgtggagagggaagaggtaaactaaaagaaaattgtggtgggatgataactgaaagatacagaaaagacagcaaagtatccattttttaggaagtttttatatatctcatttgacccactaagaaacgacatccagaaaggagctaaagaccagaggtaattgattagctcagcacccaaaaatggcaggcagtgttggggcagtactagaatgaggtagccggccgggcacggtggctcatgcctgtaatgccagctctcagggaggcaagaggtgggagtatagcttgagcccaggagttcgagacctgcctgggcaatatagcaagaccccgttctccagaaaaaggaaaaaaaaaaaaaaaaaagcatagaatgaggtagccataacattctacctggcttttggctgaattgtggggaggagagttcagaggcctcaaaagtgaccctgacactggagagtaaaccatagtaacccattatagtccacagatatgcgcaccagacccatgactcttgttcaccatagagacaggatactttgatgctgtgacccaaaatcctgcacctggaacagatttggtacctctctattgacacagaaattcatgttgagcatggagacataatcaagagagaatggcctcattcgatcggtcttcagcttaggcactgacattttgcattttacctcctctctcaggttcaaagatgactaccaaagctaaacctctgaattctaaagtctacaaggacataaagcttcagggaaaggggaaatattaatattaatattaatgtcatacaaaagaggagaagcagcacataggagtgccagctaatagactagtagtaataagaagaatccaaccataggcctatattgagagtcatgggcatcccttctttatgctgaaatggtatatttgaacggaattcctgatggaaaactttctatccttagaaatactgtaggccaaatattaattggaacttttgttaatgatttgagaacaccaaaaagtttagatgatacaagttaaaggcaaattgagcccatggcctcattgtgctacttagaataccctgtgacccagctctcctcagaaaccctgatggctttgttgcagcattgcattgcacagaagacctcagtggtggtcctgagtcctcacaacaaggtcaacccgtggcctggccactaaggcaacagagagggaaataaattttagaaaacgcttcccttaaaaatgagttaaaatgtacatttgcatcatgagactaggttaactgtcacctgagaaagtcctatattcagaaagacttaatcctggaccaggtaaatgaggcatttgctgtatgttctttgttatgaatttaatgctacaaagagaaaatgggcattgatgcataatctgggtaaaaaagagatgtcagaagttgggaaagaactgccagaagagctatgttttaggatttcactccaccttaccctgtgttttcttgtaaagatattctcaaaattaggccaatttcactcttttaaggtcagaggagattaagatatttagaaatcagattgtgggattgattcccattgtgattgctgacttttagtatcagccttttgttctgcatggattctctcatcttgcaaactagcaagactcctgaatttggcaatgatcctgctctgtgaagcattctcaagttagggttcttatcaatgtcagatttcactaagccagtaataaaggaaaggttgagagagcaaaggatgtcactgagttgacacctaacagcacaaaacaacttgtcagctggcaggacaagccagcatgttcagggtggtcacagcctttgagttggaaagatagtcttttaaacattcttacctcaccaaataactttaatagataaaatttagttactccctcccacttttgttctattcatttaaagcagtgttttttaaaaatttatgtatatgtgactacatgaaaaatacattactgtgtttcttgatgttttatgacctgtacacaaagtgagaccagcagatgccttcaagagaaataaaggacactgctgtcattctaactaaattgtccagaggaggaaagaagagtacaaaaatgattatgaatacttaagaagaggcatgactttgtcattggtgtggagcctataattatgtgcaattccctacttaagactttttagttatgctgaacattgaaaaaaaactaaacagcggagaggagaaaagaaaaggggaaatttaaacatttaatggaacacattcattaaatggagacatcgcttcaccataagggggcagttaagggtttggtagtcctactcacttgctattgtcaaatcatttgttttatcatggatttgagatccttataagtcttcattattattttgaattcaagaatgattccttctgctcacaaaacatgatcacttttcattgatttttttttttaatattctgactggttttgcatatctggaaaagataaatcttcaaaatttggaaataaatatttttcctccctgccaaatccataatatgatccctttctgtcactgacagcaccatcagataagtggacgtgccttgcttggttagaaggatgctgcgattttcagcaggaacaagaatgtagttacagacccagcctaagacatgtttagggcacgttgttacagattctttttggttctgttctagagatatcttcttaagtcccaatttgacattagaaattctcattcagggccaacgtccccagcaaaccaggtatcccacaggcaggattcaccttcaggacttgggaggaggccctcaagacgtgggctgcagcaggagacacaaagacaagagactaaaaaaatacaggggcttggcctcttcagattcttgggatcttcctctcctcctcaaactggagcctgagtttaccccagaactgatgctgagaacaaattggggagggagaggcaaatctgaagatgtgcaaaccacaaaaaactggaggcatgagaaactgaaatctaggattctgtaatagcaccaatatttgttgttgttcccttccatcatttataagtaaaatgtgaaataagacaaagggaatcagttactctacctaaagctgtattttctagttttccccagcttttatttttaaaaatacatattttattttattttattctgtcagcaatcccgtgatataaatagggcaggtattactatccttatttttgagatgagaacagtgagtcccagaaagaggaaatgactttataaggttatgcagtgagtcagacagcccaaggaataataaatacccagttctgctcttatttaatccagaacatttcccttcctggctttaagcatccctttcctccttctccctttggtggttctcttttgaacatgatctctcaccaactgtggatgagtccatgttcagagttgcagagaactgttgtttatagatcccccaagg

SEQ ID NO: 581 - DNA, 492 bp, Homo sapiens
ctgccggcgtggggcggaagtgcggggcctggggccggcgcctggtgggtgcgggcggaagtccccggcgcagggcggaagcagaggcgttggcggcgtgaggctcaggacccatgccccctttgtgatgaagccaaggaagtactcaagccttatgaaaacagggaggtgaacatcacacttccagaaaactctgtctggtatgaaaggtataaatttgatattcctgtctttcacttgaatggccagtttctgatgatgcatcgagtaaacacctcaaaacttgaaaaacagctcctgaaacttgagcagcaaagtactggaggctgactgatgccctcatgattttccaccctctcttcccataaagcatcttcctaaggaaatgaccatggcctgatactcattttgtcacttgtacagagccctaaggatgttctgaattcagtggtgccaaataaatgttgacattccccttttggttgatggaag

SEQ ID NO: 582 - protein, 109 aa, Homo sapiens
LPAWGGSAGPGAGAWWVRAEVPGAGRKQRRWRREAQDPCPLCDEAKEVLKPYENREVNITLPENSVWYERYKFDIPVFHLNGQFLMMHRVNTSKLEKQLLKLEQQSTGG

SEQ ID NO: 583 - DNA, 22618 bp, Mus musculus
  misc_feature (1)...(22618): n = A,T,C or G
tggggcatgtgccccaaagctggctgcctttcccaggctgaatggctgcccgcctggcttaacccagacaagcccagggtgccttgtgtccttggagcctggggtccacacagccagccgaagggctgggcagagactgaaaggcaagccggggacaggagagaggcaggcagttgagcttctggggtgttgcgttggtgagcaggaccgcccagtgcccgtcagccttgccatgactgacagagaagaccttatgcagatttttgcatttggggattccagcaggtggaggtcagaatctgaacccagcaggacctgcctcactgcagtgaaccagaggtgccagccttaagtcctgctaactgtgctgggggccatgcaagccctgggcactcaggcacactgtttgctgaaacagaatttccgtgcttgtgtttttccataattatattagcaggtgggatttttcctcggggaagcactttgagggggagcgctgtggctgtgtccccgcctgctccagcgtgagctcacactcagctctgcccgcctgcctgccgtaatgattttttaattatgcagccagtgctcggaattgctaatctacctctagcccagcgtcccctgctgcagctcacaccccagccccttgctgccaaccccccaaggggcagtacccagctatatacccatcattgcatactgagggggacaactgctacagtgagggagcagggtctagagagagtcatggtggggggggggggaagcagccgtgcttctctttgtctcccactccagcctagtcccatccttgcttgcattggccggctgtgtctctggaagagggtaggggagcgatcggtgcccatccccaagaatatgtccacatcaacagcaggaatgttagtccatccgtcctgcttgtatgacccccgaggacataaacatactatctttgtccctgtcagacttggactttgcctcacttccacacacagacacatagctaagctgtagtacaatagccaactccatgatgttaacatttggtcacacctgagggctggggtactcaggtggccctgtggctagatcccctcccagtcacctccacaccctggtctttctcctttcccttccctggtgggggcctgcctgtagctggcctgtaagagcctcaatcgaccctggcctgggggaagtggtggtggggggggcaggctggagcacagaggcagcgggtggctgtagctcctctccaggcgcccagctgtggcatctgtcaaggtcagatagcgactccggaaccagccagcttggccccatggcccctctcgcctcattatttttgtgttccggggttgcgacgacacctccctccctccctccctccctccctcccaccccttcagtctcctgcgtcttgcctgcctcccccacgcctctgcagggagggcctgcggtctaggggcttttgtttgccagtttttaccacgctaaggcccggctgccaggcaggcggctagatgctgaccagagctattaggccttgaacagcagacaggtgcctcgcttggggctgggattctcagcaaaaacagtgaattggtttctcaagagggacaaactgaacctgggtgacgcccagcccccactgcaccgcaccgcaggcacacctgtgggcagcttcctgtttccataagggccttagcagctggcaccagttcccaactgcatcatgcccatcacactcgggccccgccagggctcgctcacagggcacacacactgctgtctcacagctaaggcaggttagcacacagcagaagaacctgcagacactcacccaccatagttaatactctacttgcaaacaacactgatgactgtgtacgacctgaggtatgggaagcacgcccctccaccttgcacactgggcgcttatgttccaagtgcctccacctgtgttggtgcagaactgcaatggcgctcttgtccacaaaggttagcgccatggacttcatccgcacctggccatgcccaccagacaaaggctccaagcctgaatgtctgacatgcttcccctgatagctagatggttctgcttcctactcccttcttcccaggtaccccaagtttcttacttaacacccccaaaggggcctttatcccctgaaatgctgggaagagacatctgcttggtgcatcctgtgtccagagtgtagggaagggtggcttgccagttgcgctgccccacccacctggcccaagaacatcctggtggagtcggatggggggtggttccaggtgggtcatgacagcttgggtgccacagtttctggttagggtatgtaaatatgggggatgggggatgtgggcctgttgcagatcccctagagtctccggggcagccacagccatccactcacttcctcctccagctgtggactgctgtggttgttactgggagggggagaagctagaggcttagtggtggctggacaccccccccccccccaggaaactcaaaaccctgggccagccgggtggcgggttggggcaggcacaaagaaggcctctgtgcagcctggctgggctgcccacaggattctgggggaggcagcaagagccggtttccgtccccttctgcttcctgcggaggctgccggaatgcccggagctcttgcccggccaggcccgtccggcccacccgtagccccttcccctaggcttggggtacagccgcagactctttagcagtcgtgcttgatgtgatgtccctagaagcctgaaggccaccagaaagatccttgggaggagccttctcctcttaagccagggttagaaagccaggtctgggttcaaactgtggccctgtcacctactgacctggtgaccttaggcagatagtttcacatcttttagttaacagagtatagagacagtccataataagctacaaggcctgggtgtggtagctcatgccttttatcccagcccttaggaagcagaggcagacagatagtttgagctccaggagagaccctgtttcaaaacagctacaacaaaaacaaggaaatgttcagcacagtgcctggcttgctgtcacgtcccccttaggcaaccagagctagaggacaccatatgtctccctgcccctcagtaagccaaattccatctgtggcttgcttagaggcttcctctcctacaaatcctatgactagctctggcctcctgttaggccactaggtctctaggtaactagatgaggagttgctttcccaaactttgtgtgtgtgtgtgtgtgtgtgtgtgtgtgtctatgtcttcttccccttggaggccaggagcaggagtcctacagtttggaacaagggtcaagaagccgttggcagggctagagggatggctcagtaattaagaagagtactagctgtttttgcagtggacccaggtttggttcccagtatatacatggcagcttacaattccctgtaactatcggtctaggtgatgctgtgttccgatctccttggtcaccaaaaatgcacacagtgtatatacttaggtaggcactcatatgataaaacagtctttgggcatttcctattctacaaatgggaaactgacactctatgcagggagagggctagttcaaagttcatggtgagggaacagagccacgacacagaccgaaagactccggtgcctagctagctttattcttttgacagtttacctactctggctccttgactcaagtgtcctctgagctagctttcgctgcctgtccgtgatgaaacccatcaggatagaggctaagcagggacgcgagctatcatctcaggtgggtgtctgcttagacagcatcactccaggaagcagttagttcagggtccaggggtacccagagcagaatatcagtctgtccatcctagccacagaccattctgcctattctcagtaggacaatacaggacatactcagagggtgtctataaggagtatatgggctaaagcatacagaagaaagcctatctgtgttagtgatcgatagggtcctatataacatgtcagaaaagagctcaaaaggtcatatgctaagccgggcaaggtggcacacgcctttaatccaggcgggggcaggcggatttctgagtttgaggtcacagccaggtctacaaagtgagttccaggacagccagggctatacagagaaaccctacttgggctggtgagatggctcagtgggtaagagcacccaactgctcttccaaaggtcccgagttcaaatctcagcaaccacatggtggctcacaaccatctgtaatgagatctgactccctcttctggagtgtctgaagacagctacagtgtacttacatataataaataaatattaaaaaaaaaaacctgtcttgaaaaaaacaaacagggctggtgagatggctcagcggttaagagcaccgactgctcttccaaaggtcccgagttcaaatctcaacaaccacatggtggctcacaaccatccgtatcaaaaatctgatgtcctcttctggagtgtctgaagacagctacagtgtacttacatataataaataaataaatctttaaaaaaaaagattaaagaggcgcacaactacaccctgcccctctctgctatttactgtcttgcagtgttaagatccccagtagtgtcaagggcatgtctcaccccaaccaattgctaagtgcttggggttgctatggctgtactggtctatcccccccatactggcctgtcaggctgtgtgtcttcctgcccccaagatcagcaccccatgtgtatctcttgggcccaacagggctccccaaccctggagacttcccaagttaaatgatgggaatccgagacagaaccctctcctcagcatcagtgggtcagctcagttcagtcggtggagcctgtggtctgggctgtctgccaactgtctgtctgtctgtctgaccgacctccttatagtactcatcagcactgcttctcccccccatactccagataagtaaatacaagaaactcctagccagggtcctctgtagagttagcccactcaggccatgctgttctgcttggtaattggagttacttcaggaaacctacctttcacaggcaggatagacacaggttattaaagccagtgcaggcgtaatgccctgggcaaacctgtccttggacataattctaaaaatgcacttaaaaatcattgaaccaggccaagtgtggtggtgtatgccttcaatctcagcactcatgaggcagaggcaggtggttctctgtgagtttgagaccagcctggtctacaaagcaagttccaggacagccagggctacacagggaaaccctgtctcaaacaaaaacaaaaaccaacaaacaaaaaaatagccaggcagtggtggtacatgcctttaatcccagcacttgggagacagaggcaggaggatttctgagttcaaggagagcaagggctatacagagaaactctgtcttggaaaaaaaaaatagctggagagatggctcagtggttaagaccacttgactgctctcccagaagtcctgagttcaattcccagcaactacatagtggcttacaaccatctgtaatgagatatgattccgtcttctggtgtgtctgaagagagtgacagtgtattcacatacattaaaaaagtaatttaaaaaaatagaaaaaacttacagaactagggccaggaatggtaactaacatccataatcccgggatttaggagctcgggttgttgcctctcccgctccccaaacacacacacccaagaaaaagcatccaatggccctgtaaatgtcctatccttggcctcaagactgtggctgtgaccctgcagaggtcatccatacctggcacccgctttcagctgtgtgtcttggtcatgtctccctatcctttgccaacctcttcctccaagaaggcctctagcctcactggtgattccaccagcccagctctcacgcactcctgcgggaagggtcagtgtggccatcccacttgcccctccctccacagtaacacagggcattggtaggaaagggagaaccactaaacatttagatctagctgtaggcctcctagggacagagcaccagcccctcccaggacgtaagctccaccccctatgcagtcacgctcttctggggctgagggtagggtgaggccatcaccaccacctccggtgacctcattgccagctggcattatgatgtcactggcctagcattctgagttcctcctgcatgtgtatctctaagcctccaggtggggcactcccctgggggcctgtgacagctgacccctgaccaggaagaagtgacaggcatggtaacaatttggtggcagggtagtaggataactgggtcactttgccttgggctgttctgtcagttgcccaagtagaacaaaggcagccataaagcaggtgaccagcacttagctctgggttcaagttctaccacggctgacagcttgaacttttgtgaacctttgtttctttatctctgaagctggttaaagcttcctgtctctcaggtaccactatctgaacatgtgaagcatacgaatgcaacagcagaatagatgctcaacaaatgcgagcccctaggaaagggttcttagttaaatgttagttgaggtgccggtttgaaaggaccagactctgctttcagggggtagaggctgaagtaccccccactgctatcaggtggtcacatgactttccttcttcccaatagccagacacccaagcttctgaggctagggtctggggcaagaactctgcgttcccatccctccatctgttctccccaagtttatgttagaggtgattctcactctcagctcctccctctgtgggcatctccagcttctttctttgggctgtgtcattcccattcctggtcccctatgtcccctctgacctctgacggtgagtctgcttcatcctacctaccaggtcctgttgtctctgacctgttcctaggttctgtgtcaacattctctgtccttaacacctgtctctccttcacacacacaccccagcccccaccccaccccagctcttggggactagttccttcatccctaggccctgtccccacccgtcagcccctggttccagctccaggccgccgggctcctgcatggacaaaggggtcctttgtgggctgaccgcggctggcggggcggcggggcgctggctccgcattgctgatgaaacggagccctttgttgtccctcctcaggcgcagtatttctttttgggggctggatgcgttcctggcagggctgatgatggatgcgcccgccgctgccgcctgcctgcccgccagctttccctcccgctcattcccgctccgcttcaacgcagcccagctcttcccctgctgcctgggtattgccaggcccttcttggccttggaggggttgctgtgtgccctgccataaaagactgggggcctaggaaaatgtcacctctttgttctctccttctgtgaacaggttagatgggacctgtagttgttagggaccagggagggcatcagcctttccctaggtctgaaggggatgatgacacagccacaaaggcaggtttggaagaagattgggagctaggcctagtccatgaagattggttttgcatatctgctgtctggctttgaggaccgttacccctgtggccagtccccttgtgtatcctcccttaccttccagggctagcaaagcacggcgttcttcctgcagcacctgctcagtgacatatcacgttctctgtcccaagctcagtatgctgtaggactctgggactgagaccacgtcgtccctgggaggaccgacgtgagagatgagacagattttaggaggggaccagagatgaacccaaggcctgttctcaacctagacagactgggatggagacaaaagcaggggctcagccagagcaagtaagcacagccctgaaccacgctgcttgctgtgttgaagggagctgacttctaattgacctgccggccctgcacgcagagccagctcctggagctaggggggagtgggggggggagcttgagcaagcaagagcggcgttaatgcggctatcgatttctgccaccagccagcaggccttagaggtgggggacacatgggcttttgctcctgtcgcttcagcctgtagacctcttccttcttccctatctctgtagttggggctgctgggttgtggccctgggcaaggaagttgggctcaaaaagcaggagccagaagggtgcttggtgttttctgacccttgtctctcagcacacccagggtccctggtctggaaaggtggtctaggctggtctgttggaggtgagatataatcagaatggtccccgtcctattatggccctgacctctgacccccagccatgccctcctgggactgtccgagtggtttccagcatgcttggtttttgtttgtttgtttgtttgtttttcgagacagggtttctctgtgtagccctggctgttctggaactcactttgtagaccaggctgacctcgaactcagaaatccccctgcctctgtctcccgagtactgggattaaaggcgtgcgccaccacacctggcttccttggttcttcttcatccaggtgctctgggtgcagatacttggcagagtgaggccccgcccaccccaccccctgagcgtgtcagttggctacactaaccactttcctggagcagagggtctaacgggtgatgggtttacacctttgtaaatgcagagttggattccatggcctttggtacaggctgagtatccagggcagcctggtgggtgtgatggggttgtccagggacaaagatctgatgtgttcctaacactcaagcccagggcagggcggggtccgccagatgttcagctgccccttgagccaccagctgctcaggggttgggccttgtgctgcgccctctcactcctctccttggggatgctagactgaagcaggcctgcggagaaggctgagaggaaattgctactccactccatctggacctgttagaagggggctggccattcacatgccctgcttaatgcctgcgtttaaaagccccctgtcttgggagagaccccaggcctcagaactatagacgtggccagaagacaggctcttgcttgcctccctctctccctccctccactctccatcccagccctctcgattgtcactgtgacctctgctccacaccccttgtcaggcctgcacccccccttccatctgaagccagagcagggtctgagatgatgactgtggttttcaaaggaagtatgtatggagtgcatgcatgtttcccactcgtgcgggagaagcacttcaggcagagagcccctgcttgctttcttagagggtagatgttccataacatgagggtgctctactccatcagactttgtattaaatgaagcagcctgattcctttacgcacaatctccaaacaagcatccagggactgcagttctgctgttgtctgtatctttactccactccgtagatgggtcagactagaggtcgttaatccacggggttaggtagattctctagatctcctaccccactaagggcagcagccccttgccctcattagttaagtcttcaagatctacacagggcagatttgggctgggaccacgtgacctaaaccttcctgtgcctcagtagccatgtgtctctgagctagtgactcagaataaacattgtcctccctggattaccatgtactgcttggttcctaaggttcttcggggtcttaagtgagatagtacaaatacgttcttcaccaagataggtttggtaatgcctcatcagacgtctggttgttaccatggcaatatgggtgatgatgctgaaggaggagggtttactgaccttgtccccacctttcccaacagagtaaagacatttccacgtggacacctgatcatgtgcctaccctgactgaggctccccaggcatctctattgtgggcagccgtgctacacgctcaactctgagcccccaacagtttgcaggctcccagccccggggtctgggcctcggccccaccatgtcgagcctcggcggtggctcccaggacgccggtggcagtagcagcagcagtaacaccaatagcagcagtggcagtggccaaaaggcaggaggaacagacaaaagtaccgcggtggccgccaccacggcgccgacctccgtggcagacgatgccccaccccctgagcgtcggaacaagagcggtatcatcagtgaacccctcaacaagagcctgcggcgctcccgaccactctctcactactcttcctttggtagcagtggtggcggcggaagcatgatgggggtggagtctgctgacaaggcagcggcagccgcagcctccctattggccaatggtcatgacctggctgcggccatggcagtggacaaaagcaaccctacctcaaagcacaaaagtggtgctgtggccagcctgctgagcaaggcagagagggccacagagctggcagctgagggacagctgacgctgcagcagtttgcacagtccacagagatgctaaagcgcgtggtgcaggaacacctgccactgatgagtgaggccggtgccggcctgcctgacatggaggctgtggccggcgccgaagccctcaatggccagtccgacttcccctatctgggcgctttccccatcaatccaggcctcttcatcatgaccccagctggcgtgttcctggctgagagtgcactgcacatggctggcctggccgagtaccccatgcagggagagctggcttccgccatcagctcaggcaagaagaagcggaaacgctgcggcatgtgtgcgccctgccggcggcgcatcaactgtgagcagtgcagcagttgtaggaaccgaaagactggccatcagatttgcaaattcagaaagtgtgaagaactcaaaaagaagccttccgctgctctggaggtaacagcaccgtagagggaggtgtgcgggctctcccatctctctggcggtccatacctacccctgagtcctggagcccacctttcctgtctgcaagtgtgggggatacccaagcccctagggcctggaggtctggctgcaagatacctgttcactgccctaaaagtcagagccacatcctgagatgccagcaagccatggtttgcaggtaggggcctggcgttcccagtgaggccctgggactctgatgcccctcctagggcctgtgtcaagatattcccacataggtaccaagtttctatctcctagacatgtcctaaagcatctagtctgtaacctaagactggttctgtccctagccctatctgaggggttttgtctatggaccctgtggccttgagaagagtcatgtgttgtttgaacttcccaaacccagccccaccccacccccaccccccactccataagatagagtagtcccagtgctgcctgccctgcctgcaggtaggaagaggcagctcattcataactgtgagcttggtgtacctgcagggatctgtctacccgtgtagcagagcctggctctctgtcccagatggggtgaactagccgagttcaggagcagcttcgcagtttcccatccctgcccactcgtctccactccttgcaaagtggcttgactccataatggttggaaaggcatcctagtcgtggccttttggccacctttctgaccgcagcctgcctctctctcatgtgtcttgcttacctaccagcacaccaaggcacacccactccagggtggacacccatgtgtacacctgccctgtaggcctcctcatcatagacttggctgcttccccgccacatgcacacagcagtgctcacactcacttgccagaacgcagctgtggccccaggtaaacgatggccacctggtgctaggtgcctttgggcatctgagtggctcaggaggcctctgggtgctctgggcctttgggtagcccagctgggtcatggctcctcctttggccaacctggcctggccgagatgaccggaactcttcggggtaactgcccgtgcgttctccatgcccgtccctccgtcattgagccggccacggggagcatcttgcaccaggcccaccgggaccctgactgaactctctccttgtttttgtctcccgccccgccagaaggtgatgcttccgtcgggagccgccttccggtggtttcagtgatttcagtgacggccgggaacccaaagctgccctctccgtgcaatgtcactgcccgcgtggtctccggcaagggattcgggcgaagacaaacggatgcacccgtctttagaaccaaaaatattctctcacagatttcattcctgtttttatatatatatattttttgttgtcgttttaacatctccacgtccctagtataaaaagaaaaagaaaagaaaaaaaattttaactgctttttcagaagaacatcaacaacaagaagagaggtaaagacgaatctataaagtaccgagacttcctgggcaaagaatggacaatcagtctccttcctgtgtcaatgtcaatgtcaatgttgtctgtgcgggagatgctgtttttgtgtagagaatgtaaattttctgtaaccttttgcaatctagttactaataagcactactgtaatttagcacagttttaactccactctcattttaaacttcctttgattctttccaaccatgaaatagtgcatagtttgcctggagaatccactcacgtttataaaggaataggtggtggcaccgtgtagaagcccctctgtatccatccatgtgtgcagaggggccagagcccactgggactgggagttcctgacccaggcccgaccatgttgcaccccatcgtcccctgattgggattccccctaccccaacagtgatggattttggagagatgaaaattctattcatttgttgatccactgagatctggagagcccacatctcagtatttctgatcctggctacttcccttagagaaaataagccctcttttctcagccttgctcgcagcagcagaagaaagggcttctctgcgtggtcccctgctggtaggggtgggtgcccagggggccccctgcccgtggccagctccctgctgaggaacatgctgtttgtattgttttaggagaccaggctgttttgtgaataaaactgaatgcatgtttgtgtcatgataacactcctggcttcttgctcttgggttttggggggctggcttggggctggggctggctagagtctcttgggaaggagaagcctttggacccaggaggtagggtgagagctggaacaggcatcctggaaacagcacggaacccgttgtgtatggaagggttggtgcgtcccagctcctagctctttaacctgaccattgccaggcagactgtgctattggagtgggcctggactacttgggtccttttgcggggcagccatctcccacacacctagccacccacacagttttcccctgggtttctggaatgcagctgtgccctctaatgcctggtcttggatcccttccattccagcctgattttaagaagtgcactgcctgctctgacctccagagggttggttggtaaggggcggtctagaacctcagaagccagccgccatctggggaaatccttacagagcccatggtctaggccagggtgactgtaacagacaggtgtgtggttcggatgctgcttttcacacatcctagaggccaacctgaaggataaggccttgccaaccactagaggagtgctcttccccttcccctcatctgctctgagcctggcagagatggaagctagacttgcagaaggacttcctgacaaggtttcaggtgggtgaaggctttcagaacaaagcaaggtggggcttctggagctgagtgggtggtgaagtgggagagatgggctgtctgctattgttcctggaagagggaggggggagcagggaggagggatcctgaccccaaccctttccctgtgtcacaggctcccttggagcaccaagggctcagcagcctggcctggcacagcaggggtaggcaggggcggggggaggtagctttcaactccatccctgcctgggaaaattccctttcatgtggctgcctgtgatctctccaggcggctctgcaaaaggggggtgtccagcagggagtggggggtgttacagctgggggcaccctcattgcagcacaaggcaaacctgcatctccagaacctcaggagaagggagggcttcagagggagtggggagcctggccagcagggggcactgggctggaggcctttgctggcagcacacagactgcagatggcctaggccagccctctggcacatctccaggggtggggtgggtggctctagtgccagccttaatgggaaggggatgttgtgactcggccgtagcccaccccacagtgcagaaagccaaggtccagagcccctcacttttgagttcctgcctcttgatgtacccaagggcactgtgaggtggacactagccagactgtttctgagggaagcaaagggaacgggttgctgccaagccaagccttgccctgggaagtgatactctccccgtggatggtcaaggagaaaccgccatcatgaaggccaggcttggtgcatcctgagcagtggtcgagggcgactgctactttataactattcaccagcccgaagagatgagtctctgctaagagtacttggtgctctcacaaaggactagagtttgtttcccagcgtgtgaagctcacaaccacctgtaactccagctccggaggatccagcgccctcttctggccacttcattcaccagcacataagcgcacacatacatagaggttaaatatatatttgggccagctctggtggcccaaaccagtaatcccagctgtgaaggctgagacaggagaacagccctgtctgaaacaaaacatcctaataaggtgattacatttccctgatgccagaactttgggaatccaaaaagccttagttttagtgagtgtagaggtatcaggcactggcttaaaaaaaaaaaaagtcttgtgtggtggggtgtgccttgaattccaggactcagaagataaaggaaaatagatctcttgtgagttcaaggccagcctggtctacacagttcctggacacccatggctatgtaggaagacctggtctcaaaacaaaaagattttgaatgtgtgctttcccagttcgacagcccgctcccactttgggaatgtccactgagctttactgtatatttatgtatgttggtgttaggcctgaatgtagtctgcaccacatgggggcccaatacctgtaagagaccaaagagtgtcagatgctctgagaccatagtcacagacagttgaaagtcatcttatggatgttgaaaattgaactctgctcctctagaagagcagtatttgtgactgctgagccaccttccctagccccacactgaatatttctttaaaatagttcaccagacctctcctttctaggtggacctggccttagcattctccctaagactttctctgccatataacccacctatacagtatggtcctgacccttgctaaccagcccattatcctactttttgtctatctggcttaaaggtctcaaactcctgaaacctagtctgtctttacacacctttgagtccccgagttgtgttcagagtctttctcctatccctttatctctgttttagacctctcttctgctgacaaaggatgctcttgggggagtgaggatggttcattccctcccttgtcaggatgggaagtgtagactcctggtgatccctacctacaacaatgtaatggtcagaactagctttgagggtggcaaggtatgagttggaagggctaggcacactcctagagacaagtccaataacactgtgtgtgtgtgtgtgtgtgtgtgtgtgtgtgtgtgtgtgtgtgtgcgcgtgcccacacaagaggagagggagattgagactgatttaaagcctagaaaaatcttatgaggctgtgtccaggaacatgactgtaccattgaatgtgacatgaaagtgggctggagatgatgtggaacacatttaagacgcggtgtgtccatggattcatgtatgaatgatctcattgggatgttccgtgatattgtttgtgttcctgtgaccatgtacagtcctgtagcagacccaggatgataagatggacaactgaatgtaacattggatgattttgagtctgtggtactggatatacattactgttatatcttatgtgaccctgggagagcacttcacaatactaagtgtccatgactcatatacatggccctgcctgagactgacatcagagagagtgtatgacatatgttatgaccatgttgtaaccctgcatgttacctacataatgctgtggatgtgcagtgtacatacatgtgtcggtgtgcccatggggtcccaggggtacagccccattcatgtgtgtttttccacagcatttcctgctccccacctctgacagctgtacaactctagagaaagcacagggctctcgggacatttcattcgccagtgtgggtccagaagcccaggctgcactgggtgctggcatgagggcttgggaggacaggagggaggcttctcccacagctgaaatggccctctcccaaacctttcactgctgccttcagcgccaccaaataccttggcaactctgactcctttgttctgtggccgccaaaggcctcctttttcaaccctagaatgtccagtgcctgcctggcaggtgatccttctcccatgacagccagcttagtatgacctagtccctccccactgaaaccaccaacctccaacacaacacactcacacacacagctctccaagtctgtcccatgctttacattatctacacagggctacagactggccctgaactgtgagtgtggtgtgcaagaaggagaaaccacaacagttccagttcctggggcagtgccgggtgatggtgggtcagcacctgggttctggaagggtacaacttccccttggcacatggccaagttggaagcttagccttcagtccagactggtttccgttctgagttggtcgatgtgtctctggctgaggtaaaccatcagggttgggcttatgacctattttatagatgacggacattgtgtgactcaccacaagcaagatggcggtcagcacccgggcttctgctctcttgggaggaggaccagatgcctccagaagagttggcagggggcctgggagtctggacatatgggttcctccccatgtactggtcatgatgtgtcacagacaccatgctatgcgtattcttgttggatgaccttggttggttgaacaagtaccttttcctctgttccgtattcttagaagaagggcagcagagccaggggttgtagagtagggcacttgacaaggtcacctcacagttagtgccaagacccactgcagggacatgagactggtgaccctggaggtagatttgagcttggaggcccagcctctactcccaggccaacctagctcacactgctacaaagaaggacgtgatatctgcatggcttggttgtatcaaggccatttgggtctgacctgattgcactaccagctctggctcccaggtgccagagatacacagatggaggtcatttgtacagccctccctggccccccaccccaccccaacccccgctgcctgcctgacaggccagagctgtagaatgaacaggcgacagtaaaacatagatctcaactccaccaccctgcagatgggaccaggtacagagacccttgtcccccccacaatcacatagctctggtgtgtcctatctatccctaagggtccacatctgcctgaggtctctgcttttgaggaaggatggaaagtactcctgagactgctggccagggtaccaagcagacatgttttctctgcttgagacctaccaccttccagcagcattaaattacccctctgccagagaacaagagccggcttcagattccaggcagtggggggccacgaagaagaggtagaccaggtcctcccaggcttcaggtctgggtccctggggatttgatttaagggtggtggacactaaccccatctcagatgccaggctctaggatacacacctgtttcctgttccttctgactgatcctaaccctccccagcacaccacacacacacacacacacacacacacacacacacacacacacacacacacagagtctctctctcctaacccccactggctcaggtgtccatgtttcccctgccacagtagtggccactctgggtggcatcacatgctttcacggctgtgatcttgagttcatgaagggcatcgttggcacctagcacatggaagtgtgctaagaaacatctgtggatccagatgtgtggaggagcatacctataattagtactgggaaggtggagacaaggggatcaggagttcaaggacagcctgagcttcgtgtcaaagacactgtctcagaacaaacctgtgagctgaataaaaaccatcttcctttcctgggcacttttttcctgtgtgagtttttatcatagttgaggtactatccataaatgaaaatttatttaaaagagcctccttgggcagagagtgtggctcagtgcctttaaaaacgtgtacaatgcactgggttcagtctccggcttccatagccctcagtaagaaatactgatggtggtgacgagaccctcctgcctcacagggcactgagcttgtgactagggaaccaagcacttggccagctcattacatacatatgcccagaataccatgagaagggcactgatcaaatatccctactttatagataacaaaattagatgcagagaaggagagagagtgaagaggagaaagtcacacagctgatcttttaatcacctggttatgttgtttcagactttgtcaggaaacaaagctgacctcccctgagaggtcactacccactggtttttgtttgtttgagatgtttcactatccccctgcctcagcctctgagtgctgggattacaggcatgtacagtcacagccagcctagaaaactctttaaccaaatgtttacaagttcagaaaggtttagaaagaaaataaaagtactgtataggaaataagagcataaccttcgagcagcaagaggagaaattctggaggcgagaaacaggcatagcctgagcccatacagctctcatccttccccacggcccctcctacacccccaccccccacaataggattgacacgcaagctgctgggggcccagaagaagagtggccgatgttgagggtgagggcaagggcagtgcccgctctgcagccgttgataaggcgacagagccctcgggagcagggacacagtgaagccatggaaacaggggctgaagtgtgaggctggctcagccgcttccccaggtggctgcctcccaggcctggcaggggcccagcaagccaggtccagccacaggctatgtcgcctcctgccctcccaggggtcagcctgggctagtggctggaagtatcactccagcctgttttcctagagtcagacttggatcagttagcctttgggcattgttaaggaagagcaaggacaggcagggtgctccacggaagcctccttccccatttagctatttccagtctgctacccactcctctactataaatatgtgtgcattatttaccttaagcattttgataaatcataatagcagagacatctgctgtcaaaactgcaaactgcatttggggctgagcttgtggactatgatacagaccaggggtgcataggctctgataatatgaaagagatgctttaggtgtcccataccttcctccagggctgggccttgaaggggacctagctccatcttttggggtgactcctcactggctactagtcacaaaaccttcccagggaggctggccatcctagctctccctccccccagctgtgtttttgcttcctgccttcctcggaattgttaatgcagcagcaaggactgctgaggggtccctggagcagagattaactcctggggcagtgcgggtggggttggtcctgggaggctgggggtaggagtgggggggggttgcgatgaatgcagcggagcctaacggccccttctagggtaggactctgccctgaggacctcccagccccatccacactgcatcccagtccatgctcccaagacccacannnnnnnnnnnnnnnnnnnntcacaagattaatcactctgcagctggcctcatcacaagggcacccagctctcaacaccccaccgccaccactgccacgcccccaggagggcctctgtctttctaaggccctacagctccactctaacttggggggggggtgtggatttggggagctgaggccaaattccttttgccttttctggtttcttccgggtggcctcagggactctgaggaccaggcagcaatcctgtggcctctttggttttaatctagctctgcagccctgagaggaggcggccctgaccaggcaatacccttcaaagcagatccagagtgaggcacccccaggccctgttcacatggggatctgatgttagttaggctcctcagcctgccctttccgctcaccctgaatgacctagagatggggagcaggggacatcctgggtagaaacaaggcaagcacctgttggtaacaccttagggtaaagaacctcggccaatcaccccactttaatcttcaacacattgtagcaggtgggactcgggttagaccagaaactaggttgagctgtgtgtgaggatgcatgcctataaacccagtactgcaagtttgcggtcaggttgagctgtagcatagcatgaccctgttgacagagcaacagagacagagagagcactgtccctcaccctcactccgtagagcacaagagatttgagtggataggaagaggcaagaggcaagaacaaggatggcttatctagagatgaacaaaggatccagcttctttttttgtgtgtgggaatgacacttgcatgtgcatgcatgcatgcatatgtgtttatatgaaccagtgcatgtgtgttcacgtggagggtcaaactcaggtgtcattccttaggattttggcatttccagatagaatgatcaggctggccttgaactttgaaatctacccgcctttgcctcccaagtgctgggatcaaaggcatggacccctatgtccagccatactttcataagattgccttaggaactctttgggttgtgagaccatgctaatgggagcccaggcaagggttaatgtcaaggtttaccttgggacagtgggagccagggatggttctcaagcttcagcaatattgtgggataactaaaacactccattctatgttagaaggttaaggtttcagcaagtggcctgtcctcttaggaagaatcccagtgacagaccaaccaggctaattaggaaagctttcagactctttccagagataaaagtaaagaaatatctgtgtcccaagagatcctagcctagaagctgcaggatggacggctgggcctaggatttccatgtgagccctacctcaagctggcttcatgatctcaaacaaaggcctagccagtctgctgcccttcctgtgcccatctctcctcatggtgtggcagactcatctatcagcagtcagtcttggctccaggcatttcctgggcgttcaaggcttgagtaggctttaaatttagagttcttcaaccttcacccatcctcatgtaggctacctttcttctgctgggctatccacacccctttcacctctggccttgaggccagcagtctgtagtgctatcatttgttgtcatgggaaccctacctacacttctgacctagcataggcaaaagcaggcctagagctcatagccaggaaagctgatggtcctggagtggggttcctgttcctaccagcttggctttcttcttgggaagagggtattagaaagatcgatgacctaaagccaggaaaatgggtcagcaggtaagggtgcctgccactaagcctaatagtttgatccctaggacccaaatcctggagggagagaggcaagtctggcaagttccctgacctccacacagatgctgtgtggcatgcacccacaataaataaataaataaataaataaataaataaatgtaatttaaaaaagagagagagagagccaggcagtggtggcatgtgcctttaatcccagtactggggagacagaggcaggttgatccttgtgaattcaaggccagcctggtctatagaacaagttctaggacagccagggctacaaagaaaccctgtctggaaaaaccacaaagggaaaaaaaagaaaaagaaaaagaaaaaagatctgaacggggatggaccacagtggagacagcca

SEQ ID NO: 584 - DNA, 1437 bp, Mus musculus
agtaaagacatttccacgtggacacctgatcatgtgcctaccctgactgaggctccccaggcatctctattgtgggcagccgtgctacacgctcaactctgagcccccaacagtttgcaggctcccagccccggggtctgggcctcggccccaccatgtcgagcctcggcggtggctcccaggacgccggtggcagtagcagcagcagtaacaccaatagcagcagtggcagtggccaaaaggcaggaggaacagacaaaagtaccgcggtggccgccaccacggcgccgacctccgtggcagacgatgccccaccccctgagcgtcggaacaagagcggtatcatcagtgaacccctcaacaagagcctgcggcgctcccgaccactctctcactactcttcctttggtagcagtggtggcggcggaagcatgatgggggtggagtctgctgacaaggcagcggcagccgcagcctccctattggccaatggtcatgacctggctgcggccatggcagtggacaaaagcaaccctacctcaaagcacaaaagtggtgctgtggccagcctgctgagcaaggcagagagggccacagagctggcagctgagggacagctgacgctgcagcagtttgcacagtccacagagatgctaaagcgcgtggtgcaggaacacctgccactgatgagtgaggccggtgccggcctgcctgacatggaggctgtggccggcgccgaagccctcaatggccagtccgacttcccctatctgggcgctttccccatcaatccaggcctcttcatcatgaccccagctggcgtgttcctggctgagagtgcactgcacatggctggcctggccgagtaccccatgcagggagagctggcttccgccatcagctcaggcaagaagaagcggaaacgctgcggcatgtgtgcgccctgccggcggcgcatcaactgtgagcagtgcagcagttgtaggaaccgaaagactggccatcagatttgcaaattcagaaagtgtgaagaactcaaaaagaagccttccgctgctctggaggtaacagcaccgtagaaggtgatgcttccgtcgggagccgccttccggtggtttcagtgatttcagtgacggccgggaacccaaagctgccctctccgtgcaatgtcactgcccgcgtggtctccggcaagggattcgggcgaagacaaacggatgcacccgtctttagaaccaaaaatattctctcacagatttcattcctgtttttatatatatatattttttgttgtcgttttaacatctccacgtccctagtataaaaagaaaaagaaaagaaaaaaaattttaactgctttttcagaagaacatcaacaacaagaagagaggtaaagacgaatctataaagtaccgagacttcctgggcaaagaatgg

SEQ ID NO: 585 - protein, 342 aa, Mus musculus
GSPGISIVGSRATRSTLSPQQFAGSQPRGLGLGPTMSSLGGGSQDAGGSSSSSNTNSSSGSGQKAGGTDKSTAVAATTAPTSVADDAPPPERRNKSGIISEPLNKSLRRSRPLSHYSSFGSSGGGGSMMGVESADKAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEVTAP

SEQ ID NO: 586 - DNA, 22017 bp, Homo sapiens
  misc_feature (1)...(22017): n = A,T,C or G
agactccaggcccccagggtctctagagtggccctggccatcccctctcttcctcctccagctgtggactgctgtgactgcccccaggagaggagctagatggaggcttagcagtggctgggcccccaccccccaggaaactcaaaaccctgggccagccgcgggtggcgggttggggcaggcacaaagagggcctctgtgcggccggctgggctgcccacaggattctgggggaggaggccggagccggtttccgtcccgttctgcttcctgcggaggctgcggaatgcccggagctctggcccagcctgccccgtctggcccacccgcagccccttccccatcttttccagggccttggggtacagctgcagacttctctgcaacagggccctgagagccaccctccaggacccaagggaaacctaggggatttccccaagccgagagctgaactggacctcaccctttagctgaagtcttccttccctccatgtgctgtggaaccctcagccagggttggagcaccaggccctggagtcacacagacctgggtttaaatcctggctctgccacttactgaccttgtgaccttaggcaggtggctttatgtccctgagcctcagttgcctcatctgtaaaatgaggataataataattgtagtagaatccggtgagaaaatgcatgtgaaatgcttagcacagtgcctggtggacagtgagtgtgcattattaggacctgctgtttatttttttttatttatttgtttgtttgtttatttattgttttgagatggagttttgctcttgttgcccaggctggagtgcaatggcgtgatcttggctcactgcaacctctgcctcccaggttcaggcaattctcctgcctcagcctcccgagtagctgggattacaggcatgcaccaccacgctcggctaatttttgtattattagtaaagacagggtttctccatgttggtcaggctgttctcgaactcccgacctcaggtgatccacctgcctcggcttcccaaagtgctgggattacaggcgtgagcctgtacaggccagggcctgctgtttattttaatgtcctctggggaacttaagagtggaagggactggatgctccttgccacgataggtctcacctcttctacggttcagtctcagccctgcgtcctgctcaaaacccttctctcaaatcagtttcctatctgcagatcatatcagtgactgatctcggcctctggggccttcctcctgaggtctggagggtggaggggatcgctgtctggaatcctttttttcccctctgtatctctacctccttccccatgatatgccctgggatcgtgacttctgcagtagtttggggtgagaagcaagagccattcctttccattttacaaatgggaaactgaggcttagtggcggaaagagcttggtcaaagtcaccagtcagggagggacagggtggagccacaaacctaggcctcaggcctccagttccctagccagtcctaggcacatatgcctcccccaaccccagacacacaaacacaccccacacaggagccccagaaggacagtgcgccatctctgatttcttgactcgtgcatccctggactagccttccctggcttgtcccatggtgaggcccatcagtagggaggtcctgagggggtacgtgggcctgatttctgattggtgtcagctcagagatcaccacattgggaaatgtttactacaagattcaggggatcccagatagacaaggcgtcattacacctgcttaagcaaattgcctgctctaaatggggcaataataggacttccttcagagattgggtatgaggataacatgagataaagcatggacagtgtggcacataggaagagccccatacttgttagctatggtcccaggtgacagatgggaaaactgtctcagaggccagttttttcccaaggtcaaaaaatggggaagggtcttcctgaacctttgactcttccaggaaaggaacctggcctgagggaggtgcctattgaggaaagggcctgtctttatcagaggcatcccaggcatctcagtccctagagccccaggtcagagcttactccctgcccggggcctcagtgttgctgtgcatgaatgggctgatcccctcctccagctgttttggggagcaccgtaaaacagaacagagcctggctgggtgcggtggctcacgcctgtaaccccagcactttgggaggctgaggtgggtggatcacctgaggtcaggagttcaagaccagcctgaccaacatggtgaaactccatctctactaaaaatacaaaaattagccaggtgtggtggtgtgcgcctgtaatcccagccactctggaggctgaggcaggagaattgcttgaacctgggaggcggaggttgtggtgagctgagatcgggccacgcactccagcctgggtgacagagcaagactcttgtcaaaaaaaaaaaaaagagagagagagagaaaacagagctctacatactccaggtttgctcaaaccctttagtcctcaggccaaggcatggttggcacccaccccagcaggaggggtgtaagagggtcaggggtgtggagtcggggatatagaaatgctgtcccttgttctgtccttggcagtcagtcttggggtgactctagtggggttgaggccatgtctcaccccaggccaccctctgggtgctcgcagtggccagtgtgtgggggtatgtgtgtccatccatagctggatgtgtgccctgtgctctccgcctggggctgcgtttctccctgcctccaagaccggtctccctgggcttgagcagggcttctttttccctctggaaactccccaggctgaatcatggaaatcagagacgggacaccctcccttccaccccattgcccagcttggttcaaccaccatagcctgtggtctgctttgcccaccatcagcctgtctgcgtattttgcctcacttggaggcaggccaaggagaccggcccaccaaggtgggggggaggagacaagggccgggatgtcaagtgctgcatggaagcgtggaaagtggcgcattgagccagggtgtgcagctctgctgggccagtgttgggggtcctgaaacgcagcctcttccacgagcctccctgggcaggcagaatggctgcaaggctggtcagccagcaaggaatggcggggatggtgccttggtcaaaccctgcccttggtagtggtgatggttgcacaactttgttgatttactaaaaatcattaaattatatgtatactttaatgtggcagaattttatagtatgtaaactatacctcgataaaactgttttttaaaaatcctgccagccaggcgcagtggctcacgcctataatcccagcattttgggaggcccaggtgagaggattgcttgatcctcataggaagacctcatccctactaaaaattaaaataataataataataaaaattctgcccttggcctcaaggccctgcacaactgggaccctgacagcctcatagacacacctcacgtctacttccccacctgcttaggctctctttcatgcctttgtcccctctcattgcttctccttatccttaactctcaaactagcagtcccttcctccaggaaggcctcagatagctcattgtgtccccttccggctcttgtttcacgctggttcatgtgactgtgggcccagctcctgtgcactcctggaaggcagtgctggggtctgggtctgtgtgctctgctgtctctccggtatcataaggtacagggctgctgtcgaggtaggtgcagggaagatgtgtgcaaaggaatatctagaacatccagctgtgggccacctgtgtacatgtctgtgtgcagatggcactatgtcatcccaggatgtcccctccttcccagtgctttctggcccgagagttcaagattgaaccctgcggggggtgaagtgaggctcttctagggctgagggttgaataagggcactgccaccacctccagtgacctcactgccagctggcattgtgatgtcactggcttagcattccaggccctgggcatctccaagtgccccaggtgggggcactctcctggggtctgtgacagcttgcccccaaccacggagaggtgacaggcacggtaacaatcctggggagtgagagcagccttaggggtacctaggtcacctgccttgggccactctgtcaattgcaaaagtggccacagaacagggtgactaacacttgggctctgggttcaagctctacccctgctaggcaccagctgtttgacctgaggctgacagcttgaacctctctgagcctaaatttcctcatgtctgaaattggcaaatagtttctgtctcccggggttctggggaggcattcagaagctaagacatgtaaagcataaaagcacagggcctgggacacagtagatactcagtaaatgctggttgataggatccgttggttaaggaaaccagagtggcaacacaggtggtgggggctggctagaagggggcaggctccgtgccttctggggctggccagagccttagggtagaggcacggggtggcctccactgccaggaaggtggccccaggtatgagtctccctccttccagctcagccagttagctggagcctacaggaggcattgggccctgcagccatgctctggggccaagaaccccattaccccccacctcctcctcggtactccccagtcctcctccccagcctcctccccacctcctcccaagtcctcctcccctgtctgctccccacctccccccaagccctcctccccacctcctccacagtccttcttgccaccctcctccccacctcctccacagtccttcttgccaccctcctccccagcctcctccccaggatcctccccataagccctcttcnnnnnnnnnnnnnnnnnnnnaaaaaggtggtggggggtggctaaaagggggacggtttggtgcttcttggggttggaggaacattaggtaacagcacggggggggcattacatgccaggaaggtgacaaaggatatgagttcccctttttcagggttagcagttaggaggagcttaaaggaggaaatggggcaatgaagcatggctttggggcaaggactcatttacccccaacttcttcttggtatttacacgtcatattcacaggcttatgcactacttcttccaaagtcttcttcacatgtatctaaccatctccccccaaagccctcatcacaacctcctcaacagtacttattgcaaacctcttccccacatcctccacagtccttcttgcaaccttcttcacaacattcttccccagcctcctccccccaagccctcctccccacctcctccccagtccttctccccaccctcctccccagccctcctccccagactcctccccaccctcctccccaggcctcctccgcagattcctccccatctcctctccagcctcctccccacctcctccccagcctcctccccacctccccccaagccctcctccccaggctcctccccatctcctcctcagtccttctccccagtgtcctccccaccctcgtccccagccctcctccccagactcctccccatctcctccccacctcctcttctcaggccttgggctacacagtgggtctgatctggtctcctcgccacttctcctctacccttccctctgcctccctctcctgtgggcatgcccagctgccttctgggattccctccttagggctgtttccttgtcttttagaccctcaagtccctgagcctggacaaggtgtcctgggtccctgggtctctgaaccctgttaccccagacactgcttcccatgacactgtctccactaaccttgaccctctgccccttcctctccagctccccttttctctgatcctcccctctagttctctgtctcatgattctgtccccaccacctgtctctattctgcccccgcatgcccctctgccccccagctttccatgactcgtcccccctcagccccccgtgctctgtccccgcccgtcagcccctggtcccagctcccggctggccggctcctgcatggacaaaggggtcctttgtgggctgaccgcggctggcggggcggcggggcgctggctccgcattgctgatgaaacggagccctttgttgtccctcctcaggcgcagtatttctttttgggggctggatgtgttcctggcagggccgatgatggatgcgcccgccgccgcccgcctgcccgccagctttccctcccgctcattcccgctccgcttcaacgcagccctgactcctcccctgctgcctgggcactgccaggcccttcctggcctggaaggggatggctgtgtgccctagagtagaagactgggacctgggagaacgtcccctctatgtcctcctcttccatgagtagggcaaatggggcttttggtcaggggtccactgggaccaggacatcagtttttcctaaggtctgaaggagaagatgagccaggtaccagggccgatttggaacaagcttgaggaccagatgttcatgtctgtctactctggatttgaaaacagagttgtccctgtgagccagtccctccgtgtacccacctcccttcaacttctgtggctgaaaaaccatagtgttctgcctgcagcacctgtttgttgacatatcacatcctctggtcccaagctcagcatgtcccaggacctcagaggctgggggtgggtgggccctgaagaaggatagaatagtggaagatcagagaaattccaagagaggaacagaacatgaggtttggtccccaccaggagagactcaggacggagacaaaagccgagacactcagccagagcgccagccctgagcgcaggccggctgtgttggagggagctgacttctaattgacctgcccgccccgcacgcagagccagatcctggagctgggaggagggagggggtgagcagagcaggagcagcgttaatgcagctatcgatttctgccaccagccagcaggccgcagaggcgggggacgcacacaggggctggggcgcagcctgctcccctccccatctctgcagcccacaagacacctgccttctgccttctcccctcacccagtatctgggctgccggggttgtcgtccagggcagggcagatgagcttagttgggcaggagctggatgagctgacttgacggtttttgtccctgatctcactgaccctggtccccaacaactagccagggtcactgattcctgaaagggtcaccagtctctgaggagaggggctgaaaagaccatcctggtcttggccgttatgaggtgggagggaacacagctatccttggacacacatggtcttcttgcttcagctctgacctctgatgccccccaacccagcctggattccctgccagggccccccggctctgtcctggtggaatctgccatcttgcccagctcttcctcctcacccatttccctctgctaggaaggagccctaggtggtctggtgcccactggggagggacagggagtatctgactgttgatggcggctactcgcctcaccctagagacagagcttttcctttccccacacccggtcctctttggccactccttagtcctggggaagccccccctcccccccgcttggggcctcagtttccccctctgtaaatgcagagggttggactagatgctctcttgggacaggcttgagtcctgtgactaggggggttttggggttgcctggggacaaagatccagtgtgtgctgccctcaagcccagggcgtgatggggcccgccagatgtgcgcctcccccttgagcctccagctgctctggggctgggccctgtcctcccacccctctcctggggcatgctaggccacagcaggcagacagggaagcaaggctggagagccgggactgatgaggaaaccgccgccttgctccatctggcccagtcccttcagctgaggaggcagctcagacgccttagccttgaaacctgagtagagcaggccctgccccgggatgggctgccttggaaatatggaggtggccagaggacaggctcctgctgggctccattcccttgagggtcacgcctactcctcagtgccagcctgccccagccagaggtccctcctggcaacagcccaccccggctctctgggttctcactgagacctccacccaggccctactctgcaggccttgtgaggcctctgcccaccaccgcccccaatctgggagccaggccagagcaccacagtgaggcctgagtagagacaagaatgaggtctgagacgataatgattgtggttcgggggttgagaaggaagcgtgtgccagggtgtgcacaagcatgtcctctcactgtggcaggggacggctggtcctctggccctgtgctgctcgccctgtagcaggcggggagaagatccctgaaataagggttctgcactcattggcaaactgggttacacaaaggcaaccaggttcctttgcctgcaggacatgtcagagccttgaaataactgatgtgtattagtaatccccagatgaggatccaggggcagccttccagacttaatgatctgtaccatcaagcactcttctcctcagatggagaaggaagattaggatgtggaggtggtttttttcttatttttatttttttgacaggatctcactctgtcatccaggctggaatgcagtggcatgattataactcactgcatcctcaacctcctgggctcaagcagtcctcccacctcagcctcctgagtagctaggactacaggcatgtaccaccacacctggttaacttttgtattttttgcagagatagagtttcaccatgttgtccagggtggtctcaaaactcctgagctcaagcgatctgcctgcctctgcttcccaaagtgctgagattacaggtgtgagccactgcacccagctaataagcatctccagcactctcccaccccagcacaagaaggactgcctgcttctggcaggtcttcctagaccctagcagagcagatttgggctgtggaggcctggactagggcctccaccatgccgcttggtggctgtgtgttcatagactggtagttctcctaaatcttgtttccctcatctataaagtagattaccagccactgcttctagagttcttgtgggtcttaactgagatagtacaaataagaaatttctcaccaggatggatctggtgcttaataaatgcctggtcaagcacatggtggtcaggatgacaggaccgttgatagtggcggtggtggcgatgttgaagggggaggtgttcactgctgccctgaccctgtatcctcttgtgacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggaggtaacggcgccttagagggaggtgtgtgggctcttgtgtctgtctggcagtccaaacccacccccatcccctgaccccacttttcctacctgggcaagtgtctgggggatgccccccccagtccttggggcctgggggtctggcttcaagacaccagtttactgccccaaaagtcagagccacattctgagaatcctatcaggccataatttgcaaggcaagcataaaactccaggcaaggacctagcattctcagccaggccctgggattctgattcctctcctgggttctgggtcaggtattgagatttccatacaggtcctaagtttctgatgctcagacatggcctaaagcatccagtccatgacctagaactctgggtctctcccctgccctgtttaagggattctgtttcacgggccctgtgcccttaagcccttcatttgcccctccagggccatctttcccccaaggccacccaaggatagagctgttccagtgctgggtgccctgctctgaggcctggaaggacccttggtctgggcacctagttgacagatttttggggctggggtaaggggaggtgaccatgagcccggagtggacaagaacctagccactgtaggattggcttggagaaggcaaggggttcccatgctgctatctctgcacccctgtggcagggcccgtccctgtgcccccagatgcagcaacctagctggagtgccaggcctgggtacaaaagcatcttttcagcctgcagtccctgcccttgtccccgcccctctatgagtgggcttgacgcaaatgtccagaatggttggaaaacaacagtggtatatcccagccatggcctcctggttaccctcccccaaccccagccccagccccagccccagccccagccccagcccttccatttctgctctcctatgtacacacaaaggcacccactttagtccagtgtagacacacatgcacacacacatagacacggccgcttgagaaatagctcaaatacccacctcccacagctccataccacacagctcagcatagcacgaggcacacacccatatgcacacccgtcgcacgtgctcacacgctcatttacagaaacatgccacagccacctggcgctgttgcctttgggccaggggaagggacttcttctctggaaggagggttcctgggcacagtggctcaggaggcctcagagtcctcggggccttccagcagcccagcaggtcaagcgcctcctttggcctggctggggtggcaggagctccgaggggtggctgctcttcctccatgcctgtccctccgccatgaggccatccatgggggaacgtctttgctccaggcctacccggaccctgactgaactctctccttgtttttgtctcccgcccccgccagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaagcaccgctggcttcttgctctccggttttggggggctgacttgggggccgttcctgagcagggattgtctgggaccacctggaggaggaagaaggatggcccagggacatttagaatgggaatttcttggggaagagaggcctctggatccagaatgggggagagcaggagcaaccagcccagcagacaggagggaaaggctcttaatctggaagtcactgcctggttgcaccccatgcctcagaacctggacctccaggaaccttcactcacttggggccacctctgttcactcacctaagttcatcagggcctgatgagtaaagcaaccagcaccacgaggcaggtgggggtaaggctgagctgcctgttcagggtcttctttctttctttcttacctggcagggatctagtgctcccgcagccaccaatgtcattctccagggaatagtttcagctcggcttcgtggggacctggctgtacacacacgcctattcctctttaggcctgagggctgctaggctgagttacgggggtgtccttggctttgactgtccccactctcagagggtttgttggtacaaggctgctggggacctcagaggtcaaatgtctggggaagtcaccacacagccacatggtctgggccagggcagcctgaacaggaaggggtggcagtggcatgcccctccctgtacatcacagaggccaacctgaaggaggaggcttagccatccactgggggagcgttcttctcacccagctgctttgagcctggctgagatggaggctagacttgaggaaggacttcctgacagtgttgggcactggcttcaggtgggtgagagctggagcgatttctgaggctgagtgggcagtgaggtgggggagatgggctatctctgccattgtcctgagaggagaaagcagccatgttgggtgggggtggcgctgacccccaaccccttcccaggtgtcacaagctcccttcgagcgccagggcctcagcagcctggcctggcacagcgggggcaggcaggggcggtgggaggcagctttcaacttcagctctgcctgggaaaaattccctttcatgtggctgcctgtgatctctccaggcggctctgccgaaggggggtgtccagcagggagtagggggaggtgttgcagctggggggcaccctcacccccagcacaaggcaaacagcggcacctccagaacctcgaggagggtggggagggtcctcctgtggggagtggggggagcctggccagcagggggcaccgggcaggaggccccttcctgcctccgcccgctgctggcagcacacaggctgcagatggcctcagccggccctcgttggcatacctacaggtgtggggtggacggctctgttgccagcccagagggggtgctgtgactcagccggcctgtacctttcagtgtgccaacccacagcccagcgtgtctcctgagcccactccccagcacacggccgaaactcagagctcctcacctgttccagcttcacactgctttgtggaaatggtaagccagcccctctgtttggaggccaggggtggggacagctgtgaggctggctgaaaacatgctgaggactcagttacctcatctgggaaacgggacaataattgtttcccccataaagttgcctgaggatgaaatgcgatcacacttgggaagggcctgacttgcaagctctgtcaatggcagctggtgttgctatttttaaactattattcacctaaatctcaccaagatgtccctcaccttctgcctggctgtgtgtcctccctgaagccctggccacccccacctcccacctcccacttcccacctccgtagagtgacccagcctctggcccttcccctacctggatgcagcccgaccccagcctgcaccagctttctgtctctctggctcactctctgcatgtcctgaaggtctctttcggtccctgacgctcctgtgtctttgggtctccatctttcctgatctctaagcctctccgtgtctctgggtctctgcccctcctgtctctccatctctgtatcttgtactctgtctgttgcaggctcacccctgctgttccccagctgacggagacttccttagaggcaggctccctggcagggttgtgtacccagctcccctcccctcaggtgccctcacctctcctctgctacagttgggaaactgacttcctggtgacccaggagcctttcctccaggtaccctgtaccctgacctgggtgatctggcatttagagccagctctagacacagaacggtgggggtttgagaggctgggtgcacacactgggctggagagaagtccagcctccaggtagcccctgcgtggacgtgtgtgtgtgtgtgtgtgtgtgtgtgtgtgtgtgtgtgatgctttaagggcctgacaattgtgtgaggctttgtgcagtaatgtggctatgtgtgacatcgggtgtgatatgcaaatgggtttgtgacagtgtattggagactgagatgtgaatgggttagtgtatgtcagtggccacactttggaatgttctgtgacattgcgtgtgtactcttgtgacattgtacagttctgtaacagacccagtgtgataccggcttgtacaactgaatgtgtgactttgggtgattctgtgtgagtgtgtgacattgagtgattctatgtgagtgtgtcactttgggtttacaacacacgtggcattgcgtgaccctgtggcaaaactgggtggttcaataagtgtgtgactttgtgtctgtgtggccatcatggatgtgggctgggactgaccagggattgtgtgtgtgtgatgtctccgtgtgactatagtgtgaccctgtgatgctgcctgcataaccctgggtgtgtggtcatggctttgtgtcagtgtgcacctgtgatcctctcagtgttgctgacactattgccttgtgtgtctgcctccagcacttcctgggtctccgccctgaaagcctctctagggagagagtgggggatctgacagcccctctcacctgcagcctgtgccctcgcatggccctgaggcccagtctggatgggggagctggcgtgggggcagcaggcgcagttcccacggccgctgcggcccctctcccagccccatcaccaccggcttcaactccacagaatatcctggcaaccccggcctctttgttctctgaggccgccaaaggcctcccccaaccccagcctgcccagcgcctgccaggcgccccctcccccgacagcagccagtcttggcctgacctagtctctagctgcctttatcccccacccagactgaggcgcctgtcccatgccctggacctgactcaggactccagacgaggcctttgaccctctgctctgagcttgctgtggttgcgctgtgcaggaagaaggaagaaggataggtcctgtggctgtactgggtgattgtgggccaggagctgggctgtctatacgagtacttccccttggcccaaggctggttggaggcccagggttggtttcagtttgtccagtaagtttacttctttggcccccaaaagtcatcaggacagaaattattacccattttattggtaagaaactgaagcctagagagggtatgtgacttcccctatagcaagagcaagatggtagcagggacctgattagaacccaggctcctggctaccttgagagaaaaatcaggtacctccaaaagaatggaaagggggcctgggagtctggacacatgggtccctgcttatttcttggtcaccatgtgtcaaagccgtgtgtgtgtgtatgtgtgtgtccttgctagatgaccttggccaggtgcccttacctctctgtgttccaagaaagaaggacaacatagccaggggttgtggggtggtgagcttgacagggtgctttgcagagccaaaggtcacctcacagttagtagtgccaagacccacgccatctccaacaggcacagattctggctcggggccccagccaccattcccaggctcagcccagctttgtactgccacaaaaaaggaggcagcgatggctacatggctcggctgtagtcaaggccacttgggtctgacttgattgcagcacaggctcccaccgcctcccaggtgccagagatggatggatggaggtcactgcacagcctggccccaagcccccccccgcccacccgcagccctgggctgaccagccactgctgaagacagtcagccagggttaggggagggacaggcagccaccagcatggtaataacccagaccttggccctaacatcctgcaggcatggcacagagaggcccagctgtcccctagggtcacacagccctgcagggagtcctgtccccagaggcccacatctcccttgagggctgttcctgccatgcaggagtagagaatggctggagagggtggtggaggtgcaggagggtcccctgaggctgccggccaggctgccagtgcagacactttcatctctttctgcctgtcgacctgccatctctcagtggcattaaattcccctcctgccggagaacaagggctgcctcagattccaagcagcagggtgtgaagatagggcgggcccagaggaggtgagcggggtcctccagggctccaggcctgggtgcaaagcggctggactctcggggcacagctgaggggtccaggtggccgcctaccgcagcctcccagtgcttcgtcagatgctgcttcgtttcctgttgccatctcccacctgtatgatgccttcctcccgccttcggagctttcttgtcccttgcaagctgggtcaagtgtcccttgccccccgccccccacccccagcccatcacaacactggtcattcttggtgacatcacctggcctcagggctatggtctgcagctcagtaagggcagcgctggcacccaacacatggaaggggtaggaaacatctgtgggctgaggaaacacattctctcctctttctggacattatttttctctcacgcatttccagcctaactggggagctgtccacaggtaagggaaacttactacaaagagcctcctttctccagtccctggagcctccataccccttggctagagaccttaaacaagatccttctgcttcaaggcatagagcctgtggcctgtgcaccagggactgggccattccattgcactgacacactcacagcaacctatgaggggggctttaggcggttctctccatttgacagataagaaagttaaggctcagagaggtagcgagacatacaaggtcacacaaccaggttcgtctgctttcggaagctagcccttaagcacctggccatgctgcaggctttggctggaaggaccccctcccccatcccacaagctgcctgtgatcgtgcccagatgtgggattagggttgagtattacttacttccttaaacttgtctgcacttctttttgttttttgtttttttttttttacctttgctattcaaattggaataccgaatttattaatacatttatttaagttatttaaccaaatgttctcaagcccagaaaggtctggaaacaaagggcacagtatggagcgaggataggggattagggggtaacctaggatcaccgccccctcccctgcaatgacagggcgtgggtatttcgggggcccgaagtgggtacagcctgaatccacaaaggctcctgcccaccgctccccctggtgtcttcccaccaggctcccagcccctcttccagctttgaggcctgcccgggaggggcaccccctgtggctgttttggctctgcagcagtgggtccacaggcagctgctgggagtcttggggagcggctgcaagggtgagggcgagcagtggccgctgccgttgataaggcgacggaagcctcaggagcgaggacgcagtgaagccatggaaacacggctgaggtgtgaggctggctcagccgcttcccccaggtggccacctcccaggcctggcggggccccgcgagacaggtcctgccactggctgcctcgctccctgccctcctgggggccaggtctgggctgctgactgggctagcttggtgtcacccagccatctccccagggccaggctgggggtcaaccctgggtctgagtagggagggctgaggacagtggcaggggccttctgagttctcaggccccaaagcccccttagcctggtcaatccctccccttctaccacctactcctttcctataaatatgtgtgcattatttaccttaagcattttgataaatcataatagcagagacatctgctgtcaaaactgcaaactgcatttggggctcagctggtgaacgatgagggctagaggccagggatataagggctctgatggcctgggggaaaaaatagggatgaccccacccctcatccagggctgggccttgaaggggacccaggccccatcctttgggacccctcctcaccagccacttaatcacaaaaccctcccaaggaagctatccaccacgccccaactgtgttccctccttcctgcctccctctgcctcagaattaatgcagcagtgacagcggctgagaagtcccccagagcggagattaactcccagggcagcgcgggcggggttggccatgggaggcttgggggtggggggtctgacgcacaggcctggcaagattaatcaccctgcagccggcctcatcacgagggcgcccagagctccgggcccccacctcgaggaggggtgctgggtcgaatgtcaggagtctgctctgcctcccgcagccctcatggcccccagtccaactcgtgggaggattctgggagctgagtttccttctcttccattttgctggccctcagggaccctaaggaccgagcagcaatcccgtggtctcattccctcccccagtttctggcctggctcagcagccctgcaatgggggaggctctgacccttgcctccctgcctacttcttgctgtccccactggccccgctcccatggctccccgagactgccagttccctaacatagagctagaggtggggggcactgaaagaggtccctggacctgctgtatttatttgggggactcaaagagatgtgtgatggatccgatggctctgggcctgctatccagccagccctcttgaactgtcctggggggcttgtggagatggtggagagagatacagagtgagtgggcagatacagatgaggctactgggtgataaagcactggggtcagtacctgggtactggcctttgtcagccagtcactcacttagaaagtctttgaggggttgcagcaagtggaattgagcttagacatgagaataaggttccccaggcaggtgggacctaagagaggctgagctgttttgcacagaagacttctaaggtcagagttggccttgactctgtaagtaagagctggagtaccctcttctacgcacccactgccctaagtgctcccatcacaatcctgctggggtcacactgggtgaactcacctgttcacttgctgatcttctgaactagaaggagcactcctggagggaggggcttgtctgcctggcaaatgccaaatgctcaataatgttgaatcaatggatgaattggaggaggacatgggttggcctgttgtatatgaggggctggggaaagaattgttaggtctgagcttggggagcccagctgcagggccacaggctggcgagtgccaagaggaggccccaagaagttccaagagaaaaggggttctggagccaggcacccagtggacattcacaggctatgtgacctacaaaggctttcctttctgggcctcagtttactcatcagcaagtaacattgcttttcagatatcctatgaaggtggaatgagaaatcctgtgtgaggtccctgtgagctctctagccttgtaccccttggtaggcaagagatttgaatgcatgggaagagccaagaaggcttcttggaggaggtgagtgaagctgagcctcgaagtaccatgctgcctatctaggaggcttggagactggtacttctggggcagtgaggagaccacactggagagagcccagggaacgatgggccaatctcaaaatccaaggcaaatgggtatattttgtcttggggacagtgggagccaatgatggttctggaacctttggcctttaggctttggaggggctaacatgtatctggagtgaagcctttagtcaatctgggtatgtggggcaacttcccaaccccactctggggccctgagactgaggtaggaagtcagctggaggctgattcctgacatatctccttccagaggaaccaaaacatatcccatgttaaaaagtggagggctgggccgggcacggtggctcatgcatgtatcccagcactttgggaggccaaggtgggcagatcacctgatgtcaagagttcttgaccagccggccaacatgatgaaaccccatctctactgaaaatacaaaacttagccaggcgtgctagtgcacgcctgtaatcccagctactcaggagtctgaggcaagagaatctcttgaacccaggagatggaggttgcagtgagccgagatcatgccactgcactccagcctgggcgacagagcaagactctgtctcaaaaataaagtgaggggctaggcttgatcacaagtaatctgttagtgtgggggccttgaatactcattacaggatggggaatccaagtcacagaatggccaggccggtcagagagcttcgggacccacacccttcctggaggtggggataaggggacatctggcctcatgcctagcctagaagcagcagagtcctgggctgggaggcagggggataggatttccatccaagccctacccatagctggattcatgatcacatgaccaaaggcatagccagcccttcctgagcctagctttcccaattagtgcaatggaccttcc

SEQ ID NO: 587 - DNA, 597 bp, Homo sapiens
atggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtga

SEQ ID NO: 588 - protein, 198 aa, Homo sapiens
MAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 589 - DNA, 25386 bp, Mus musculus
aattaaaacaaaataaataaaatatgaccttaaggagcaaaaagagatgcagtagagacgcagtataggagcggggaggaaactggacacagaacagtcctgagaactatagggctctccagctctgctctgttctgacttacttacatgtcatctctccagttctcctgaggccacgggggtgtggcgggggagtcaacttctcatctacatctgtgctttcccccttcattttaattaattagcttgatggtgaggggcgtgtgaatgtcatgatcagaagacacgggtcctaggggtcaattgaaggttgttaggattggaagcaagtgccgttacttgcctgcccaatggttataactgatcgatccctcaagcattttttttttctctcttttggtctgtctgtggaaaagtccatttagccatccacttggcacactcgtaaagtgatcactgggaatcttttaaagggcccaagttcaaaagtgctgaagcaatgaacttcctgatttttagaaaagtcgcctcagggtggcttggttggcactggggtgtccaacccttccctgattcatccgtacggaaagcgctgctcataggtctgctgggcagctctggccttcccccatttaagtggcctccaagccaaagggtgtggcttcagtggaagtagcactagatacaaactcccagaggtagggtggggtggacataccaatacaaataaagtaaaattccctagacatgcattggcatattaggaaaataccatttttccagggcttgtttggtcttgagaatcccccaataagcctactaaaacgaagatacataggtgtctatctaatgagttcgaattttcaaggttaaactgaaaatctatagtttttagactttcaagccaggttgttttcatgtacagacctgatgtgtgagcatagtattgaggggtattcattattttggttaccaggcacttatccaacaagcctttttttttttttttttaattttggcttgggaggaggggctaaaaagactatcatagcaattatcaagtcaggctttggggactagagctgtatactgctcagtggcacagctctcttgcctactgtaatcaagctcctgggctccttagcactgccaaaacaaagcaccaacaaactcccaggctttctggcaagaaacctgggtctgacctgcctggaaacgactgtaggattttgagcaagttattcagcctctcagaacctctttttctttaactgagaagtggagacgatactgtatcttcctcactgaggattgagtcatgcatatagaacttagtccagtgcctataaacaacaacaacagcaacaaaagtgctctgtaaataggggctgctgatatttccacacacacacacaagtccaaccgtgtgcatcctcagatgtaaacatggttaagaagacctcatgagagagggagattaggaaagatggttcagaaatctacacatgtatgaaagtacagccacaggatccagtgacctgtttctgcctagacccagaagacacatctgtggctgcttatattaaacaaaaggaagaacatgttcatcaaagcctgtctctactgaacagcaggaaccaaagcagacgggacgctgacatctgggactttcctgggtgccatcatgggtttgaagtaaaaattgcatggactgggcctgctgctgaacacctgtaatcctagcatctgtggaggtagatgcagaatcaggagttcaaaaccatcctcagctacataacaagttctgggtcacaactgggctacatgagccgaacaaaaccaaacaaccacaaaaagcaggatgttccccccatataaggacaaatacctgccctaacgagtcagacttactacagactgactaggacactgtcttagtgtttcccaagccctataattagccaagtctgaatgggggcaccggctctattgtttatctacagtgtggccttgggaacttgttcgaacttgtgtttctcagttttaactataagatgatcacattgatagttctttctttaaagaacactgttaaggattttgttgttttattgctgttgtttatctttttctcttttcaagataggattttctgtgtagttctggctgtcttggaacttactctgtacatcagactgacctcaaactcagagttctgcctgcctctgcctcctgagtgcttagattaaagatgtgagccgtcacagtccagttatactgttaaggctttaaaagcaaatatcatacaattaactttatttattagctatcttttacattttaatttttttgtaatgttatccaggctggtgttggatttttgggtcactgtacctggctttgttatccctttaaccgggacagattataaaatccccttgaaaaacacgggccttcgccttcttttttcttgtttctgccacactgccataatcactgcccccagagtaaggaaggaacagtctgcccatgcaattatccacatcctgttcctctcaactgtgcccctgtttccccgggtccctgctctgtgtgtgtgtgtgcgcgcgcgcgtgtgcacacatacacacactctttctgtttgcacaggtgtccatgcattctcccaaaccttcctcagaggtttgtctgattgatgtccataactgcatggggaaacggagcattttctgcaggtggacagggcagacaaaggcattgagggtggacagggagaaaggaaggaaggaaggaaggaggtgaggagccggaataggagagagggtggaaatgtgtcatgaggttcctcaaaatctgcaagttatgaatctcattgtcagtgaatgacctctggtgattcacttccttttattagctgctcctccatcggtgtcatgaagggggatgctttcattttccttaagtaaatgaccacatacagaatctagtttgagagagccatgaaaacatacatcatataggctacagatgttatcctgattttcttcagaacaagactgcctagcagttcagctcatagctgaacacatttccctaagtaagactgacttcttgacagttttcagccaacccagcagtttctcatttcctctttgagccttttctctagagtacgtccttagtttcctcttttttttttttaagttctattttttttaaagatttatttatttattatatgtaagtacactgtagctgtcttcagacacaccagaagagggagtcagatctcgttagggatggttgtgagccaccatgtggttgctgggatttgaactcaggaccttcggaagagcagttgggtgctcttacctgctgagccatctctccagcccccttagttcctcttaagcatccgttgccactaagttatgctgacctgagtagtgagtagttgtaggacaggagactggagagtcttttcctggagagagatgcagattccaggaggtttggaaagttataactagggcgctggagagatggctccgcagttatgagcattgggtgttcttccagagaagccaggttcaattcccagcacccacatggcagctcacaactgtctgtaactcctgttccagggaatctgacatccttacacagagatatatgcagtcaagatactaatgtacataaaataaaaataaaatttaaaaattttattagatttattcattttattttatgtgtgagaatttcattcaaatgtatgtatgtgcatatgtatgtatgtgcatatgtatgtatgtgcatatgtatgtatgtgcatatgcatgtatgtatgtgcatagtgttcctggtgttcctggaggtcagaagagggctttggatctcttggcagtggaactatggctagttgtgaactaccacacggatgctggaaaattgaagccaggttctcttcaagagcaacaagtgttcttaactactgaaccaccactctggccccccagtattcgtgtagggtaatacatttctgccttactgtgtttgaattagggacaaaagaaatttggccaaggctcaagaatttcatgcagaagtctgagataattggtttgagtataactacaaatcagatcagagtcatgaaataacaaggacgtttagggagtcatagaccgaacataaacgagccaagttgacctgtgcgtttctgtgttattgacgacatcatgtaacctcagggttcagcccttgagtgctttgctttccatgagtaagggcacaaatatgtggcttccctccaccccgtccacaggccattagggacccactagctccaccacctcccctatcatgttgcaggcccagacacagtcagcttcaccttgaccactaagcacacagtaggacaggggagggggccttagactcaaggatgtaagatgatcaattccatggtctgtttcccaaactgctggagtctgtttgccaatatgttaggaaggaggtttaaaaagagtttcatactgcaaagagtcacagataagggggggggggtgagtgggagtcaggagtgcgggggcgagcaacacatgcagctgtctttcccagctgcccagttggtaggaactgtgggccaaggacacagcatccccacttaactggaatcctgcagcatattccagcatgacctggttttttggaccaaaatggacaagcaaaggagggaagcactttagataggaattgcagtttacaaaatccatctttctgtttttagcacctggaactataccggcacatagtagtcctttcactacttaatgtatatagctaatgaatgaatgaatgaatgaatgaacacttttcccacataggcatgacttcatccaatctccaaaatgggaccagggctgtttcattttgcagatgggagaaccaaagtcaaaagagttaagtgccttgtttaaagtcattctactacaataccatactgaatgttcttagtatagcaacccaagaatatatcccatgactcaacacgaaattccttttggacccagctagtcagaaaatagcctttaaaggataggcatgatagcacaggcttgtaatcctagcacttaggaagtgcagactacagtgagtttaaggtcagcctgggctacataagaccctatcttaaaaactcaaagcaatggttagctgctttgggcatggtagcacatgcctttaactggatctctgaatccaaggccagcctggtctatgtaaagagttccaggacatcaagggctacataaagagacccccatttcaaacaaaacagccagccagacaaaaaactcagaacaaacaaacaagaaactaaaccaaaacaaaagctttcggggctcatttccctggataaagaagccaggctaggtttaggcactgctcagtgtgcatctgcactcctgtatcctctacccttttataaacagagccgacaaaagagcccctccactagtctatgtcagcacacctgactcaggaggtctgctctcctgagatacaaaagccacttggagtcaggaaaataatgaaatcatatgcatttgctttcttatttatcactctcaacagaaacttcagccagtttagaccacaagggaagttcctggaattcaggcaagccagtaacatgcacagcgtgggcatcctaagaaaaaagaagaagaaaaaaatgtgtttctggaaggaagtctccagaatagatagaaagacttgaggcaaacactgggctggaatattttataccacctgcctgagtatcttagttaacgggcctctctctttacagcattctgctgctttatggagactgtgggacccagagcccaggagagagtacctagatgcaagtgccgccatgggcacacatgaaccatgttttccttgcaggctgtggaatgagaatataattccagtctacatcatagggcagctctgaactggaagagaaattgaagatgtatctgaaaatgtctttaagacgtatctataagatagaaataacagacaaaaaggatataagcctatactagagagagagagagagagagagagagagagagagagagagagagagagagagagaacaatcaaacttacctgccttggacttcccacataatcaccttttacaatctaagctaatgcagagcgtgaccttaagctatgtactcttctcatgcccaaactccgataacacatatcaatcatttgttgaaaacagcaaatagaagttaagtaacttcctaaaagctaccataaaggttgagcgaaactatttatggatattgattgataagcaataatatttgttatctggtatttggagtcagttggaagcagagacttaattccttgttgaactctgttaaagattttgccaagtatccattccttccccgtgtggtgctttctgtactgttaaatacgtacatagtaaagacatacaaacaccattcacacatagagacatatacaacacacatagacagaacagacagacaccactcatacacacagctcacacaacagacagacacacatagggatagacacagggacaaacaagttcacaagaccgccttcagacaggcacaaatgcagattcatgcaacaacagatggtcataagacatagtgatcatgaagtagagaattcaaatttagacttgctcgtggttagaagactgcaaagggaagaagtgcttttatatctttatgtcttttatatttatatatttccttaatgcaacacctattcattataggtaacttggagttagtcactaatgtgtataacacacacacacacacacacacacacacacaaagagagagagagcttcaaagctccctgttacttttctctgttctgcattcactgattcactcacaattaagcacctctgtggttaagacatgtagcaaatgatgagggaggggcagatatctaagacctgttctttgcctccaaagagttgaaagtctaacacagactgcaccaaaaatagagatttcagagagtctaaagactaaccaggagaaaggcagttctgtgatgagttggaggcacgaggattgttcatccaggtgaagaagtggcggtagaaggaggaagagggctatcacactgcatagcggtctctggccaggaggaaatgaggtcatcttgctctcaaagaatcagcatgacagcctccagccaagtaatccggagtcatgagagctgttgggggggccatgtgaatcacgacagcctgctgggaatttcctaataactaaactagagtttcggggtaaatcctcaggctgtaacacctctgtttacattttgatcacgtttgtttacaattagtggcttcttaaacataaacataactggccacagtcttctaaaggaagtagcaagttgcctctgagatctatggaatctctgattcagtggtcctgtgggttgctagcagctcagctgcgcaaggaaaacgtattctgaagaacgatggtcacctgcctacccaaagctgggtattcaatgtgtactttcctatccagaggttggcattctgggccactggctggggtaaagtcaagcagcctcctccttcctacctcctggcattcttttccaaggtccaggttgacagtaaaatgttgtaggctcaggcttatggaaataaagcaaagctggggcactaatgaatggtgcgggctcaggcacctcttctgtggaaggagcatcaaaatgaccactggtccttggctctgaggcacatgttgcagtgactgacccttggaatcttttctgagcactccctactttgcctgaggggtgtgtgcatgtgtgcatgtgtgcatgtgtgcaagtgtgtgcatgagggagggtgctttgtcttcaagatgttcagggctcatttatacatgacctgtctttatataagcctattttattagataaattattagataaataattgttttcgtcttaacgtgatgatgtaaaatgctgaacacaagtgcatttacagtgtggaattggcaacagaagagatggctaggctcacacccaaaaataaaatgtgtaattatttttttagaatggctgatacgaggacgtgtttaaagtttttaaaacagtgtgaaatagtattcagtgaaaaataaacattccttttatcttttccttcagacccacagcctctctactacaagggaagagcagacacccccactgttgttgcatgttgatagcccacactaacgaggtttgagtattccttgctttttttttctatcctgttacaatgtactgttcatgttactgttcacatcactgactgctcttccagaggtcctgagttcaattcccagcagccacatggtggctcatgaccatctacaatgggatctggtactcttttctggtgtgtctgaagagaggactgtgcactcgcatacataaaataaataaatctttaaaaaaaagacacccccccttgattgcttatttgtgtctgtgtgcaaccacaataccagtgaggtatgcactcagtcctgatctatgatcctctgtattggttgtattcttttccagacaaataaatggattgttcattataggcatttttcaaaagacccattgacacttccatagcagctgctgtgccaagactttgctcccacaatcctaacatagtaaccattactgcttttttaaaaatcataattatttttgaggatttcactatgtaaattagtctgggcttgaactcgcagagatccacctgcctcttcctccctagtgtttagataaaagacgtgcaccattaagtctggcccttgccataaattttaaaattgtctttcaaagattgaccttaaaccaaacagcaaatctgaataaaatctgaccttgcctttcaccttctgatgacagtattacactccctgacgacaaacttcactcttgtcttctgattcactgcttgcattagtggcatttggagaactcagcatttgacatgtgggagcctttgttagtaggtattttttgttgtaaaggaactgcgacttatacccctctatcagacatctgaatcagtgtcgtaggcaggtagggggacaggttggagaagaactgattaaaccactaaggaagaggcttgagatcagcgagccaatggctggagcgccctcaccacgctacactggggccgcactaggtgaatgaaagaaaggaagaatgttcaagccgccggatcatcgctcgatccagacagactgcgttaagtttgctcagctggaaattccgtgacttcgtcaaagttgggaagcaagcgcggtccagttgcggtgggatgcaggaaaaggaaaaggagagagagagagagagagagagagagagagagagagagagagagagagagagagagagagagagagagagagccgccctccagcaaacctgggcggggccagggctctggcgggccctaataaagggcgagcagcgccgagcagagcctgtagccccagagctctgtctgtcatccatccagtccttgcgtgtctgccagcgcccttccgctgcagtcaccggtgagtgctgttggtctgaagcaagcctagcgggatgaggcagccagggctcccgcatgcctcccttcccactaccttggctggcggaactgtgggcaaggtcaccactccagcccttcgcgcccctctacagagaggttccatggtgttgtgcggattcagagcccgcagaggggagagactgcccggcttggggaggttggtcactgatggcttgccccgcaggacacctggagtggcttcccttggtctgtagtaactctgccaccttcaagctgctccgcttcttgtcctgacttctccttcctttgcagaactgctgtctagagcccagcggcactaccatgaaagtctggctggcgagcctgttcctctgcgccttggtggtgaaaaactctgaagtgagtggtctcgctgctttagcaccatcaggaaggggcttgcaggatcccttaagcagcatcaggggaaaaatgggggctgcacggggaacttaggcatcaaaggcaggtccaggctttcccaggaaataggacaatgtatcagcggagggcttgtgcacccaaagaggtttgcactatctggcaagggaggaagaagccacggggagtgccttagcccaagggcacctggtttgtgtgaagtttgcttgagtcagtccatgtctgggtgctggctagtaataaacagaaaggggagagacagacaggggtggggtgggagaaagagagagagagagagagagagagagagagagagagagagagagagagagagagagagagagaatattatgagtgaatgaatatcactggaagggattttgaggtggggacctgtttatcctgaacatgaattccctagagcatgtcaccttcatctcttgcagggtggcagtgtacttggagctcctgatgaatgtgagtatctgcttccttgcacaatagttggctgcacagagacccttgaaaaaccttaggagacataccctccctgtccctgctgaaaggctggctccccacttgatccttgcttacccctcctttgcatttgctagcaaactgtggctgtcagaacggaggtgtatgcgtgtcctacaagtacttctccagaattcgccgatgcagctgcccaaggaaattccagggggagcactgtgagataggtatggggatttggacttggaatgtgggagtgggggaggaccagagatcttagaacagggacagatgggtgggatgcagaagcaggcagaagctggccttggaggtgtgggtctgttaccccagcacttaggaggagactgaagcctggcctccatagtaagtccttgtctcaaaaggcgggcgaggcgcagctagagagacagcttagtgattaagaacactggctgctcttctagacatcctatagtttgagtttcagcacccatagaggtgggttacagccatctgtacccccagtcccagagaatctgatgccctcttctgacctcttccagcccaagtgacatacatggtgtacagatatacatggaggaaaaacactcatacacataaaataagcaaacaaacaaacaaaacaggcagcagaagttgggagtcacacacacacacacacacacacacacacacacacacacacactcatgaagtagtggctatacaagtgtgaaaaaaaagggtgaatctccctcatatcacctgacaggtctgaaaccgtgtcacctctgaaatgcctgtccaaaccgcctcccttttctaatactctgcactcctcaaatcatttctagatgcatcaaaaacctgctatcatggaaatggtgactcttaccgaggaaaggccaacactgataccaaaggtcggccctgcctggcctggaatgcgcctgctgtccttcagaaaccctacaatgcccacagacctgatgctattagcctaggcctggggaaacacaattactgcaggtaggtggtgactgagtaccaagaatccttcccaagggggatagggaggtggctcagcagttaagagcacagactgcctttccagagcacctagtttgattcccagcatctacagggcagctcgtgacagtctttaacacctgttctagaggatccgataccctcttctggcctcactgggcaggcatgcactgtcatgaatataggaaaacacttatacacattaaaaacaacaacatcccttcccccatcgtggcctcttagaaacctttgttatcaccatggtatacctgggatgggaatcctggcacaagaatccaggtctctggctgagcctttgttggaagggagaatacagagaagacattcgggcttggcatgacattccctatctctttgtgttaccaggaaccctgacaaccagaagcgaccctggtgctatgtgcagattggcctaaggcagtttgtccaagaatgcatggtgcatgactgctctcttagtgagtgtcgctgactgcttatgacaacggggtgggaagagacaaactctattgtcactgcaggagggatgagaagtgaggtgtgcctcagagacttcttcatcattgctgtctcccccaaacatgtgtctctttcttttctaggcaaaaagccttcttcgtctgtagaccaacaaggcttccagtgtggccagaaggctctaaggccccgctttaagattgttgggggagaattcactgaggtggagaaccagccctggttcgcagccatctaccagaagaacaagggaggaagtcctccctcctttaaatgtggtgggagtctcatcagtccttgctgggtggccagtgccgcacactgcttcatgtacgtccatccctttgtcccttctctctgactcttccacccaaccccaagactgtccttcctccttccctatggacggttacaatgtcattctcctgctaaccctctaaccatgcagcttgtggtcttgggtacaagtaatactttgaggcctctggggtggagtggagagagtgaccggactttgtgagaccaggctgacatgtttcatttctcacagtcaactcccaaagaaggaaaactacgttgtctacctgggtcagtcgaaggagagctcctataatcctggagagatgaagtttgaggtggagcagctcatcttgcacgaatactacagggaagacagcctggcctaccataatgatattggtgagcagaaagcttagttaccagaaaggctaaagtagtggtgggaaatgtggggggacttgaagcccgggatttatataacgagatggatgaggaagagtgcagaatgagatacatgagaagctgaggggtgtagggatcctctgtggagaccttgaatttcccaaaaagatagattcttctaagtagaaacaatcttacaggcatacggcttaggctgagaatgccctgtttgtacaaagtaggatggatgcttcttctctgtataccagaatatagaatgtataaagcaaagccttggctggatttcagctcagctccctcagcaggaaacaacctgttcagctgtatatggtggattttgttgcctgaacatctgtcatctgatgaaataaagcatttggagaatgtggcaggggaggcttcagggtaacaagataccagcagaccttttggatctctgtgactcccatgccacgagtatagatcaatgctcagcattggtaggggagagatgatgaccatctgacacagtgataacctttcccctttgacctttcccttccccacccagccttgctgaagatacgtaccagcacgggccaatgtgcacagccatccaggtccatacagaccatctgcctgcccccaaggtttactgatgctccgtttggttcagactgtgagatcactggctttggaaaagagtctgaaagtaagtgacagatgaagctcactgagagagtctgggggagtgttacggtccagagtaaagagcagactatcaaaggaagactgtggaaacaggactggaaacattatggagggccagggatagagtagggggagatgggcaagcaagtcaaacagggtgtgaacaattgtgagtgaagtaaaagactcagattggagaaacaagaacaagagcttttcatagctgggatatgttttttatcttcacccctgcagagagtctcatttatagacacatcttaatgcaaacatctgtttcttccatctaggtgactatctctatccaaagaacctgaaaatgtccgtcgtaaagcttgtttctcatgaacagtgtatgcagccccactactatggctctgaaattaattataaaatgctgtgtgctgcggacccagagtggaaaacagattcctgcaaggtaagactctcaagcacccctctttatcacccccaactccccagagctcttggatttgatctaacaaccctggggagtctctttccagccaacaatctaagaatcaaggacttaggtctttgggagcttgtcccaatacttataggttcaaacgttgggcatgagtccctgtgctatatgcgttttagactaaaagggaccaagactgctaaaaaaaaataacccagacatggtagagcatacctataacctagcactcttagcattttgaaagctgagacaggaggatcatgagtttaaggccagcccaaactacagagtgagaattcaaggcctgtgccacatagcaagatcctttctcaaataaaacaaggaaagcacaaaccataaaaaccaagacaatagcaacaaagggatgggtgcctagctcagtggtttagtgcttgcttactatgctcaaagtcctgagttcaagtctcaactcagggactggagatcataagaaaaactaagagtctggggacgtggcttagttggtagagtacttacccagcatgaaagaagccctggatccagtcctcggcactgtatgtaatgacccaggcctgcagtatcagcccttgagggagtcagaatcagtttataagttcttcagttacagagtgagttcaaagccagcctgaaagacatgggcttatgagactctgtcccaatctgaaagaacacaaccaaccaaccaaccaccaccaccaacagcaaaatatagatactattcaaatcacttctgggcctttggctaagacaagtgaaatcaacataattctattgttcaggatcgcagtgaattaccaaagatcaggtaggaaaggaaggagaagtcttaaagagactatgaactggtaaataaagagacggaaggaaaaaggaagcatgtgtcagttggaaaaaacaaaactaagactgagcatgctgtgtgccaaggcgaggaatagcagggtctgggaaagcactggagagtgggagaggaaagctaagactttttactcttgattcggtagaaaatggggagttgcgaatgtctctgactctgggagcctctccccgttctctcccgtggctgggtagtggcccttccctcagttcttccagggcttcacctctttatctttggcttcccagggcgattctggaggaccgcttatctgtaacatcgaaggccgcccaactctgagtgggattgtgagctggggccgaggatgtgcagagaaaaacaagcccggtgtctacacgagggtctcacacttcctggactggattcaatcccacattggagaagagaaaggtctggccttctgatggccctcaggtagctgagggaagaaacagatgggtcacttgttcccatgctgaccgtcctctctgcaacagagtcgtcaaatggagggaagaagctgaaaagacaggttttgcattgatcctctgctgtgctgcccaccagggtgagcgccaatagcattaccctcagacacaggcctgggtgctggccatccagaccctcccgaccaggatggaaagttggtcctgactcaggatgctatagaccaggagttgcctttttatggactaaagccatctgcagtttagaaaacatctcctgggcaagtgtaggaggagagctgtttcccttaatgggtcattcatgagatctgctgttgggaaataaatgatttcccaattaggaagtgcaacagctgaggtattgtgagggtgcttgtccaatatgagaacggtagcttgaggagtagagacactaacggcttgagggaacagctctagcatcccatgaatggatcaggaaatgttatatttgtgtgtatgtttgttcactctgcacaggctgtgagtataagcctgagcaaaagctggtgtatttctgtatctaactgcaagtctaggtatttccctaactccagactgtgatgcggggccatttggtcttccatgtgatgctccacgtgaatgtatcattcccgggcgtgacccgtgactagcactaaatgtcggtttcactttttatatagatgtccacttcttggccaggtatcctttttttttttttttttttttttttttttttttttttactaattagcctagttcatccaatcctcactgggtggggtaaggaccacttctacatacttaatatttaataattatgttctgctatttttatttatatctatttttataattctgagtaaaggtgatcaataaatgtgatttttctgaagattctggtttctccatgattcttgtgtgacagggaagagggggacattaaaaggaagaaaataatgagggctacgtgcatcttagtttcatttggggtttgcttggatttttttttggatgagaatgcatggatgaggctgctgatccaagccaggcacggtcctagtccacctgaaggctaaatgaagattggtgcaaattcaaggtcagcctggacgatgtggttatttcaaggccagctaggctacatagcaagacattgtcttaaaaaaaatacacaaagaaagaaaagaaaaaaatctgattcaaacaaagcagccgagtcggtgctgtcgacggggtcaggtaatgaagtacttgtgtttgcagctcttggtcccccgctgaaactacttgtaacgcttctggcctctgtaggcaccaacacccatgcacacacacagatgattacaaataagtcttacagaagaaaacatgaaaaaaatcagtgtctcacacctgtcatcccagcaagtgagaggctgaggcaagaagactcctgtgagtttgaagccaattttgctacaaagctttagtcttaaaacagacaaaataaaacaaaaagtggggtggtagtggtatgcctttaatctcagcagaggcagaggttcgaggcctgacttgtctacagagtgagttcaggacagccaggagctacacatagaaaccttgtctcaaaataacaataaaataataataacaacaaaaccaataaaactaaaccattgtgaatctgggattccagaaagcaaacatacttttccatcatctgtgtgtaggctgatgctaaatttccgctgtgctaatggagcttatctgcacttaatgtggccttgggaaggtacagaaggagagttccagggtcggccttcatagcacctaagttacaaaacaggccacagacctgcggcttggtaagcggtgttcgggttgagctgcagctcacaggtgcttcctcagcctggtgctattgggcagagtacctcgtttattattaattaattaattaattaattttctagagggggactcactatatagccccagatgtcttggaactcaatatgtagactaggctatccctgcctcctgagaccagaaattcaaggcagtgtgtttcttttatagctgtatacaactttttttttttgattaattttggtactgagaacagaatcctatattttaggctacattcacctttttcttttattttttaattttgagataaggtcttactaaattacaaggcagcccttcaactcactccgtagctcaggcagactttaaatttgtgattcttctgctccagtctcctgaatagtagcgctgagacccaggcctgttatactagaccccactcatagtgagtttcttgaggcttagctgtaccacattctctttgctcttctccccacaaatccttgggctgacctcagtcaagaacattgcagcagtgaaaaccgctgatccccaacaccaccctacatatgtgacatccaggggacacaaaatataatttctgcatgtctggcttgtactgcattctcttgggtattgatgtcactcattgctatctgtaagagcaaggaactcaaaattaaaggtggatgatatcctaatggggtaaccacataatttgaatcaaacatcaggttctaaagaactgaggcatacacagaaggcaggccggaagatataattagatgctaaaatattggaatttccaagtcacgtttatgagttttggcagtgtttcttaacagtcacctgagaaactttaaaaattatctacacacctacgccccacctgttagattatgattcaggtcagggctaaatgctaatgcttgtgactctagggaaaggctcactgggtgtttttgacatgcaccactgactgagaacctcaggcggcagcgcaatcagtcagaatccgtgaagggcccagaaaattcaagacctgatgatcatcatgagttctctgcatgaacagccagttttctgagtggagtttgagcatacggagtctcctggggtttctgtgaatccctgagcttctatcccatgacctagcactttttcccccacacagtgcagctgtgtttcagtatgggttttgcaatcaggtggcctgaactagatagaaccctggcttttaacattagctatgtggcttggaaaagagcattagcctcggtgcgtcctgcccatgtttcctccaccataaagagagagaggctgcgagaaagctctcagggtttaatagaatcccttcctgtctcccaccccagaattgtacgagtgtttgtgggagcagagatttcctgggaaagaaaggacatgattagaatttagggacccagccctggctgagctgctagtcagcttcatttcttccctaggggccaaggaagatcttgttcaaacttgagtagctccagcagcatcaggactcccagacactgcaaacaggaagtaagagccccactggccggttgagcaatgaggctgctaacagtctgcagattctttctcagagccacctctaccctcagctgtctcaccctgaagctctaactacctccccaacaactgttttagggctctcgatcctgatttaatcctttccctcattctgcgaagaacgtacggaactatttgtagccctattttacagtattaaaagcagaggcacagagaccctgccgatcctgcggggagcaaatataactgcaagtgcagagtcaggctcgaactcccggcaggcagctggctccagagtctgtgagccaaatgtaaggagagcacacccagtcaccggctaaaagaacaacttcaccctgataaagcaacctcagccatttttgccgaaatctagtttcaccgaggtggtttccgttttcaccagaatccttccttttgaaatcttccgtggccaattcaatgatcagaactcaacttgatttccatacagccgtgtctttcccaagccagcaccctacagcagccacacccctgcacactcattcccattgagtgcactttccttcctagcaggaaacatctgagctctcccttcaacagacatggcgtgaagctgctgaggagtgtttgagtgactagctctgctgagatgcagttcacaccctctacaattcatccatttaaagcacacaacttggtggttcttagcatatttacagagttgggcaacataacaaccaatttagtgcattttcatcacttcacagagaaaacccgaaccaatgagtcaactgctttcttttcccttcctaggtccacagccctaggtagcctcttacctactttctgtccctgtgggtttgccaatcccggccacttcacagaactatagaaaacacagccttgcctctttctgtgagcaccatgctatcaagtttcacccatcctgtagcatgtgtcagtgttgcttagttttaaacaacgaattggaagagaagatggtttagggtcctttgtgatcttgcagtcacactgagatccagcagatatctctttcctcccttcttccctccctccttccttcttttcttctcttctcctccttccttcttctccaccaggttccgttcctttttgagacatagtctggctatgtggttgaggctgactaggaactcacattgtagcttaggtcggctttcaattcgggatccttctgctcctgcctcccaagtactgggtctttcattcatatatatatatatacttttattgtacacatgtgaaatacatgtgtgaatcttttgcctacatgcatgtaagtgttcctaacatgtgcatgatgtatccatggagcctggaagagagtgtcagctctgaaacggaaacagatggctgtgagctgtttggaaaccaaacctgggtcccttgcaaaagtgtctcctaagtgggggctacctacctttccagtgtattctcttcctcctgcccctcctcctccttgcacatgcatgcttgtgcttgtcacagaattcatggggagtcataagacaactcatgacagtcagttctcttctctcccaatgtggataccagggactgaactcaagtcttggcaagaaggccctttacccactgagccattctgctggcttttaatttttattaactcagagttcctattcggttgtaaaaagaactatacaagtaaaataatctcatagtagtcagtcattgttagcatctctggcttgggaggggggttccttttcatttaaccatctctacttgattttgaatatttggctccccaaagccaggtattaaactatcctttcttgtttctaacctaaactttctctaaagacatcttactcatgctcaggctaaaatcaccaccaacagatgactcacagtccttgccagacttccaaaaggcagtccctcgttttctgttgtctacttggcaccctggttgatcggcatacagagccacctcaaatccagcttttgttgttttcagttccaatggagacttcttccattggtctctggcacaacagtccacataaagaagaaaataaagccacacaattatgcaagccagaaatcttgccgtcagctctcttctcctatctcctaatcttatctattacaaaatcctagggattggcccaatagctcttgaagtcttccattcctttgttttgaacagggtcttatgtagtctaggctagtcctgaattcactgtacagctgaacagtctcctgtttctgcctcccaagggctggaattacaggcatgtgccaccatgcctggcttctctccatctgcaccccaccattagctgaggccaagctgctctcagtcagctctagtctgctggatggcacagcctcccatgctcttccctccactgctcactaaaacagcagaagaacctgaatgtgaattctcctaatgactgcttttgctcttcccagctccctacttctgactcagtacctgcccttcttcctaaccccctctttcttcctccactgctgtcttagtatcaacccccagctaccatggttcttgcgttcgatgcttcctctttctgggacattcttcgtgatattccgaggtttctattcatacttccaagattattagttttcctctccccctttttgggggggggggcagagttcaagacagggtttctctgtgtagccctggctattctggaactaaatctgtagaccaggctagcctcaaactcacagagatccacctgcctctgtttcttgagtgctgggattaaaggtgtgcaccaccactatcctacatccaagattaatttttctaggctacttgtacctacacaaaaccctctttcattgtgtccatagttttactgagccatgtccccctctctaatgcactagtcactgttttaatgttttagttgctatatcatcagctgattaatgtgtgtgcttttctcccatcaaattatacttcatgaggtcaagtacactgaatatggcagacagctaatatctattgaataaatgcattctgatgtagatgatactttaaaaaataattgtatccattttctacacataattttctatcctttttcttagttattttatcactagctttttcctttagcataagaaatctctctatgccaggcttagtggcacacacttctagttccagtacttggaaggcagaagcaggcagtatatgtgagcttcagggcagcctggtctacatagtgagtctcaagacagccagggctatgtagagagaccttgtctcaaaacacaaaacaaaacgaacaaaaaagaaagatttgtccaagccgcgtacacacagcatagttgattataacactcattcaattccactgatttgtggagatatagcagcctttctgaggcatcctaggtaaagcacgtgacagttctttgtaaatatctatgtatgagacagtatcatttgcatttcaaaggaaatgggcttctttcctttctcaggccatcccctccccgcctttctccttgctttccccctcccccacctttctccttgctttcccccccaccccacctttctccttgctttccccccaccccacctttctcctgctttttttttgtgtgcccttactctgctactctgcttgatgacccggtaagtctaaaataactcagtaactttaatatcttactatccaaggatccatctctcttcttgtgtgtgtgttgctgaaaaaaagttccgacacgatggcacacacacctataacctcagcattcctgaggcaaagccaagaagaaaatcaagagttctaggccatcctggactccaccaagactctagctaaaaccaaaacaacctcttctcaaaactacataaaattctgctaaaaggcgggcatcctcagcccagtaatggtgtgggctgtgcttctttctggtgttaccccgcctctgcctttctacttgctttcctctctcttgtttttgtttgtgtttcttgtgcccttgttctgcttgatgatccgggaaggcttaaaaactcattaactttaaagtcttactaatgcaagtacctctctctctctctctctctctcttttcgtgtgtgtgtgtgtgtgtgtgtgtgtgtgtgtgttgctgaaaaaataaaaagccaggcatgatggtttgggatcttaaagggaactcaaaattttttgattcattgatttctcttttacctactcactcaacatttatggaattggtcaagggctgggcactgctgtatactgggtagagcaatgaacaaccttgctgagctaaaagtcaagcaagagaacagacaaaccaataaatggaagacgttgagcacctcagcatgaggaagacatgcaagatgggcacggagggctgagagaacagattggaggacgtcacctggaatggagcactgagggacaaacacagggaggagaaatggcattctgaactgatggagcattgtgtacaaaggtgaagaagggagcatagaagatccagggactgcagcccagggggctaggacatggtccagcactgcacaggaggtttggttgaagggatgagctattaggatcgtgagggcctagaggactctgctacatgaagggatttatggcagggagtccatctaagagcttgaagcagtctgattgttgggcctagatgagtctatgggcaggcaaaaccagtttggggactatttcaattagcctcaagggaactgctaaggaggtgaatcatccctgtggggtatgaggggaggctggtacagtacagataaaggagatttgtggagatatagcagacttgatactgactcagagtgggaggaggggctctagcttttcgtttagaatccttactttagacaaataaagacattatattattttacaggtgagatatttaggctccactgtaggtggactcctggaagtcatatctaagtaggtggttggtccaagaagagttatgactggtggagttgggaggaccagtctctcaggaaagctgacatggttaatgacctctacctgcccacctaattggagaacttctccaacaccatgatcacaaagccttgctgctacctaagcttgcatagcctatgcttgtctctaaaatatctggggtcatttcagccttgtgactatggctctgactctaggagttcttcaaagcctcctgtcatgagattcactgtcaggaaattagtggatgagattctggtatgtatactgagatcaacagatgttggctctagttgccttgtgatttcctaaaactgagacgttaagagtgtttcagcggatcacatgcacttattagataagcagattctagcaagcaggttgcagaaatgcagctttgaggagaactgtagctagtgtcttctcatcccatcctccaaatccttcctttctgtggtctcccagttgcccaaacttttcacatatcagcaggctcatctatctatctatctatctatctatctatctatctatctatctatctatctatctaccttcattcttctctcatatgttacattccaaccatgtttttccctcctccttttttcctcctagacccccaccctcatcctccaatccatttctcctctgttacccttcagaaaagggcagatctcccagggatatcaaccaaatatgacttatcaagttgcaataagactaggtgcctccctcatattaaggctggacaaggcagtccagtatgaggaaaagggtcccaaaagccagcaaaagagtcagagacagtactggttcccacttttaggagtctcaaaagatgaccaagctacaagaccataacatatatgcaaaggagctagcccagacccatacaggctccctgattgttggttcagtctctgtgggcccctgtgaaactaggttagttgattctgtggcttttcttctgtgtccttgacctctctggctcctgcaatctttccttccctcctctgcaggactccctgagctctgcctaatgcttggctgtggtactctacatatgatcccattagttgctggatgaagtctccctggtttctttgatgacaattctgctaggatctggtcccagcacattctgcaggtaggacaaaatgtaggttgcaggctttgtggctgggttgtgtcccagtctctctgcttgtggtcttgccaggttgcagaagatggctagtttagggtctgtatcccacgttactaggaacctttgctagggttactctcagagattccatggaatccatgtactaggttcccacctgcccccaaatccagtcatttctcccagttattttcttcctctctcccctccatcttgttcctcctgttcccaacttcacatgcccccagtccaccttcaaaatttattctgtttccccttccctgggagatctttgcatcccccctcaatccctccttgttacttagcctctctg

SEQ ID NO: 590 - DNA, 1302 bp, Mus musculus
atgaaagtctggctggcgagcctgttcctctgcgccttggtggtgaaaaactctgaaggtggcagtgtacttggagctcctgatgaatcaaactgtggctgtcagaacggaggtgtatgcgtgtcctacaagtacttctccagaattcgccgatgcagctgcccaaggaaattccagggggagcactgtgagatagatgcatcaaaaacctgctatcatggaaatggtgactcttaccgaggaaaggccaacactgataccaaaggtcggccctgcctggcctggaatgcgcctgctgtccttcagaaaccctacaatgcccacagacctgatgctattagcctaggcctggggaaacacaattactgcaggaaccctgacaaccagaagcgaccctggtgctatgtgcagattggcctaaggcagtttgtccaagaatgcatggtgcatgactgctctcttagcaaaaagccttcttcgtctgtagaccaacaaggcttccagtgtggccagaaggctctaaggccccgctttaagattgttgggggagaattcactgaggtggagaaccagccctggttcgcagccatctaccagaagaacaagggaggaagtcctccctcctttaaatgtggtgggagtctcatcagtccttgctgggtggccagtgccgcacactgcttcattcaactcccaaagaaggaaaactacgttgtctacctgggtcagtcgaaggagagctcctataatcctggagagatgaagtttgaggtggagcagctcatcttgcacgaatactacagggaagacagcctggcctaccataatgatattgccttgctgaagatacgtaccagcacgggccaatgtgcacagccatccaggtccatacagaccatctgcctgcccccaaggtttactgatgctccgtttggttcagactgtgagatcactggctttggaaaagagtctgaaagtgactatctctatccaaagaacctgaaaatgtccgtcgtaaagcttgtttctcatgaacagtgtatgcagccccactactatggctctgaaattaattataaaatgctgtgtgctgcggacccagagtggaaaacagattcctgcaagggcgattctggaggaccgcttatctgtaacatcgaaggccgcccaactctgagtgggattgtgagctggggccgaggatgtgcagagaaaaacaagcccggtgtctacacgagggtctcacacttcctggactggattcaatcccacattggagaagagaaaggtctggccttctga

SEQ ID NO: 591 - protein, 433 aa, Mus musculus
MKVWLASLFLCALVVKNSEGGSVLGAPDESNCGCQNGGVCVSYKYFSRIRRCSCPRKFQGEHCEIDASKTCYHGNGDSYRGKANTDTKGRPCLAWNAPAVLQKPYNAHRPDAISLGLGKHNYCRNPDNQKRPWCYVQIGLRQFVQECMVHDCSLSKKPSSSVDQQGFQCGQKALRPRFKIVGGEFTEVENQPWFAAIYQKNKGGSPPSFKCGGSLISPCWVASAAHCFIQLPKKENYVVYLGQSKESSYNPGEMKFEVEQLILHEYYREDSLAYHNDIALLKIRTSTGQCAQPSRSIQTICLPPRFTDAPFGSDCEITGFGKESESDYLYPKNLKMSVVKLVSHEQCMQPHYYGSEINYKMLCAADPEWKTDSCKGDSGGPLICNIEGRPTLSGIVSWGRGCAEKNKPGVYTRVSHFLDWIQSHIGEEKGLAF

SEQ ID NO: 592 - DNA, 26318 bp, Homo sapiens
ggagttcaagaccagcttgggcaacatggtgaaaccccttgttctctaccaaaaatagaaaaactagccaggtgtggtggcgggtgcctgtagtcccagctactcaagaggctaagcaggagaattgcttgatcctgggaggcagaggttgcaatgagccaagacagcgccattgcacaccaacctgggtgacagtgtgagaccctgttcccctccccgcccaaaaaaaagattagtccgggaaatctctaactttagtgtctccagtctctgaacttctgctgcgtttgtggctgataggctgcttaatgattaacaacttttacaaaaatcttggtaaaaattacataatatttaccatctttataattttttatgtgtgcagttcagtagtgtttagtacatttcgcttgttgtgcaaccaatctccagaacctttttttttcaagacggggtctcactctgcctcccaaagtgctgggattacaggcatgagccaccgcgtctggtccagaacttttacattttgtaaaactgaagctgtatacccacccattgaacaataactcatcatttcccccttcctcagcctctggcaaccaccattctactttctgtttgtatgaatttgactattatataaaatataagtagatttaagtggaattatacagtatttgcctttttgtgaccagcttatttcacttactatgctgtcttcagggtttattgaagttttagcatgtgatgggatttcgttcctttttaagactaatattccatgtgtagatatgctgcattttgtttatccatttatctgcgtggacatttgggttgcttccccctcttggctattgtgaacagtgctgctatgaacaaaggtatgcaaatctctcatcaagaccctgcttttacttctatatctagaagtggagttgctggatcatctggtagttctgattttttgaggaactgccatatatcagctgcacaattttacaatcccaccaacagtgcacaaggattccactctctccacatgatcaccaacacttgttattttctgtttatttttttctttatagttgccatcctgtttaaagactttttcattgtttcatgtaaattcattttgtcttcctaacagatttcatgtgtcttcagggcaggaatcttgccctgttctcctgtgtaccctcagtgcctagcaccgcatgaggcatgtccttaggtgtctgaaggtcctttttggttgattggatgaaatgaacagtttgagttgagcttagtccttttgagaacttagggtagaattccctttacaaacagaacaagctgactgctatgatacagactgaatgaatcttcaggacactgctgcactgtggagcaaagtctgcatggggacagtgtcactgtcgcttcctctttgactgaagatgcaatattgtggtcatcacacaagctgctgggtctactctccctgcaaagcataatgctctggaaacccaattctatgcaggtagaatcagaagaccttagaaataaaaacaaaaccaaaaactgaccttgagaagctcagaggagggccagtacgggaactgagaggaaacatcacagatagacaggtactagtaggtacagctattctcaactctgctttgttctaaccgctacttaatttcccttcattttcctgaggtcttggggagccaattttttattcactgctatgactttgagggttcctctgggtctccaagctcttttttttttttttttttggagacagagtctcactatgtcacccaggctagagtgcagtggcatgctcttggctcactgcaacctctgcctcccgggttcaagcaattcttgtgcctcagcctcctgagtagctgggaccacagacgcatgctaccatgtccagctgattttttttttttttaaattttagtagagacagggtttcaccatgttgcccaggcggtcttgaactcctgagctcatgcaatccacctgccttggcctcccaaagtgctaggattacagttgagccactgcacctggcctccaagctcttttagtctatatggaaaagtccctccacttagccatttgtttggcatttaaaaaataaaactatcactaggaatctaaaaaaagaacaagtacaaaagtgctgaagcaattaactttctgagaacagattctctagaaaagtcgcctcgaggtggtttggttggcacaaggctctcaggtatacatccctttccttgattcatccctgtctggggaatgctgcccaaagacctgccttgtagtcccgggccatccccacctctgtgttctcctccggcccccatctcaaaggatggggttgaagtagaagccccagtagatagatagtttgtagtttagttgggtgaaaaaaataaaacaacactccctagatatatgatgcattggctgacattttccccacttgtttggtgatgagaatcctctgggtcacctattaaggttccttcagattccctcctatcagattccttcacttgaggccaggagttcaagaccagcctggacaacatagagagacctcatctctacaaaaattaaaaaaataacagggcataatggtgcatacctgtggtcccagctactagggaggctgaggtaggaggactgcttgagccaaggggtttaaggctgcagtaaggtatgattgcatcactgcactctagtctgggtaacagactgacacgctgtctctctttaaaaaaaatcagatttctaggccccgtctaaagaatcagaatttacaaatgggtaacctgaaaatctgtacttcttcaactttcaagccaagtgactcttatcatcagacaagtgtggcaaagataacattactgaatatttattatttcagatacctgggcatctactcaacagggctttttttcgtctttttttttttcccccttcagggaaggataaagagacaatgccatcttagtgatgattatcaacacaggcttgggagcaggaaacctgggtttgatttgccaggtattggctgtgtgatcttggacaagttatttaacctctcagtgcctcagtttctttatccataaagtggggatgatattgcatctccttcactgaggatcaaatgaaataatgcatacagaactgttagtccagtgcctgctaaataaaagccattgtcaataaatagatgctattgttatttccccatagaagaaccctagagtatccccatcatataaatatgggtgaatagttgtggaaaaggaagactggctatgggtggttccaggagtccacacagatatataagcacagccagaaggcccagtgatcacttctctgactagacccagcagacacaactgtggctggctacattagacaaatggaagaacactttaatcagtctggttcaaggtgggcaggcaggaatcaaggcagacatgacttggatggacagctggagctatcctgggatgtcaccatgggttagaagtaggaagattcccagttagaaggacaagcacctccactagcctgattgaatttgatactgcctcagagatagttctccaaacctggagtcaaccaggtctgcatgtgagtcttggtgcttccatttccctggagtttaaccttgtggaaattgcttaagcccagtgaaccttcattttctcatccataaaatggtgacattaatagtaccttccttaaaggtgttaagatgtaaaaagaaaatgaatgtaatgcaaataaaagttggttattattattattatctatctttaacaagggataaattgtaagattgtattgtccccttggagacaacagacttcttttttatttttattttttgagacagagtctcattgcccaggctggagtgcagtggtgtgatcaaggttcatcgccacctcaacctcccaagctcaagcaatcctcccacctcagcctcctgagtagttgggaccacaggtgtgtgccaccacttctggctaatttttaaaaaatatattatagagacgaggtctcactatgttgcccaaactggtctgatactcctgggctcaagccatcctcctgcctcggcctcccaaaatgttgggattacaggtgtgagccactgcatctggcactcttccttttctttagtccctgccacattccccaccatcactgtctccagagtaaacaaagaacgcccatgtagattacccacatactgttcctcccattcactctgcacacacacctgcctccagggatccctgctccctcttcccacagatattcatacatttagtcctctagcagccttctcaaaggagactgtcccctctgcaggacgtggctgcctccaaaccctcctcagaggctcagcaaaccagagaaaagaagcaccttctgcaggagggtgggcaagatagattgaggatggggatggatggtgatcgggaaaagggaggagctgaggattcagaataagaaaggagagggtggaaatgtgtcatgaagttcctcaaaatctgtgaatcctgaatctcatcatttttagtgaatgaactcagatgattcacttcccttcattagcctctattttcctctctgtgtaatggaaggggaagtgcttgctttgaagacagagatgcatatagaatccagcacatagaatccagcttgggagagccatgagcatgtggaattagacatcatatgggttatgaatattatgttagttttcttctgaataggattttttcagtatttcagcttctggctgaacatatatccctaaatattattgattttttggcagtcttcagcaagcccaccatttgctggttagtcatcccagtcctttgttcctgggcatgcccctttgcttctagttaagcatctattgccacccaacatggtaaccagaactctgagcagaagttttaggaccagggcctaactttggttcctggtgaggggctcagaatccagaaggtctggtaagccatgaccaacactactttttttttttttttaatggagtctcgctttgtcacccaggctggagtgcagtggcccgatctcggctcactgcaccctctgcctcccgggttcaagcgagtcttctgcctcagcctcctgaggagctgggattacaggcgtgtgacaccacactggctaatgtttgtatttttagtagagacggggtttcaccatgttggccaggccagtctcgaactcctgacctcaagtgatccagccgcctcagcatcccaaagtgctgggattacaggcgtgagccaccacacctggcaaactactttaaagcagtaagttcctgacttaggtaataagtgggtttgggtcagggagggacaaagaaaaatttggccaagactcatgacatacatgcagaagtctgagctgagtggcctgggtaggcctaggaagcaggccagagctggtaaggcagaaaaagagtgaggaaggttaggggggtcatagcctgatgctggagggaccagctttagttcccctttcatggtgctactgacgacagtgtaacctcagggttcagcccctgggctctttgctttccatgagtaaggaagcaagaatgctgcctccctccaccccttccacagcctgctgggggcctgcagctccagcaatccccctatcatgttacatgcccagaagcggctttcagtgcctgccgttgccagctggcttcacccttcacactagacactcaggaagaaggggtccttagactcaaggaagctatgtgaccagcattccgtacctccttcccagaactgttgaagagtccgtctgccccatgtgtaggagggaaagaggcgcttcaggccacacagggacacagacaagagggagagggagtaagcataggcaatgtgggagtgaacagcacatgcagctgtgggtccagctgcctgattgctgggaactgctggccaaggatacagcatccccattggcctggaatcctggaatggactccagcctgacttggtcttctgagtcaatccagccacagtcaaaaaggggaggcaggcactcgatgtaggaattacagtttacacagttcctcttcctatctctagcatccagaactgcgcccagcacacagtaggtccatgataaatatggaatgaatgaatacttttacatgcaagcatgatctcagccaatctgcagagtgaggcacaggctggacaggtggatcacctgaggtcaggggttcaagaccagcctggacaacatggtgaaaccccatctctactaaaaatataaaattagaccggcatggtggcagacacctgtaatcccagctacttgggaggctgaggcaggagaattgcttgaacccagaaggtggagggtgcagagagccaagattgtaccattgcactccagcctgggtgacaagagcgagactccacgtcaaaaaaaaaaaaaaaaaaaaaagagttaagcaacttgcctaagatcattcaactttgatgtagcagactgaaggctaggcactgtggtctttctatagtgccatgctgagcattcttcatatacaacacagaattgcatcctatgactccatgggaacttccttttgggtcagaaaatagtccttaggggctgagtttcctggacttagtctcagggccaggtttggataccctgcccctccctgcgcatctggcatctgccttcccttttatgagaatctcctggaaagggcttctccagcagtctgtgttgccacatctgactcaggagctctgtacccttgagacacagaggcaggggttggtggcttcaccctaggagtcaggaaaagaatgaaatcatacacattcagttccttattctcttaccctcaacagaaatttcagacagcctagaccacagagacagttcttggaattcaggcaaacaactaatttgtattacagcgggtgcaacttaagagctcagagtccatagtccgagcagtctttctggaaggaggtctccaaagtcaggaggagggctcccctgagctggatcatcttagctcactggcccctcccttcacagcgttctgtcttttatggagacagtgaggtatagcgcataggaacaaggatcagaagacgctgggttttagtgctggctttgctgctcatcaactgtgtatcttctctccacttcattttccatatctgcaaaatgggaacaacaataccagtctatatcataaggcagttatgagtttaaagagaaatggtttacattaatgtgccttgaagcacaagacagaaatacaatataaaaaatatggctggggccgggcacggtggctcacgcctgtaatcccagcactttgggaggccgaggtgggcggatcacaaggtcaggagatcgagaccatcctggctaacacggtgaaaccccatctctactaaaaatacaaaaaattagccgggtgtggtggcaggcgcctgtagtcccagctagtcggtaggctgaggcaggagaatggcgtgaacccgggaggcggagcttgcagtgagccgagattgtgccactgcactccagcctgggtgacagaccgagactccgtctcaaaaaaaaaaaaaaaaaatatggctgggcgtggtggctcatgcctgtaatcccagcactttggaaggatgaggtgggaggaccccttgaacccagaagcccagcaaaaccttgtctttaaaaaaaaaaaagaactgtgcacaaagatttcagagagtgctaaagattagcgcatggataaggaagttctgtgaagagttgaagtgctaggtgaagaggtggcacgggggaggagggggcggaaggggagaaagggtgtcacgcttcataacggtctccaaacctctttgtccaggaggaaatgaagtcatctgctctcagcaatcagcatgacagcctccagccaagtaatctggagtcatgagagctgctaggggagcaacatgaatcatgacggcccctgggaatttcctgataactaacctgggagtttcggggtaagtcctcaggctgcagcatctctgtttatgttctggtcacgtttatttacaattaatgggttctcaaatccaaacaaaactgaccacagtcttctagaggaagtagcaaggttggctctgaagcctatagcatctctgactcagtctgtcccctggaaggctggcagctcagcaagcacagaagtctctccagaagacagtgggtcacctgcctcccaaaagctgaaaggctaacttgtactttccccagcaggcagctggcatcctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccagtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcaataggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccatagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagtttgagtggatcatttgaggtcaggagttcaagaccagcctggacaacatggtgtaaccctgcctctactaaaaatgcaaaaatcagcctggcatggtggtggatgcctgtagtcccagctacttgggaggctgaggcaggagaattgcttgaacctgggaggcagagatctcagtgagctgagatcacaccactgcactccaactgggcgacagagcaagactccatctcaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgccaggaacccagacaaccggaggcgaccctggtgctatgtgcaggtgggcctaaagccgcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttccgcctcatttctccctcatctgcccctgtccatgcagcccatggccttggggacaagtcgtgctttgaggcctctagggagggaaggaagaagtggcagatttcatgggactaagctgtttgatgggtatcttctcccacagtgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattggtgagggggaaccccgcgactactgtggccataatggcttggggagagtgggacccagggagagactggagctgaggttgaagctgcccggtggggcaggggtggggcgagggaccttgaagcctcgatatacatgacaaagggagtggcagggaagagttccatgaagtctgaggggcctggtgctcctctggagagaccctgaatttccccaacaagtagcctcttgcgagtggaaacagccctgtgggtatatggcttgggctgggaaggccctgtttatatgaattagaaaaagacacaccttcctttgtgggatgcagcctctgtctgtgctaggatatagaacttggagaatggagccttgggatggattccagcctaactacctcagctgggagtttttgcagaaacgacctgtacagctgtatgcagtggctctggccatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccgttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagtgtgatcaagggaagactgcagagttagaggtgggagcactgaggcggtggcagatgggtccagggatggatgaagagtgttgtttagggagcgatgggctgcaaaggtaaatagatggtaggggctataggtggagtaaaggctcagatttgcatggaagagaataagggccttccctggtagagatactttatggttcccctctctggcagactcccagtggacagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgttccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttaaacttgatgtggtagaaaatggggctgcgtcaggcacagtggctcatgcctgtaatcccagcactttgggaggccgaggtggatggatcacttgaggccaggagtttgagaccggcctggccaacatggtgaaaccctgtgtctactaaaaatgcaaaaaaaaattagccaggtgtggtggtgcctgcctgtaatcccagctaatcaggaggctgagacatgggaatcgcttgagcacaggaggcaagtttgcagtgagctgagatcacgtcattgcacgccagcctgggcgacagagcgagattctgtcctccccccgaaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgacaaatctccctggtgcttgtatgggaaggagttggagtacataaaaaggagaaaataacaaaggtggactgcaccctagagtttcttatgggactgcatctctggacttaatggagctttgggaggtagaggttaggagagctgtagggcagggccaccacagcacttaatgtatacaaagtttccccaaaccacaatcccatggctgtgtaagtagtgtacaggcttagtgtcagctcccaattgcctccttaacctgatgcctttgtgcagtgcacatcttgtacagctgtacatggtggtcttctttagggttaactccacaacagtctcttcactctgcccccaacaatccttgagctgacctcaaccaagaagaacacctgtggccaggtgtagtggctcatgcctgtaatcctaacattttgagaggctgaggtgggagaatcgcttgagcccaggagtttgagaccagcctgggaaacttagtgagaccctgtctctgcaaaaaataaaaaaattagccaggtgtggtagcacatgtctgtagtcctagctacttgggaggctgaggcaggaggatcataagccaaggagttcaagtttacagtcagctgattgtgccactgcactccagcctaggtgacagagcaagaccctgtctcaaaaaaaaaaaaaaaaaaaaaagaagaagaagacctgtaagtgaaaattgctggccaggctcagtggctcacgcctgtaatccagcactttgggaagccgaggtgtgtggatcacctgaggtcaggagtttgagaccagcctgaccaacatagtgaaaccccatctctactaaaaatacaaaaaaattagccgggtgtgggggtgggtgcctgtaatcccagctactcgggaggctgaggcaggagaatcatttgaacccgggaggcagaggttgcagtgagccgagatcgcaccactgcactccagcctgggcgacagagggaagacttcgcctcaaataaataaaaaaataaagaaagaaagaaaattgcttatccagaatgccagcttgactctgtggcattcaggaaacaaaaaacataatttcccatcatctgtgtgtgggactgatgctggaattttctcagtgtgttaacagagcttgtgaccagccattgctatgcctatgattagggggcccagaatctcaaagctggatgatgtcctaatgggggtgactatatattttgaacaaaacatcaagttctgaaaagctggggtgtagaaggcaggttgggagataattgggtatcaaaaattagaattgccaagctgtgttaatgggttggggcagtgtttcttaatcgagtcatctgaggaccttttaaaatatgcacacctacactccacctgtagagattgtgattcaggtcagggctggctccaggtctcgtggttttagaaaagctccctcggtgttactaacatgcaccactgattgacagcctttggggacaattggtcagaatatatgaagtgcccagaaaaattcaagatatggtcagcatgagttctctgcatgaacagccagttttctgagtggggtttggtggcacaaggtctcctggatttcctggttaaaggctttctggaccgtgcttccctagagggcaagaactccaagtatttggctttttcttttttttgaggcagggtctcactctgtcacccaggctggagtgcagtggcgcaatcttagctcactgcagcttctgcctcccaggttcaagcgattctcctgcctcagcctcccaagtagctgggattacaagcatgcactaccactacccggctcatttttgtgtttttggtagagatggggtttcaccctgttggccaggctggtctcgaactcccgacctcaggtgatctgcctcccttggtctcccaaagtactgggattagtattcggcttttgatccccatcatctagtgtgctgttttacacaggttgatgcagtggtttagagcatggattttcgagtccggtggcctgaactagaatctaacaccagctgtgtgacttgagaaaggttattagcctctctgcacctcagtttcctcatctgtacaaaagagatgatacaatctacctccctgggttgttataaggattcatgaaggccagacacagtggctcagcctgtaatcccagtgcttcgggaggccaaggtgggcggatcacctgaggccaggaattcgagaccagcctgaccaacaaggtgaaaccctgtctccactaaaaaaaaaaaaatacaaaaattagccaggcgtggtggcatatgcctgtaatcccagctactcgggagtctgaggcacgagaattgcttgaaactgggaggtggaatttgcagtgagccgagatcacaccactgcactctatcctgggcaacagagagcaagacttcgtctcaacaacaacaacaacaacagaaaggattcatgagttcataagtcctttagcataatactggcacctaataaaagcataaaaacggtggttattattacaaagctaagtaaattattgtagcatcagatcagatgggaaccctctgccctctcccacctcagaactgcactattttgcgggagtggaaacctgctaggaagctgcccaagccgagtggctgttcagtttctgccttcccctcaggggccaagaaagatcttgttcaaacttgagcagctccagcatcagggctcagagacactgaaaacaggaagtatgagccctactggcagggttaagccaggaggctgttaacaattttcaggccatttcccagccaacaccctgacccccagccagctgctgtctctttgcctaatattagatctcaccccaggctagcaggcatcagccgcttctccagcaaccagtttcacagttccagattctcactccagagactgcctcctattagtgcctccacgatcaagcactgtgctttttctgtttttgcttttgttttttttgttttttttttttttgagatggagtatcgctctgtcgcccaggctggagtgcagtggtgtgatctcggctcactgcaacctccgcctcccaggttcaagcgattctcctgcctcagcctcccgagtagctgggattacaggcgcccaccaccacgcccggctactttttgtattgtttttagtagagatggggtttcaccatgttggccaggatggtcttgatttcctgacttcgtgatccgcctgcctcggcctcccagaatgttgggattacaggcgtgagccaccgtgcccggccttttttttttttgtttgagatggagtcttgctctgtcccccagtttggagtgtagtggctcaatctcagctcactgtgcaacctttgcctcccgggttcaagcagttctcctgcctcagcctcccgagtagctgagattacaggcgcccgccactacgcctggctaattttttgtactttcaatagagatggggtttcaccatgttggccgggttggtctcaaactcctaacctcaagtgatcaacccgcctcagcctcccaaagtgctgggattacaagcatgagccaccatgccagaccaacactgtgctaaattattcatgtgttgtctgagttaatcctcccaagaatcctatgaggaaggtagtatcactagccccatttaacagtagagaaaatggaggcacagacagattgagtgacttgcacgaggcaatgcagctccaaatgcaaagagtcagggttcgaacccaggcagccatctccagagtcctcatgcgcggtactaggatttatcacctctcaggagagtccaactagggcaaaaggagagcagcccccctttcaagctttctactttatggttgctgggtttctaggcaacagctatcagaattttttttttttttttgagacggagtctcactctgttgccaggctggagtgcagtggcgtaatcctggctcactgcaacctccgcctcccgggttcaagtgatcctcctgcctcagcctcctgagtagctgagattacaggcacatgccaccacgcccggctaatttttgtatttttagtagagacggggtttcaccatgttggccaggatggtctcggtctcttgaccttgtgatccacccgctttgggctcccaaagtgctgggattacagttgtaagccacccgcccagcccagaatttttttttttttttccatacacagtcttgctctgtcgcccaggttggagtgcagtggcccatctcggctcactgcaacctctgcttcccaggttcaagctattatcctgcctcagcctcctgagtagctgggattacaggcgtgcaccaccacacccggctaatttttgtatttttagtagagacgggggtttcaccatgttggccaggctggtctcaaactcctgacctcgtggttcacccacctcggcctcccaaagtgctgggattacaggcgtgagccactgcgcccagcctcatctatcagaattttaatcctctcctagataacaattctttcctcctagaagattcccaggccagatgaggagaccacactcagccattggtttcaaagtaaaacttcactgttctcacagtaacctcagcctttctgctgcaatctggtttcattgaagtggtttccgttttcaccagaacccctctttctgaagtattctcagcccattatattaacagcactcagcctgctttccacgtatgccctatctttcccaagctgaccacagcagcacccctgcctatacccctccatactcactcccattgggtccaccttccttccaagaaggaaacatttaagccctccctttgaattagatgaagtaagaggagttgctgaggtgttttttgaaaatcaattctgggctaggtgcaatggctcacacctgtaatcctaatactgtgggaggcctagacgggaggattgcttgagcccaggagctcgaggctgcagtgagctatgattgcactactgcactccagcctgggtgacagagcaagaccctgtctctaaagaaaaaaaatcagttttattgagatataattcatatatcatacaacttacccatttattctttctcttttctagagacagggtcttgctctgtcacccaggctgatctcaaactcctaggccagagtgatcctcccacctcagcctcctgagtggctggaattacaggctcataccaccacgtctggcaccatttgaagtgtacaatgcaatggtttttagtagattcacagaattgtgagacatcacaatcaattttagaacacttcatcacctcacaaagaaatcctgtacccactcacaatcactccgtttttctccccaaccccctcagccctaggcaatcactaatttactactttctgtcctctctgtgggtttgccaattctgggcatttcatatcaatagaatcctataatatgtggttctttgtgactggcctctttcactcttaacatgatgttttcaagttttatccatggcatagcatgtgtcagtgaggttgctgagttttaataacaaattgagggaaaagatggtctaggcgaggtgcagtggctcacatctgtaaattccagcactttgggataccaaagtgggaggatcccttgagttcaggagttccagaacagcctgggcaacataaagaggccccatctcaaaaaaaaaaaaaaaaaaaaaaaggatgttctaggtctctttttgaggtttcagtcacattgagattcattcaacaatctttgtcatttctttctttctttctttttttttttgagatggaatctcgctctgtcgcccaggctggagtgcagtggcgcaatctcggcttactgcaatctctgcctcccaggttcaagcaattctctgcctcagcctcccgagtagctgggattacaggtgcctgccaccatgccccactaatttttttctatttttagtagagacgaggtttcaccgtcttggccaggccgatcttaaattcctgacctcatgatccacctgcttcggcctcccaaagtgctgggattacaggcatgagccactgcgcccggccctttgtcatttttttaaagtacccatacacaggacattattttagatacaaatgaggcagtcctagtcctcaaggagctcaccactttgcaaagtgctatactaagtctgcataaaatgcatggaaaaataatgaagaagcaattgattctgcctggtgaagtcaatgacgactttacagaagaggtgatattttatctggacattcaaatacacacagaaatttgccaaactagaagaaaggcattgtaggcgtagggaagttcatggaggcatgaaaaggtgaggtgttctaaggaaatgaggaatagtccattgtggtggagaactctggggggcaatgagtaggtggagatggtggggaaggatctggtgggatccagctggtgatgaccctgctgcaggactgattctcagcagcaggcactggttctgctcaatgactaaacagatgctgtcctgagatcctctctgcgtggcccctgccatcagcctctctccacttcttcatgatccagcaaccacagggttaatgcctgtggcacagcaaaggcctctgagatcctccctcctccagctggctcaggcgaaagtgtcctactggggtatcttgatagttaaatattttgactatcacctcttgccctcaggcactatttttcaaaatccagaaagtgaattaagttctagaagccataaaaaaattggctttttaaactaaacatttttattcaattgtaaaagtagctacaaatgtaaaatactttcatagcattccacagccattgttaacatctctggcttcttgggttcctttgtaatctcaacctcttttactcggtcttaaatgttaggattcctaaagcctgatcttaaacttcctattcccaccctaagctttctcccttaggatcttgttagcacccaggcttaaatgaccaccaataaacagatggcttacaaagctgatctctagccagacctctcttctgcactccagactcttattttctgttgtctacttgacaccccttttggttgtcactcacaggggacctcaaagtcaacctgccccaaactggccgagtcttcatgccccagtgtggagacatctcccatcactttctgtctcagatgatggcaccacatccattcaattatgaaagccagaaacctggggccatcctgatgcttctctcctggtttccttcatcccctccatcaccaaatcctggggatttgactgatatctcttgaagtcgtccatttctctccctccccaccatcaccattagttgagcccagtctaccctacaatagcttcccagtttggtgccactgcactacagcctgggcgacaagagcaaaactcagtctcagaaaaaaaaaaaaaaaaaggaccaaaggaccactaaaagaagagcactctttttttcttttttgaagcagggtcttgctctgttgcccaggctggagtgcagtggcacaatcctagttcactgcagccttgacctcctgggtttaaatgatcctcctgcctcagccttccaagtaactggaaccacaggtatgtgccaccacacctggctaatttttttttttaattcttttgtagagacagggtcttaccatgttgcccaggctggctggtctcaaactcctgggctcaagtgatcctcctgccttggccttccagtgtgctgagattataggcataagccaccatggctggcctaagaagggcattcttagcacaggttggtgaggattaggggctagaagagaacccaaaagtttcatttattcactgattcatccttcactcattaatatagcaaacacttattgggagtcggccatgggcctggcattgtgctgtgtattgggtataaagatgagagccccagtctcaaccccagtgagataagggtcaagttggggaagagacacattgcaaatgaatagagtacagggtgaggaagatttacaagatgggcagggatggctaagacagcaaggtggaggaggtgaccttggggagaatcttgaagggcaaatacaggaggaagaaatgcttctctgagcagaggaaacagcacatgcaaacgtgaagaggagggaggaagcccagggcaccggagggactgcaggtggttccagccgctggggtaggggctggcattgaagtgatttgactggagggattggcaagagctggaacctacgggcctagaggactctgcctgacacatgaaggactttgaactttcttgtgatgtggaattgttaaagattttggagcagtgtgaaaaattgatcaaaggaagattcttgggcctgggtgagactaccagcagggaaaaccagtttggagactattgcaatcagcgaggtaggagctgaaaagtgtctgagccagggctatggcaatgggatgtgagcagaggatacaaatatgggagattggtggggatagaatagacttggtgcctggctgggggcgggaagaaaaggagatatcacttggtttagtctcctgccttcgggtagataaggcaacagcataattttacaggtgagaaactgaggctgtaagtgatttatagtaggtagctgaccaagctagagttaccacttgtagaaccttggggatcaatacctcagggcagctagttctgctaattacctccttaactctgtccacccaactggagaacttccctatcaccataatcaccacgcagtgctgatatccaagcctgcatagggtgatgcttgtttctgaaataccccaggcctgttcagccctgtgactgtggttctaacacctggaatttctcctgaacctgctggtcatgtgatgcactggcaatgagttagtggataggtcggtggcatgtataaggaaatcagcagatgctggatctagccgtctgccttctgacttcctaaaaatgtgacttctggtgtttcaacagatcacatgcccttagcacatcaccaagttctggcacgaggttgtggagatggagcagattttgtaaggactccagctggtgggcttcctagcccagtctctccttccctctttttggtggttctccagttgcccttaatttctcattctcttttcatataaagggaagaaaatgactttctccctcacctggctcttcccatcctcaccctactgtctttttagctctctctccagagtattgtacaagctggggttaatgccattggagggaggactctctagctccagcttggtttttccatttaattgtcttggtgaagccagccatggtggtgcatgcctgtaatcccacctacttgggaggctcaggggtgaggattgctagaggccaggagttcaagaccagcctgggcaacatagtgagaccttatttctaaatgaatgaatgaatgaacgaatgtaacaagtgtcagccccttttccttttcttttcttttttgagatggagtcttgctgtgtcacccaggctagagtgcagtggcatgatctcggctcaccgcaacctccgcctcccgggttcaagcgattcttctgcctcagcctcccgagtagctgggactacaggcgcacgccaccacgcccagacaatttttgtatttttagtagagacggggtttcaccatattggccaggctggtctcaaactcctgatctcgtgttctgcccgcctcggcctcccaaagtgctgggattacaggcataagccaccgtgcccggccccccagcctcaaactttctctgatttctcactatacctacacactcctcaccaccacaggctgagagattctgccagggaagctctaagct

SEQ ID NO: 593 - DNA, 2297 bp, Homo sapiens
gtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctga

SEQ ID NO: 594 - protein, 437 aa, Homo sapiens
RPDLATMRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 595 - DNA, 24656 bp, Mus musculus
  misc_feature (1)...(24656): n = A,T,C or G
taatacagatgacaaaaatctagctgatgcagttgttaggttacagatgtggagcacacaatcaacttaataaatgttgttcttaaagaggtttgggttttcactgcacataagaaagtacctgagagcagggcatgtcagggcatgcctttaatctcaacacttaggaggcagaacaggtgaaactctgtcaatatgaggccagtctggactacataggaagttccaggcttgtctggagagatgactcagcacttaagaatactggctattcttccagaggttctgagttcaattctaagcaaaaacatcacagcttatgatctaatgccttcttgtggtatgcagacatacatacaacaaagcacctacatacataaaattcataaataaataagaaagtttctttttaggccaaccagaggtaccacgctagtttgaatgagaatgcccccatagggtcactatttgaatgtttggtttccagttggtgaaattctttggaaaatattagagggtgtggtcttgttggagaaggtatgcactaagagacaaagcccacaccaggccccttctagctttcttccttcctgctgcctacagatctggatgtaagggctcatctactgccccagtgctatgtaccatgatctggggtttggggagttggaaaacagtaaaagatgaggccatagaatagacagtgaacccatgggtcagagtctggggaatggagataaacgagattcctgaagttactgacgtaagataaacactgcactaccattaaactagtggctctgaaggcgcacaatggccatgatgtagtgcacaatgcacagtgtgcagtgctgcagtgggggaggaggagccagaagcagtacactgccccagaacactgggtcccatctgctgatggtgatgtggaggccagaggagggagggcaattgttctaatcccagagcataagctgtgttttcacacaacgaccagcagccagtgcttctgagattacatcatgtataagactgtgcagttctttgagattctttcccaaagagctcactattcatcccattcttatatcttctattcatggttttgcttcattctcagaacaatcctaggaggaaagtgttgtcaagaccattgcacagtcaatgaagtaaggctgggggcattggcaccttgacgtgcctcctccgttcccaagcccccacagacaaaatgcaatgctgcttataatttcaagtaaaacaatttcatgtgaaaagatcctatccttttgtacccatgaagttttctcttcaccttttaactctagacaaaagccaactaaccaaccaaaacaaaaacattatcttttagaaagattttaactcttttttttctgaccagtgattctaacgtgaacataataccccttttccaacagagggggagataaccacacaccattctgcagtcacaggagcacacaagagagcatacctccactgagcgagcgccttacagggactgagcagtcggtgtagacagggcagcagtgtgagtggagagccgtggagaggttagttcaggacccaagcaagctacagagaagaaaagaggaaaaggaaagagaaacaggtgttctcacttcgtgtgtcccatagttaacaacagtgtcaggatattgaggttaaatgctctgaaggataaaattaatattacttttaaaattctatccatttaaatactagtcccgaataattacactaaaactgactgctgcacagttgagtcaagtcttcattttttaacagcaggtatcaaaagaatctattacaatgctagaggaagtatcctgatttaaagaaccttttccatgtgaagaagggaaattgtgtgactgatattcctggcaggccttataaatgctatttaaaggtattattattcctgagttcacagtaacaagctgtgataacagccaccttacactgccttctatgtttttttttttaatcagtttgtacatttgccctgaaggcagaggaaagcattggtcagcctgcctgtcaacaccacccagctactggtagaagctgcagctctaaactctggatcctaaattggttttttcgtaagaatcacctaggtgatttgttactaaatctgtccatcaaacacaacaaaagaggcttttctgacccacagacaaggaaaataaagtggaatggttgttttagaactctgctctcaagagtctcaaaatctcaaaacaatacctttatggttctcatttgtttgggccctagaataatcccactttaaaaaaatctatttggctgggctgtggtggtgcacgcctttaatcccagcacttgggaggcagaggtaggcggatttctgagtttgaggccagcctggtctacagagtgagttccatgacagccaggactacacagagaaatcctgactcaaaaaacccaacaaacaaacaaacaaacaacaacaaaatctatttggagcatgaatgctgcctctgtaagtctgaaagccacaaaaccagtgagaacaaagagagttccaccttgcagaggtgaagctagtgttggactgcaacacaaatttaattcaaagctaagagagagcaggtgatcaaaacaccagctttctctgggaggtggtggcacacctttgattccaccactcaggaggcagaggcagatgggtctgagcttgaggccagcctggtctactgagcaagttctacagctaggactacaaacagaaacccggtcttggggaaacaaaacaaaacccaacaacaaacaaacaatggcagcttttgtccttaacacaagaaaacaaaaccaatcaccacaccattaatgatatatgctcattggaaaccagacgcttggggcgtgttggtgctggagttccaagcctggggcctgtttgtgcttgctaaatacgtatgctttcgtttgactctcacacatcagaggggagacattcatttcttatgcacgaggctgggtcaagtgagcagcatggtgttactcaccggtgtggatgcacatggcaagcaggagatggactgagtaagaagccaggagagcaacaaacagcagcaggaaactaaaacataaaacaacaccgttaggtttcctccaagcttgctttttcatgatccgtcatttcttcagtcagatgcttgtagggaccgtctctgagaagcaaaactgcagacatcaaagaaatcactgttctgtatttaccgacttgtacttaagtcaaatgaaatgcttttaaaatgaaaagtgaagtcagaaagaaagaaactttacttaaaacacaagtccctcactttgcactgtctgctgactgcatttcagcactcagtgatttaaatatttccctttagtgactaattttcctcttctaagtctcaatgacttcctcttgccccatttccccaactccctctccttccagtgatgtgggccctgtaaccatggctttgcctgtactgtcgagctgatgattcctaggctctatgtgggccctgtaaccatggctttgcctgtactgtcgacctgacgattcctagactctatggagcatgcagttcttcccagctcaacccccgaacaacgcaagtaacacatttctaaggatacaatctaaaaacccgtgtaaacgctgcgaaaataaatggcataagtaattcctgcttattctccgaaagatcctggcaaggtaggcttctagcaaaacccaggtccctagtgcaccatagcaaaggcacagaaatcctctctgtgaggcactaaagacttactggtaagtagcaagcattcaggaaaccgacatcagagacctcacaaaattacagtgtgacgacaccaacgaaagcagagtgggctacttagaagcggttttgcttattaagacatttggaagaaagagaagaaactgaagtgagattttgcactttaagttggcttctactaactaaacaggcgccaggacccggtgctcgatgctcagagatctgggtctgaaggatttcatgtctgcggccagtgagatggacaccagccatggaagccagcgacggcagtaaagcatcgaacatacaaagctatgtgaacaacagcagccccgtgactggctgtgattcatgaaaacagccctcacaggctcacaccaggctcactgaatgcttgattagcagcgggtgaccaaatcaggaaaggtttggaggtattgcttgttcagtgcctcctgcaggtgatcaggaatgtatgctcccagctactgctcggtgccatgcctgcctgtctgcagcctaccacactccccagctaccctgaccagcatgatgacaatgcttaccctctgacactgtaagcaagcccccatttaaagtgctttcttctataagctgccttggtcatgctgtgtagtcacagcaatagaacagtactaagacactggcccatgactaactcttgaaaataagcccagaacataatgttgggctccaggcgttaaagaagtcttatttagcagcctaagacaggagaaggatattttatttgcacctaaaaaaattgcttttaacttgcctgactgataagttttgattcacattggccagcctgacacaaatgagcttgaacttttaaaaatcataaatcaattgtagatcaagtgtgtagtggctattcctggttgtcaacttgacaatatttggaataaactacaatccggaattggaaggctcaccagtgacccttatctggaggcttggagatccttatctggatcttggtttgaagatcttgagccatagtggctatggattccagaagattgaatctccgagtttaaggaacacacctttaatctgggctccaccttctgctggagacaatataaggacattggaagaagggagtctagctcttgctcttgctccttcgcctgcttgctgcgtgagactgagtaactgctagatccttggacttccattcacagctgcgactgaaccattgttgggaattgggctgccgactgtaagtcatcaataaattcctttactatctagagactgtccataagttttgtgactctagagaaccctgactaatacaaagtggtttttttttttttagattagccacatttttagattaataaaaatcaacatcagtcctgtattgcacagtgatatctgggttaacaatgaagtctcagagacaacatggctgtcctcgtgtcatagggaacacattattcatgctcacggtgaagctggggaaagcagactactgcattgccaatcatataatcatgaacgcaacacgtgcttttacatctagtactgaatatccactaagaagaagtaatacaatcctcggttcctgtatttattatactatcatactgtattcttttaaaaaatcatgattttagggcacactttttttattgttgtggctgttggtttgtttgttttttgaagcagggtctcacttgaacttatatggctgaggaagaccctgaattccccgatcttcctgtctctacctcccaactaccaggaccagtccttcaggggcttcagaaaaggctttgttgtcacaggcaaggaggctgcagctgtgtcctgctcccgaaacacctccccatgagcaaggtgtgtaaactgatcctggctctcgggtagtaagtgtgcttatgtctgagttttaaagaaaaagttggaaaaggaaaatacgagaataagagtagattaaatttaaaaagcttatgtaataaggacatatagaaagaaaagttttatatggtatatggtgtatttgttttttaggctattataacaagaatcaaaacattgaaaaacaaaacacaaggcccttaaaacgacttctccagttcctctcagcacgacgtccaatccaggaacaggtttcttctttcactggatcttttttgcatgtgttgataaacaagtacgattacattacaactgctgcggcatttactatactagcacgtggactgcactatattaggtgatttttttagcctatgagcaacaggcaatactgtatagatgtgtagaaggttttaccatctaggtttgtttaagtatactctataaggatcacccaggaacgaaaaagcattgccgcacttcagaactattagccatggctactccacttggtaccctctcccccttttagttaaacaataacaattcctaaagtaacttgttttctagatccttacccactgtgccctatggaccccagtcatgtctgaccaggaaagctgcttatctatcacatgacatcctaaccacttaccttatctccaaagcttcccctagcaacaacctgcccaaaagggacaatgctcagtggccttccctttcttttttgtgccctataagcccttgggttctgattcttacaccagagccccgctttgctggtgctgttttaaagcccacgctatcttagagccccggggttcctttcttgaggttcctacatgaatgcccaccccctcaagccatgcatgactgtagggagcattcctccaaagcacagaactagataggcacaaggggaacaaaacagcattaaaaccccagaagtaatccaactagaaattgtagaccggtaacttctggaatcaaaattccttatcaaaatggaaccgtgtgatgacaaaatatggaaacaggcctcacctaaatccaaggatacccgtgttagccatcacatacgccaaaccaaggatgccgcttcccatgatggcgttcatcacgttaaagacggagagaccaaaggaagcaccggaggatccctgcctgtgaggttcctggaaacacaccatttacccacattaaatgcctgaggaaggaagttaaagtgtgctgagccattctacacacttgaggaatcgtgtgaacactaattaaccaggacgtggctagttctttcgcccatgtaacacaggctagtctcattggagaagaggggatctcaattgggagaatgccctaaagagactggccaagacacggcctgttttaggtgggggcatccctgagcaggcaggccttcctggggatgaaggagagcaaactgagcaagccagtaggggcaagtcaatatttcctccgggtctcccgtttcagtttctgcctccagattcctgccctgactttccttcaagacggactgtagctgtaagatgaaataagcccttcccttcccaagttgctttccgtcataggagttattaccccaaggaaaagcacatttggacataacacttgttcctttccctccgttctgacctattggtgcaactcaaggaaacgagtcttccaggaaaattacttcctcccatgcagggcccagctggcttcagtgggagccacagccttgtgacttcaagatagggtggagacagaggaggaacgggcctcagtcacgtgcttcctgaagaatcccagtgtcagcatggaacttctgtccctaactcttcttcctcaagtacgaggaccgcaataaactaaccttttgtttatatgcctaatgaattaagtcgattagcaggaatatcttacagggaaaacataaaccaaaccatcagctgttacagtccagggattcataaaaagtggagtggcaggactggaaagcagctctgagttagggagtttttctagcatgcccaaggccctcctaggctggacattcaagaccgaagaggctccggggcccccgggcacacacagcccactacaccggctttaggttaaggacgagctatgtgcacattaccagagacctctcctcatcttcacttacagggacttgtgtattaaagtgcctatagctcatctttcccttggccccatgattaaatccagaaaagaaacatcgtgtgatgttcttgcaagacctcacaaggctagaggagacagaggcgacaatgacacaaagcaatggtgagtcacaaaaccgaggctcatcccgctggtgttccaagcctctcactattgactgagtgctccatgctgctgccacattccaaactcgcctggggtcagtggttcgggccccaccccagggtcagtcccctgcagtccaaggctcctcttgcaagccctgaaggataccgaagcgcacaggaacccagcgcagccagtaaagcccacttacgttgcttagcaacggactccactcgtctgcagccaccgcctcctctggctgctgggcagagacgtaccagcctggctccgcttggatgctgtgccgggacgcctgcatggtgctccgcgaccgactgctaagtaaatcacggagccgcttcccctaaccccaagcgccccggctgagcggcttcagaggcggagctacgggcttggcccttccgggctctcgtagcaaatcgcgggcccggaagagaggtgcgagtccacagggtcggactctacgctgccttcgcggccagcagtgatgacgtcaccagcctccgacgccctatttccgagctgcaccagagcatgaggtgaggggttcgggtctgaagccggcctcgggtgacgctggccctggaaaggtgcagctggtgagggggcagtagtgtcccgggtgatgtagaaaacctgacggtaccgcggcgggactcgtgctcttctttcttgcccaatgagcgcaaaaaggccaccaggtcattcatctccttgtccaccggccgctaagccgaggccggagcccttgggtagggggctggtcaaatgcatggtgagggctgatgcacccagtggtaggattggatagcatgagaagtgccgggattaggttcccattaccacaaaaatcttttcatagtttaaaccacatattacagatggaaaacggacgcctacatttacttcaaacaacacagtaaagccttgtcaaaatactgaagcttttagttataggcatggcatatggcagtacactatgatagacatcctaacagtatactaaggtcatatgggaagggacaaatctcatgtatccagaccaacctggaggatgactttaatttctgatctgctttctgagtgcctgcaccactgtgcccaggctatgtagtgctgaaagcccatgaatttgcttgtgcttgctaggtacacttctagctaaactgtatccccagctttcaggtcatttttaaccaagcttttgtttttttttttgtttgtttgtttgtttgtttgtttttgaggtctggtctcaaatgcatcccaggctggccttgaacttttaatcctcctatttcctcatgctgagattacaggtaggcaccaccatgcttgatattatgtgctgttagggatgaccccaggacctcatgcgtgctaggcaagctttctaccagtgagctacattttaagaccttaatgaacgtttaagccttgccaagccacttagcagccacataactttgggtgattaacttaccccttagcttacaaacttcataacacagcttctgatacaacagcccgttgaataaataaaataagatctcctaagaatatcccagtaagtattaccattggtggcatcacatatagtgatcatttcatttagagatgacccttaactcaaatttcatacttcctattctatgtgtgttctgtcgaaatttgtgagcagagttctttgggtatagggagattgctagaccactaatttttctgttataggggcaaatagactgaaaatgcaaatgtattatttaccagggacagtgatcattctaacctgcaagagagactgccctcccttgccatccaaaccttttgtcagcacttggcaggtgacttgaaagataatttatattttcatcctcaaaagccattgtgaatgtgttcacatgtagcttgatggtgtttggtgttttgttttgttattttccccagaatcttatggaagctaattggattctcaagaagacttatgcaagtggaatggtgtcaccccagtgaatcaatattgttgtttaccctggtgccgagacttaggaaagcgccttctgttttcttgttgggtcaaagacaaggactctcaaccatgccagaaatagaagcaagtgtgagagatagtgaattattttcaccaccctctgacgttcgaggaatgagagaacttgatagaacagcttttaagaagacagtgtccatccctgtgcttaaagcgaggaaagaagtagtcaacagattgatgcgagccctcaggagagtagccctgcagcgcccgggcataaagcgagtgattgaggatcccaaggatgaagacagtaggctgatcatgttggacccctacaggatgcttactgctgattcctttgacaaagcagaactcggagttttaaaagaacttgatgtcagcccacagttatcccagtacaacttggaactaacatatgaaaattttaagtcagaagaaattttgaaagctgtgcttcctgaaggtcaagatgtaacctctggattcagcagggttgggcatattgcacacctgaatctccgagatcaccagctgcccttcaagcatttaattggtaggtggattacagtcagattnnnnnnnnnnnnnnnnnnnncacacacacacacacactctctctctctctctctctctctctctctctctctctctccaaccacttttgttatattgaacaaaatccttttggtccaaaaagccattaggcctttgggacattggtcagtacaaggttttgaaatttggtgtttcagagtcacatatacaatgctagtgacttagctagtaatttagctaattaagcctcttctttatggtaaacactttaaaactttcttaagtgctcctagccttttagaaactgctatgtacaccctactattgtagctccagggaaacccacagcctttattatttggatagaaggataatcaaaatcacattttatataaatacttggtatacatgcattctgtaggttactctttttaatacagtaattttcaaaacatgtgggaattattcccagctttaaaatgtagcattcagtattttgcatcgattggacttgataatgcccttctgcttcctctctcttcattgacaaaagacattaatactgcacagtggggactcagctcagggtcatatgtgggctttcatataataccctaacttaaaactatgtttctcctaaaatggtggtggtgcataagggttaaaagtgaaacatttctggctggggacatagctcagctgccataccaagtccaaagccctacggctttcctatggaattatagaaatgcttttaatgttttaaaattttatttaaaactaacttttatgtcttagaagtaagtgaaaggcaacccatccatgaatatatgggacacaaagttgggtgggtagggaagtcgagtgcatctgggaggagttgggggaacaggttcatagcttcaaaaagttttaattgagttcagatatgataagtagaacacaataaggcagccattgattattttacatattctgaattctgataatctcattgtatttcatcaaatttatattcagtacatttttctaacttaaagatgaagttctttctttatgaaatgagaacatagatctctataaaatttccaagtgttgacaaaaagatagagacttaattaaagattttaacagtaagtcatttctgatgtatattattgtctttgtagcctttctgctaggataaatgtttgactaaatgaccaatttaagtagaagaacatttttaatttaggtcagcctctgaagaacctttgtctccttggctgtaaacattgcttgctgatacacatccctaaactgtaggcatgtgcttcagacccacagcaaaagaaacctttggtgtgaagccagcagaacaagcatatggctttcttcgctttctagcgtttctggggccatttgttgtcagggtcttcacagcttctcattccattgtcagtttcatatggtcgacccttttgcttctatttgaataagtttaaagaaaatgaggaaaaacaatagaccacaagccctcaaaaatttgctttaaagatatccataaattttctgtatgtactttaattttagaattgtgggtagaattacacataccgagtacagtttttatttgtaaaccaaaagaaaatgtaattcgtttatgttaaattgtttagttttcatttcacagtcatgaattttcaccttttaggccaagttatggttgacaaaaacccaggaatcacctcagcagtaaataaaaccagcaacattgacaatacgtaccgaaatttccaaatggaagtgctgtgtggagaggaaaatatgctgaccaaggtactgccctgtttaccaattccaagagaacagcaggactgatgcttagaatcaggacaggacatattcataatatggctgcaatgtagtgtgcgactctgagcaacttatgctcacagagactataagaggatttggttgaattctgctaaaatgatatattgaaacagtccttcattaaaaagtttttagctctatgtattgaaataaattgcccatggacaggtgacagaataagccatggaacagtgtgcaaaatattcataaaacacttcacctgccaggctatgcctagggcacttacgtttccagcactggcctgaacatccttttcagtcagagggaagatacgtacctcagtgaaattaaggccccaggaaacaaaagaaagaggtatcagatttgtgtaagttaggaactttctggtctttgattctttattcataaaacgagggacttgatatgtctaatttatagacatgaaatgggcaagattttagtaattgtctcaaaacattgagtatctcaaattctaatgatgcttcaattatgtctcccttttgcaacctgaatgctgtggagagccacttgcttgatgtgtggaagggttctgtttttcctgttgtttgctttctctacatggtgacataaagccagttagttggcctttctgcaaaattccttatgtgaattggaatcagttttaagaccctttagaatgtgaacaactgttttactttggagagctgacttttctcatgaaaaagggttgaatacaagatacatactggtcccagaaatggtataaagaccaggattctaatcaaaatgtttttaagtgaagttatttgctcctatgatacatgtatgctctcatgcgtacataacctatccagtttcagtggacagactttaaatctagtacgattaactaaaaacatgaaaccctttttaggttcgagaaaacaactacacgtatgagtttgatttctctaaagtctactggaatcctcgtctctctactgaacatggccggatcactgaacttctcaaccctggagatgtcttgtttgatgtttttgctggggttgggccctttgccattccagcagcaaggaaaaactgcacagtgtttgccaatgatctcaatcctgagtcccataaatggctgttgcacaattgtaaactgaataaagttgaccagaaagtgaaagtctttaacatggatggaaaagacttcatccaagggccagtcagagaagagttaatgcttcggctaggattgtcagctgaagctaaaccctctgtccacattgtcatgaacttgccagctaaggccatagagtttctcagtgttttcagatcacttttggatgggcagccttgcagcacggagctcctccccacagtgcactgttactgcttctccaaagatagcgatcctgctaaggatgttcgtcagcaggcggaagctgtgctgggcgtttccttggagaccagtagttcagttcatctcgtaaggaatgtggcccctaacaaggagatgctgtgcatcaccttccagattcccactgctacactctacaggaaccaaagcctcagtctacgtgagttcttcacaatgaagtgtggagtatactacccttaacatagcttgtgagttatggtgtgtgtgtgtgtgtgtgttcttggaagtgtgcatttatttgtaagtagggaaattaaactagttccagccattttgtttgtgacccccttgccacttagcttagaatatttgaacttttagcaaggaatgtggtttagtcaaatagaaggcttgttctgttaaaacaataaatccatagtagtatgtatcaaattgaaagaataaaaacaaatcctaaaatcttttctaaaaaagtgtatggaactgttaaaagtgctctaaagtgggttttctgaatttgttacagagaatgaccaagaaccacctcttaaacggcagaagacaggtgacccgttctcaggagaaccacagatcgcatcagattcttagtttgaaatgttttctccatctccccagtagactttatgtaaagaagtacaatttgtaagaggtaaactctaccacacagatatttgttactaaacacttacgatttgctcttataaatggaacattaccaaagtaaactgaaataagaggaacttggatattgtatagactgattttttgtttccatccatttttcctttcttttttattattttttgtggcaggatctgtgtaactcagggcttagaactctatcttcctgcttcagcctcccagctgttggcatttccagcgtgcaccgctgttattcagcatagttttaaaacagaatcggcatgggccagtcagaccagtcagatggctcactgggtgaaggcacttgctgccaagcctgatagcctgagcctgcctaggaacaacgtggaaaggaagaaatcctgaaagtcttcttctgacctcatgcgtgcaccaaggtactcatgtatacacttgcacaaaataagcgaacaaattaataaacttggaaatttatgtaaggattttgtaattcaaggtatttctatttttattagataaatgttcttttaatagtgtctatcccttagaaagatagttgttgaagacagagtaattctattctgcttaactaggaaggtatttaattacattgtagttaccagtggaagaatgtaattatataacttctctgtaaaaataatacaaaattaaatcatgtagatgatgcattagaaaaggacagcttccaggccaagtctggacataatggtctagagtgtgaaggcacctttaatgtaaaggtgccatagtttcatacaactgacatttgaatcaaaatatcctaatttatacacttcacactatcaaaaattaaaacattttggactttggacgcaaactcctcagtcagtcccacaacacccagaggaagatctactcccaggcactccaacatgcccaggaccacaggatcagaggtgaagaggacataacatctgccccaacaccggaagtaactgggaccaacagaacccaggtacccaggaactccaccaggccagtgagacaggttctgtcctgtctgggccagtgccctgagcagaccttgggtgcgacctcttgtagccagtcctataacacagaagaaactcaactcccaggtgctctaacacgcccaggatcccaggatcctaggagcttggtcacactaggatctcggggtcccagaggcagcttgactcccaggagctctgacacacccaggatctcaggatcccagagacagctgaactctgaggaattctgacacaaccaggatcccaaggacgggctccagtcagatatagctagggcaggtagcattaaaggtaatcagatggcaggaggcaagcatgagaacataagcaacagaaaccaaggttacttggcatcatcagaacccaattcttccaccatagcaagtcctggatacaccacactggacctagatcaattctcatgatgctcatgatgagtttacatccttctttaagaaggacgtaaataactcccttaaagaaatacagaacataggtaaacagctagaagcccttaaagaggaaacacaaaaatcccttaaagaattacaggaaaacacaaacaggcaaaggaaatgaataaaaccatccaaggatctaaaaatggaaatagaaacaataaagaaatcacaaagggagacaaccctggagttagaaaacttaggaaagagatcaggagtcatagatgcaagcatcatcaacaggatacaagagaagagagaatctcaggtgcagaagataccatagaaaacattgatacaacaatcaaagaaaaggcaaaaggcaaaaagctcctaacccaaaatatccaggaaatccaggacacaatgagaagaccaaacctaaggataataggtgtagaagagagcaaagattcccaacttaaaggaccagtaaatatcttcaacaaaattatagaagaaaacttccctaacccaaagaaagagatgcccatgaacacacaagaagcctacagaacttgaaatacactggaccaaaaaagaaactcttcccatcacataatcatcaaaacaccaaaatgcactaaacaaagaaaggttattaaaagtagtaagggagggctggtgagatggctcagtgggttagagcacccgactgctcttccgatggtccagagttcaaatcccagcaaccacatggtggctcacaaccatccgtaacaagatctgactccctcttctggagtgtctgaagacagctacagtgtacttacatataataaataaataaatctttaaaaaaaaaaaaaaaaaaaaaaaaagtagtaagggaaaaagatcaagtaacaaagacagacatatcagaattacaccagacttctcaccagagactatgaaagctagaagatcctgggcagatgtcatagaaaccctaagagaacacaaatgccagcccaggctactatacccagcaaaactctgaattaccatagacagaggaaccaagatattccatgacaaccaaatttacacagtatctttccataaatccagccctacaaaggataatagatggaaagcatcaacacaaggaggtaaactacaacctagaaaaaaagcaatcattcaacaaacccaaaagaagatagccacacaaacataattccacctctaacaacaaaaataacaggaagtaacaatcactattccttaatatcccaacatcagtggactcaattcctcaataaaaagagactaacagactgccaatgtaaacaggacccagtattttgctgcatacaagaaacacacctcagtgacaaagacagacactacctcagagtaaaagattggaaaataattttccaagcaaatgattccaaaaaacaagctggaggacccattctaatatcaaataagttcaactttcaaccaaaagttatcaaaagggataaggaaggacacttcatactggacaagggtaaaatctaccaagatgaactgttaattctgaacattcatcctccaaatggaagggcacccacattcataaaagaatctttaataaaagcttaaagcacacatcgcaccccacacaataatagtgggaaacttcaataccccactctcagcaatgctcagatcatggaaacagaaactaaacagatacactgaaactaacaagttatgaaccaaatggatctagcatatatattaaaatcatgttctacaaacatcatggaaatattaatgataatttttctcactgtgcttgaaattagcattttcttaatgcttaacttcaaagagtttttactattttgaaatttttaaaatatacttataaaataatttctctcctagaaacactgataatcttttaaaagtaaacttataattagacaatgaacatagatatataatgtgttttaagtactttctcagtatgtcaagtggtatcataagggcttttgaatatatttgttagtgattcatttttaatattttacgcttttattatgcttaattcccaaagaatatttattatgtttgaaaacaatttagtattcaacattagatataggatcctcagttatgcatactattaaatattcattaatgatatttttagggtatgaagggatatgaatacaaaatttgaacaaaatttttaagtattatttgattctccaaatactcattaatgtttgatatataaaatgcatttaaataataaaaaaaaattttgaaaaaaaaaaaaagaaaatgtttctatcctcccagaaattagcagtagctgtcttttcaaagttccatatttggggtattagtacaagtgccaaggaaatgcttcctcaccaaactatttagtgaagttaaggcacttcaacttataaaattcatgtgcaaatatgaggaaaataatcctctcaaaaatgccttcctacttctcccagaagccaagattgcctaataaaaatcacagtaccaggtgtgtgggacacctcccctcaagttattgatcagagtgtgctatagactcccccaaaatagaggcttttgccgctgctgaccagaacttaataagaccctattgctagagataccacctaattttgtcctaagacatggagaaatctatctgatagcaggaagcttcctccctgctgactagcgttcatagcaccagatgatgtggtgtaggctgctgtcggtgcaggagaggtgtcaacagttttacttagaagtgaacaataatgagcaggttcgtaagataagctcaaagggtgatggtagcatgaatgttaatgggcgtaaccaacaactttctgactggggttaagtaaggcctgctccacaggaggaaaaggcttgcctggcactatatatctggctaagaaccacagttagggaactcacaggtatcaagggtaaacctattattattctgttaaacagacatcaagcgtctctaaatttccatctctatacctacagctctcagatatcagcacaaaagtttctttgtgtaatggatggtgactaaggcagaacctcaccttcactgctcaaccataaagagacatcagtatcatcaccaccactaccacccctacaaggctcaggaaccatcacagaagagggagcaagaagattttaagagccagagatcagaagggactagagttcccgaaagtgctctgaaaatgacaggaccactgcactcataaactcatggcatgtgtggctgcttgtacaaaataaagctggtaaacatcctaagacagggaggggtagcttttaaaggatgagcccctggaatgtcaaccatgctccagtggatgatcccacccccaggaatatatggccaaaagatgcaaacttgggaggggtgagaagggaggggtgggtctgggaagaataatgaggaaaatatgatcaaaatgtgttctatgaatctctcaaaagtgtcttccaagttatggatatgcttgggtaatgttctagtttcacttccgttgctgtggcagagagcaacttaagggaaaaaggggtttatttcagctaatactttgagaccatagtccatcactgtgaagaagtcagggcaagaacatcctctatctgagcagaaaggaatgaatgcatatgtatacttgctcacattcaccctgattgccacttagctcaggacctctagttggcaatggtgctgcccacagcagcctgggacttccttccccccacagacacgcccacaggccaactcaacagacagacattcttcctacgtgatatgcttctaggttgtcaagttgataaaaatgaaaactaaccatcatatttgatatcatatgtttatggactgagaccaatatttggtagaatttgactattaaataatcagaattcaaattaaagatattaccataaaaattgtgcttattacatcttgacttttatcaataaaattacagcaagttgcttaatctcatgatgtaagtatcccatcatgctcttaagtttgtcacttggcctgaatggcctaaactatctactaagtgacctctgatctagaacactgactgccagcttcagaggcttggcagggaaatgtaaactagcgaagccggcagtggtagtggtgagaagcacagggaggtggtgagtgaaaatgcagggaggacagcaacagcccagggatgtagtgagctacagcccagcttttctatctaaaagcatttatacacaagtcgttttgaaacaacccaagtaatgtacactgatactggctatgaggcacaaatgatgtagttatctactctaaataaggctgtaagaactgtctccatgtagtcatcctctaatacataaacagtaggattataagtgaatacttacatgcctttctaaatgctgcggggctccctcctctttcatgtagagtttgagtagagaactgatgacttaagtgtagggccaccctaaccttaactgaagattcctagaacatggatttttgatgaatccagtagaaaatgtgagctgggatgtgcattgatatacagtgtttaaattctgagactcttcttgagtcatgagccaaggccaccactcgtgcattttgtgatgtatgtgtattccagactattattattatttgcttaaagcaagtcatcttctatgtaatgaactatagaactcttagggtatcaatgagatcatctattgaccatcatttatatcccacagggttagacccttgctctgtaaaacttccttgaggtctttttgaaatgggattaccaagtcacctctggagcatggctgctggagccttggcactggagtttaactcctggctctaaggcttttaagttattgtacttaaaatgcaataactctctgctcctggcaggttactggacacctctatctgctagaacacgggagacgggaacgggattgtttgtaaggattagaaaacacaggaagcatgaagcccagtgcctggcacaaaagccatacaacggctatttctgtactagtgctagaggagatacttatgtagaggaaagacttgcacactgtctctaggaggacatcactgggagggtgagaaagaagtacaggatttagtttagaatatggccatttttcagtgacatgctctttctccatttcatttaatccaacagagtaggtaaagatttctaagtcagatgcaaaacaaagcttgagttttattaattagttcatgaattgtaggtatattgatttctgtccacgagtgcagcaaagccctagccgtgggctcattttcatcacttcttcatcagatttacagattgaatacagaagcgtgaactaccaattagcaaaaacctaactaacataaggaatactacatgctcactccatagtggatttagattaagaagtaacttgacctaattctagctttttactaatttacatatatattcttggcatattcaacttcttggttttctcatttatcaaagatgagaagtgtgacttctagcaaggaaggttggtcccacaagatgcactgaaatggatccccacccaataaagatggtattgttacatatgactattaacactaacataaccagagatttgattcatttaactctatgtccataaagttagcatttgttgtgacagaaatttgatagaatatcctttaatttcctggaaaagcctatgttccatacccaggggcccacgcgacagactcacacaggctgggatgctcatgcttctgaccaacacacacccaaactacacaaaaccacaagcacagtaaaatcccttgaagctttggtgggtggaaaactacatcagtctataatttatgcagagaaatttcacttacatggtaccttttccagtctcaacatctcatcataaaatgagctcacattagcagtgaaaggtgccattgatgtattaagttttattagctcacatctttgaatctgccattaaagcaggttaatggcctgctctggtttatcatttctgtggctcacagctgggaaccacattaggtttgcctcactttgcatggctcaaaacagtcccccagactcttactgctgaggaagagccacatcacagttgtgctttcttgacacggcctgctgctaagatgaaacatctccacttgtctgtaccactatcaatacgacattaaggggaaaaagaagtttttatagggaaaatatagacttggataatagcactgaatgttataatcaaaaaggcatttggaaatatgttgcagaaaaacacaaggaggaggaggaagaaaaaaaaatcccacaaaaatgtaccataaagtcaggctttattttttataaaatgtgtaagtcaactccaaacataggcaaatcatttatttcttttctgtcagatgaggtttaatgttcttcatccctgtctaaagaacagaagtaaaaaataaacctcttccatgaatctatatgcaacacatttctcagcttggtccagactgcaataaacacctgagcacagcagcagtgggtggtgtgctgtgcagctgcggggctggaactttacaaacctctatactttcaaaccccttggtttggctccacaatccagatcttatacatgagaaaatacaggttatctgggctgccagaagagcccactgaacgcatcctgtagcgctactgtgacaagcaagagaagaagtatagccgccagcaagatcctgtggagatgcagcccggacgtggtttaaatacctgaaagaaaacaaaaagtacaccattgatttgaagaccgtaagccagtgacattctgcaaagcaagtgtaaaactgattctacatttggaaaggaattccgagattgaaatgttcaggttcacacacacatatatatggattgcccaactactactaagttacaaaggacaatgaattctaagaatagtccttataacctgtacatttggatgaaatgttaaaatatccactctttcaccatttccagtactgattcgtttttttggaagctatttagacatccagcgaatactgtcctttccagcacgcacactattatgctactaacatttctacgaaagctttttttgttgttgttttgttttgttttgtttccgtttttccagacaaggtttctctgtgtagccctggctgtcctggaactcactctgtagaccaggctggcctggaactcagaaatccacctgtctctgcctcccaagtgctgggattaaaggtgtgcaccaccactgccccactgcccggctttacaaaagcattttaaagcaaaaccttacatacggaaaacaagcacactcaggaagagagcacacagtagttcacagtcacctcggtatcccagaagcatactgtctctgtccttgcaaggacaggaaccttagaaagtacacgtctaagaagtgtgggacagagcctaagctgagaacaatgacctgaagagtcatagagtcctaagtacagaaggacaaacccatctcaaaaggcagaacaacaatgtttcttcagtctcagcttttttaccaatgaaaaattaatgccttcataaaaatagatacaacaggcctaaaaactcagaggatctcagccgaggactgacttgtcagccagacagctgcactgcaggaaagaataattccagccttgctttaatgcctctgcaggaagccacacgggccctggaaacaaagctccttcgcccactttcagaattacaggtacgataaatgaataaatcaggaagcaggacattttaatagcttggaaccttttctacttattcattcaaacttcctgtgtgtcaagatcttaatgcatgagcaacttcctatttctaacataataacaagtcagttttttgtttgtgcatatgttttaataagcttgtatgattaagacatgtatggcaacttaagggaccaaatagaagacgctgtcaaaatgagacaggtcaaactcctggaattggctataatttattcacactgccacaaatcatggtcttaactcaaatctttgcttttctgccaaggggtaaaagtcaaaggagaaagaaataaatgtttattgagcaaaaatttaaaactatttgggtagtatatttatagcatacaagttatttgtacatctaccctcaaagcttatttataaattataacaaatattagtaatggatactctatatcatactacaggatcatatgaaatgtatagaaatgaaaacctgaagagataaaatgaagcatgaatcatgccatgctacccgcctctgaggatgcatccgacttcagaaactgttaggtgtcgctgatgagctccaggtagagccttaagtctcacaggagctggacaggaatggactgaatctacacataactacaatgttattttcttattactctcccagagcacaataaaatgccagctgttaggattctgctggttagggcagggtatggtaatgcttgcctttaatctcagcactcaagaggcagaggcaagcagatctctgagtttgaggc

SEQ ID NO: 596 - DNA, 1658 bp, Mus musculus
gaatcttatggaagctaattggattctcaagaagacttatgcaagtggaatggtgtcaccccagtgaatcaatattgttgtttaccctggtgccgagacttaggaaagcgccttctgttttcttgttgggtcaaagacaaggactctcaaccatgccagaaatagaagcaagtgtgagagatagtgaattattttcaccaccctctgacgttcgaggaatgagagaacttgatagaacagcttttaagaagacagtgtccatccctgtgcttaaagcgaggaaagaagtagtcaacagattgatgcgagccctcaggagagtagccctgcagcgcccgggcataaagcgagtgattgaggatcccaaggatgaagacagtaggctgatcatgttggacccctacaggatgcttactgctgattcctttgacaaagcagaactcggagttttaaaagaacttgatgtcagcccacagttatcccagtacaacttggaactaacatatgaaaattttaagtcagaagaaattttgaaagctgtgcttcctgaaggtcaagatgtaacctctggattcagcagggttgggcatattgcacacctgaatctccgagatcaccagctgcccttcaagcatttaattggccaagttatggttgacaaaaacccaggaatcacctcagcagtaaataaaaccagcaacattgacaatacgtaccgaaatttccaaatggaagtgctgtgtggagaggaaaatatgctgaccaaggttcgagaaaacaactacacgtatgagtttgatttctctaaagtctactggaatcctcgtctctctactgaacatggccggatcactgaacttctcaaccctggagatgtcttgtttgatgtttttgctggggttgggccctttgccattccagcagcaaggaaaaactgcacagtgtttgccaatgatctcaatcctgagtcccataaatggctgttgcacaattgtaaactgaataaagttgaccagaaagtgaaagtctttaacatggatggaaaagacttcatccaagggccagtcagagaagagttaatgcttcggctaggattgtcagctgaagctaaaccctctgtccacattgtcatgaacttgccagctaaggccatagagtttctcagtgttttcagatcacttttggatgggcagccttgcagcacggagctcctccccacagtgcactgttactgcttctccaaagatagcgatcctgctaaggatgttcgtcagcaggcggaagctgtgctgggcgtttccttggagaccagtagttcagttcatctcgtaaggaatgtggcccctaacaaggagatgctgtgcatcaccttccagattcccactgctacactctacaggaaccaaagcctcagtctacagaatgaccaagaaccacctcttaaacggcagaagacaggtgacccgttctcaggagaaccacagatcgcatcagattcttagtttgaaatgttttctccatctccccagtagactttatgtaaagaagtacaatttgtaagaggtaaactctaccacacagatatttgttactaaacacttacgatttgctcttataaatggaacattaccaaagtaaactgaaataagaggaacttg

SEQ ID NO: 597 - protein, 499 aa, Mus musculus
ILWKLIGFSRRLMQVEWCHPSESILLFTLVPRLRKAPSVFLLGQRQGLSTMPEIEASVRDSELFSPPSDVRGMRELDRTAFKKTVSIPVLKARKEVVNRLMRALRRVALQRPGIKRVIEDPKDEDSRLIMLDPYRMLTADSFDKAELGVLKELDVSPQLSQYNLELTYENFKSEEILKAVLPEGQDVTSGFSRVGHIAHLNLRDHQLPFKHLIGQVMVDKNPGITSAVNKTSNIDNTYRNFQMEVLCGEENMLTKVRENNYTYEFDFSKVYWNPRLSTEHGRITELLNPGDVLFDVFAGVGPFAIPAARKNCTVFANDLNPESHKWLLHNCKLNKVDQKVKVFNMDGKDFIQGPVREELMLRLGLSAEAKPSVHIVMNLPAKAIEFLSVFRSLLDGQPCSTELLPTVHCYCFSKDSDPAKDVRQQAEAVLGVSLETSSSVHLVRNVAPNKEMLCITFQIPTATLYRNQSLSLQNDQEPPLKRQKTGDPFSGEPQIASDS

SEQ ID NO: 598 - DNA, 26047 bp, Homo sapiens
ttttgatggtggtaatagtaactgaagatgggtggtagcaattaaatgagaaaattatcagattattaattttttggccaggcacgatggctcatgcctgtaatcccaagcactctgggaggtcaaggcaggaggattgcttgagctggtgttggaaaacagcctaggcatcgtggtaagagcccatctctgcaaaaaattaaaaaatgagccaggtgtggtgacgcacatagcctgtagtaccagctgctcaggaggctgaggttagttaggtgtggtgacgtgcatggtgatgtgtgcctgtgattaccagctacccggaaggctgaggcaggaggtcgaggctgcagtgagctatgttcacgccactacattccagcctgggccacacagcaagacactatctcgaaaaaaaattttttttgaagtgaagggaacagtatggcatggattgaacatgcaggatgaggggaaaaaggggagatacagaataacttaaagatctttggcctaagcaattagaagaaagacattaccatttacttagatgggaacagtagaaagtgtagattggtagtataaagatggggagttttacaaatctgagctgttagacatccaagtggagatgtcacggaggcagctggagatgagactgaaattcaggggagagttccaggccagggatataaatttcagaatcaccatgagcccgataatgagtgtaaaagaaaagagatcactcacacctgtaatcccagcactttgggaggacaaggtgggtggatcacttgaagccagaagtttgagaccagcctggccaacatggcaaaaccctgtttctactaaaaatacaaaacttatctgggtgtggtggcacacatctataatcccacctactcagacggctgaggcaggagaatcgcttgaaccctgcaggacggaggttacagtgagccaaaatcacaccattgcattccagcctgggtgacagagtgagactctgtctcaaaaaaaaaagaaaagaagggaaaagaaaagagatcagaggaatagtcccaggggtacaccaatgtttagaggatggggagattaagagaattcaacagaagagaaaaggagtgtttgatgaaacaggaagaactaggaaagcgtgacttgtctttcagagagcaaggagttatcagctctgtcacatgctgctgactgagaactgatcattggatttagcaatgtggaagtcactgctacaacagtttcagtggaaaagcctgataggagtgggaggagaggaactggagacatctggtttagataattctttttctttttggagacagggtttcactcccgtcccccaggctgaagtgcaacagcatgatctcagctcactgcaacctctgcctccctggctcaagtgattctcctgcctcagctgccccagtagctaggactacaggctcatgtcacctcacacaaatttttgtatttttttttgtagagatggggtttcaccatgttgcccaggctggtctcaaactcctgacttcaagtgatcctcctgggtctgcctcccgaagtgctaggattacgggcatgagacaccacacctggcctggtttagacaattattttatggagtgctgtcatgaagacatgaggcatattcaaaagatgcaaagtaaaagagatttttatgatgacagaaattagactatttgtaaaatgataggaaggaaatggtagaaaagggccaagaaataagaaagaagggagaaagtggctggagtgatgtaggcaagagcaggtgggatcatagcacaagttggggggtaggccttagaaataaacacaaagaattcatcccaaggaacagagtatataggcacagataaataagtggtggcaagagcttataaaattcttttatgattgcttctattttttcagtgaaacagaaagcgaagaatatcagttatgggtgaaatcaaagaaaaaagtgtcgaaggtttgacaggagaagatataaaaaagcaatctcctagatagcagatgaatgagctaaatgaagtgatgaaccaaagaagtgaaccagaattgtgtgatagcatcataggtacactagacgttgaattatagtgatatcagtctgcatggttgtgcttttcctcaggaagattcaaatgcatgggtgcaaatgtgaagcaggcagagttatatttaactatggttggaattttaccagggaaatatgatggttcaagggataggcaagggattaaataacatactacaaaacctcaactggataaagagggaagtaagaatgagtgtggggggtcagtgcaaaggtggtagaatcaatgaattgatagaagtcttggtaggggtgaaaactgtcagagttgaagtacttgagagggtgagttagaaacaaaggagatggtggtggcagatgggcagatactaacaaatgctattttggtaatgacaagatcagtggtatgaccataggagaaaataagtggccagtgtaggtagagaatatgatcattagagaagaagaggttcaggaactgaaagcattagaaggattagctacatgcatattgaaatcatccagaattataacaggggtaatactgaagagaactaaaaggtgagtagaagctaaaatttagctaaaactttcatgaaatgacaggaaatggtctaggagtctatagatgacaatagtaaggagagccgtagatggtatacattcatgagattaaaagctggggggttcaaggagaggaagatggttgagaagcagaaatgtgggacaaacaggacacctataccatcttcaaattagtatgagagacataaagagaaaagactgaccacttgagagaactacagggaagcctcagaggaggttctcgtagtgtaagaaacagacagaaatgttcagaagagaattagagacatgtgagttttgctgatgattgactgtgagttccagagagcacagtggaagggtttcaggagttagagagcagtggaagacgaggtcagaaacagatgacagccatatgggatgagtctgagaaatgaaagataacctaatatacttgaaatgactaacacaaattgagatagatggtataatgtcataatccaaatggtctcaaggcaaataatggtgacaatccagtgagtagtagggatcaacgactagggagttgtggttcggccagaggtatgcagagttctaggactctcactctctccagttgacagtgacatggaagccagtggaggggagctgtgggtttagtatcagagcatgagaagtattccaaaagaatggcaacgaaccaactatttctgagatagtagtgtgtacaacaccctgcaatctttagggatttttgccccagtgggcatttttgccccagggagcactcatttgccaaggacttgacatttcatatacattattttatttcactctcagaacaattccaagaaggaagtgttatcattgccattttacagatgacaaacgaaggctagagagaataaggttctttacattccacctcagctcccatgaaaagtcctgatagaccccaaacgctccataaaatctaaagtagaatttcatgtgaagaaatcctttacttttataaagatgaaaatttctctttaccctttaccaccagcaaataaatgaagaagttatttcataaaaactcatgatagctctttctcttaccaatgaattcaatctgagcataataatcctttatgacagtccaacaaactgttgggagagagttagttacgtattatactctagtctttatatatgaatgtatgtattgaaaaaaaaaaaaaaaaggaaaagcctacctccacagagaattttacaaagattgaaggaattcaatcaacggaagacaggtgagtcaatgtgcaggcagaaccatgaagtagttagttcatgggcccaagtaggctacagaaatcaaagaaaaagaaaaaagaaagagaaacagatatattcacttcatacgccccagagttacagaaaagaacaaacacagtgtcagaatcttaaagttaaatacatgtgaaccgaaggagtaaaaaattaaaattacttagaaatctccacacactgaatactactcccacataaccgaaataaaacattttacttaaattaaaactaaaatgaagttttaaaatgaagcttgaaagacataattgccacatagttgactaaagtattaatcttttaacagaatgaattgaaagaatctaccaagatgttaaagtatcacaattaagtaaaatttttttcacattcagcaaaatttcaatacatgcaattaaaattcaagtttcagcaggatttacaaatatatttatctaaagctattattcctaaattcaggatgcttttatgaacaacctgttactttaggattaatatttgtactgcttcctagtattttcatctgtctgcacattcacccaagccccttgagagcaaaggcgtgcactggatggccaaagcactgttagaagttgtggctataaactatgaatcctaaactagatttgcataagaatcacttggaggacttgttaaaaacatatctggcactggctggccaaagcactggtacaagttagagctataaactatggatcctaaactggttttgccttgttaaaaacatattcttgagtctcacctcagatttttgaaattagaatccctgaggcttagagctctctgtgtataaaaagatctatgagtatttctgatgatggacaggttttaggaaaacaaactagagcagtggcttcagaattattctgaagagtcttaaaattcttaagaaacatcactgggcttcactcacctgtttcagcacagaatagtctcactgatatagtttggtttgtcagacccctccaaatctcatgttgaaatcagatccccagtgttggaggtagggccaaaggggaggtgtttgggccctggggccagatccctcatgaatggcttggtgccttccttggggtaatgagtgagttttcacttttattagtttcatgagagctggttgttaaaaagaacctggcatgcccctcctctctcgcttcctctcttgccatgtgatctctgcatatcctagctccccttcaccttccacaatgaatgaaagcagcctgagccccttactagatgcagatggagcagaaaagcccctcataagaagggccatgcttcttgcagagcctgtagaactatgagcaaaataaacctcttttatttataaattatgcagcctcaggtattcttttatagaaacactaaatgaattaagaaatccatttttatctattttgtgtatctacttttcttcttaaaatctgaacatcacaaggccagataaagcaaaacgaactcatccatataagaattaaacccatgattttggcatcaaagctgacctaatccaaagacaaaagagactagacagataaaaagaccaggactgatgaacatagaatatttgttaatgacaaaaggaaaatcttagaaaagcacttctataattcatatacttttatttactggatcctaaaagaacttattcaatacatgactgaattgcataataaaattccaaatgggaaaaagtatatacacaaatatattgaattaactgcacatacttatttctcttaggaaaaaactaccctattctagacttgcaattaaaaatacaaaatgtgtctaaataaattaaagctttgtgaccttacttcctacaatcctaattctgccatccctacctctgactagcaggcagatgggggcagggaaggcaacagtagctctgagaaggtgttctctccttgagaaaatgatttctccataagcataaggtttggatcctttgaacaccttttagaccctcccatgatctactctactccagaaaattaggttgtgttgtggaggaaagcaggtaaaaatgctaattacctcctcccatcctgtgcttggatattcccccacagtattgggtctgtatatcctggtttttcaaattctccattccgatcaccctatctaataaaaatgtatgctcactggatattagatttgagacatccaattctatatgtagatacaaactcaagagactcctttattaaatgaagcagcataacatttttactcacctgtctgaatacacatactaagcagaagatggactgagtaagaagccaggagagcaactgtcagcagcaagaagctaaaacataaaagaacacctggtcaaaacctcccaaaagtttgtcttttgtatggtgtctcattacaaaaacaaattgcttaacagtcaaatattcacaggaactatctctgagtagtagaattatgttcattaaggaaattaagaagatacttttctacttttttgtatttaccaattttatttaaatgaaaatatactgattttaaaataaaaaaaaataaaaaccaaacttttttaaaaatacaagcaaacttcctcattttgcagtcttgtctgctgactgctgaatcagccattaaataatcttgtaatatttcctttttatgactggttttcttcttattttaagtctaaacagaagttttacttatgcaatctcattgtcttctctttttcccttcctccctctacttccagtgatattgacctccttatcataccttcatcttattaaggtgtacttaagatttatttaggctgtattttctagcatctattaaacgcacacactctccaaaccaaactaaattaaaataatgtagttaacacacctctaatgatgcaatttgaaaaatgtgcaaacaatgtaatgattgaggtcctctcaccaacagtgtgaaagaaaaaacttagataatttcctattcatttttaggaagacaccagcaggacaagcttctatacagctatccccagtgaactgccccagtcattgaagaaattttctctctgtggtccagttaatacttgttaataaataaaattgagaggtaaaagtacaaatgtcattaaactgacatcaggaacttcacaaaataacactttagcatcaccaaaaatgatggttgctatgactgggtgagcacacattcagcagtatatatctgcatgtaagaccctggtgcataaattatgatttttcaaagagaatcaaaaaacaagtcctctgactatgtcttgcttaaggtgtcacatatagtttttaattttaaaaataatgaaagtttgtgagtacattccataataaaagcaagttgggttacttaaaagttgctttgcttatcaaaaaatttggaataaaagcaggaaataaacataaaagagactccctaggcattttaaatttcctagtaaatagatctgcttctactgacaaagccaatttgttaattcattctattagccatgtggtgctagatgctaagaataaggtccagttataaaggatttttctattttttaaattttttagacaggatctcactctgtcacccaggctagagtgcagtagcccaatcatggctcactgcagcctcaacctctcaggctcaagcagtcctcccaagtagctaggactacaggcgcactccaccataccaggctaatttttgtattttgggcagagatggggtttcaccatcttgcccaggttggtctcaaactcgtgggttccagtgatccgcctgccttgacctccagttgtaaaggatttcagtttagtgggaacattaatttccaaacatatcattgtaacaattataataacagaatgaatatacaaagtactatgaaagcacagaatatccaggattgtcttctattttgggcaaactggcctacaagctaagtcctgaaacataaaaaagaacaggcacaaaacacatgtctggcctctgaaagtgaaataagactacttaacaatacaaagagacagcgaggaatgaaaagattatgtgttgtatttgcactcacaaaattgctatttggaagttaatctgcatggctttgattcactttggccaaggagatacaatgaatatgccactcttaagtgtcatatttcattataaatgaaatgtggatcaagttcccatttttaaaaactagtcacacttctgtgtatttaagaagctatgtagtagccctccaaggtacacactagcaacaagaataacaagaaaaatgctaaaaccccagaaataactaactagaaattgtataatagcagcttctggaatctatctctctacttctccgtatattatcaaaatggaaaaaaaaatttgatgctaaaatatgaagactcacctaaatccaaagacaccggtattagccataacataagctaagccaaggatgccacttcccatgatggcattcatcaaattaaacactgataaaccaaatgaaacacctggggatcgctgtctgtgaagttcctgtaagcacacaaatttagtagtgttaaatgtttggacggtgaagttaaaatttcgtgaagaaattccataaatgaaagattatggaaaaaagctgcaaaccaccagggtttgtatgacacactcgttgcttaaccaacactaatttcctttcctttccttcccacctcccactactgcagctccaggaatctagggtttcttaggaaaatgatttccaccagtacacaagacaggcagagttcaggaagggccatgactaaccttgtgactgcaagagatgaagataggatgggaatggagtggggagagagaggagggataaggcctcagctcatgtgattactaaagaattgctgagtcaacctgggactgctgtgggcagttgtttctcctcaattactaggactgcacaactaatctctacttatatatctaatgaattagttctaccaaactggaaggatggtcaggaatatcttgcaatgacaatattataaacagaagcaattcacgttgttctggcagtatccctgaaaacatccccctccccacaaacagcaccgggaacaaagtcctgggaacagtgtctaggactcgagttaaaaagcggagtgcccactgcacaggctttagggtcaggaacgtgctatgcacttactaccaagccacttccattctaccgctaagaatttctgtattaaaatgtttattactttccctccccccatgactaagtcggaagaggaaaatcctgtgactcttgcaaagacctcacgagactggtggagaaaataaggtgacaaaaatactaactaacagcagtgagtacataatcctagggccgctcatcccatcatgttcgcagcttccactcaacgctgcatctcttccacccgacgcttttcatcttttctttctagagtatgctaggctgctatcacgttcataactgcgccaatctcatctgaatctcggcggctgccttcagaccccatcccccagggttcaggctccagcatctcccctgtcccggtgcggtcctccttttctgggtcttatttggcaggcacttgagggaagccggagggcgtcagcgcggggaagcgaacacagcccacttacgttgcttagcaacggactcaactcttcggcctccgcttcttcaggctgctggacagagacataccagccccgctcagcgttgaagctcccccaggacgcctccatgctgctctccagctgactaccagttccatctacgagcctctacccctgccctgcgctccagtcgtcggtcgcgccagaggcggagctttgagcccggcccttccggcattccgtacttcaccagggcctggaaggagaggagcgagtcgacttgatctgatgacgcgcgccctcttcgcggcgaacagtgatgatgtcatagaagacccgcccatccacccgcgacccacatccgatcggtaccggagcgggaggtgaggggtcggctcgcggatccagctgcagagcgacgtggggaattggaatggtgctttggtgaggtggcggccgcgttaggggctaatggtccaggggaggtaccagcccgcccagggctgctctctgccatgtgctgcctgggcacagaaacatcgcgaggtcacccacccgcctaggtgctgagcttagtttcgaggttctggatagtaaggaatgtttcaaaagcctttcgccacattttactggtgggaaaaccgagacttatagtaatttatccagggtcacccagctggtcagctgctagaaccaatttgatctctgacggtgaagttagacttcgttgctttacaggattctgggacagggccctttccccttacaagtaaattctttggtattttagaagacagtgaataactgatactatgcatataacaatcagcaaagctctcgtcctcaaaatacagaagcctctagttaaaggcaggacatgtggcagtaaagcatcgaaaacaaacaacagagcaatatattaagaacacaagcaccgaagtcagtcaaaactaggttttaatccatgtttagccacttatcagctgggagactttgggtgggttaccttacgtctgagctttagtttacttatttacaaaatgagggtgcaatactgcacacctcccaagattcataatgtacataaagcatttagcgcagtatctgacacaataagcacccatgagactatcctaataaatatcaccactagtaatggtcatgtataatgactatttcatttacagatgaccatttaactcatacttcagtcttccaatcccaaatgtattatctagaaaattgtgggtgaagaggatcattgagtatggctaatggatcactaagccctctgaactgggagcagatgggttgaaggtgtaaatttaatatataccactattatctaccactaatacgacttcctgaagaagtcatcctagtctggaaaagatagtatacttcccacacatcactaaacgttttatttgtcagcatttagcccgttatttgagatagtagaatttagatttttattctcaaaagctgtcgtgtgtgaattttttttttttttttttaaggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggtacgtgtgtcatagtaatattcatgtatttgaagggaatttgcaaattgttaattttagctttaaaaattattttttttaatgccaagttacagaggcagaacattttatcatgttaactttaagctagatcttgagctacataccctcttttgagggccattttgaaatatcttctttagtcatagcaagttccaaatactggtccaggcttttgtgtacaacaatacatcagtgtagattaaacttgaatcacatgctttggcagctacattgaggagagatctttttggtacacaagacttgttaggccttcagggctatgttaaatactaggtttcataaatttgggtactttatagtcaaaagtgcaagatgtttacttatgctttcattgattcaaccaattgagcctcttctatatgtcaagcaccatactgtcctgttacacatttcttttgtttttattgatgaagggagtaataatggatagtggtaacataaatacttaagcagatccttgtaattgtgactgggtacaaatgtcaagtctaggctttcctgtgagtcactgcctaccctaactcaaacattcctctggcattcctattttataaactttctttcatagaggcactcatacattaaaagtgaaacattttcatacagtagtaattttaaagcttttactatagaccttcagaatagtttttaaaaatttataaatttcattcctcatttcaaactaaattctgtaccttaaaagttgagttcagatacatgaagcagaaagggtaagaacaatgattaattcgtttattgatactatattaaaaaacaagtatctgattatcagaaatgggacaaatgctggttgtatttcaggatattgtataattgggtactgtgtgctgatttacaaatcaagttatgcaatgagatagcatatagatttttataacttttttaaagtgctaactaaaaaaatagattcatcaaatggccatgagtatgccagttctgtagctttttttgctctgaagtaaatgaacatttaatttagataggactgtaaataatctatgtttctttttttttggaaacattgttttgctggcatatatttctaaagtgggggcatttgttccaaagccatagtaaaacagacatttggcttgaggccagtggaaccggcagatgttttactgttttctgaggccatttgttgccagggtcctttacatctctttccattctttcccaattccttgtgatctacctttttggttccttgtttattggttcatttgaaaagatttagtaaaacatggaaaaaacattaggtagacccaaactcctcaaaacgttttctttaaaaatgtacccaacattttgtgtgtgcatattagcaaccgtcagacattaactttagtcatctgttgaattttttaaattgcatgccacattacacacagtaggtgcagtctttatcaaccaaaagaaatacaactcatttctgtttcatattaacaatgttagcttttattttgcaaccaataggcagtattatggattttcattttttcttttaggccaggttatgattgacaaaaatccaggaatcacctcagcagtaaataaaataaataatattgacaatatgtaccgaaatttccaaatggaagtgctatctggagagcagaacatgatgacaaaggtatattttattatctccaagtaaggtgtatatcaatattatgtttagagtcagaatagatgacaaagatttaaaatacttgtaacatccagtgttggtgagtatgtgagaatgtgatcacttatgtatgctattgatggaataacactgataaagccttttcagaagaattggttaaattctcatatagtgatacaatggaatatttccatcattaaaggttttttagctccatatttgttaaaataagttgtccatcgataggttgacaatggacaattgccagaaagcaatataagtgacaaaaagcaagttatagaacagtatgtataaaatagttctcgagatatatttaaaccttctaggttatacccagaaagacttttagttggcagaaatttgcagaaacatttccacctctgtaaccttaataatttggccggaagcatctgatatggttgggagaaggaaaaaaaaaatacatacaaattgggaattaaggtcctggaaagcagaagatggaagatgtatctatctatgagatttatagaacttatgaactttctggcctttgattcttcatgcataaattaatgagtttaagatgatggctgaggtcatacttcatgactgtaacttaagttttattttctgttttttaaggtgtctactacaatagacccaaaagaaacattaaaaagtcttttgttcaagaattagcttcactgtatatatttagtttacccatgaaaactcaaatttgggaaagagaatctgggaatgattcattctatacactggctctaatttatagacatcaaatttgcaaagttcaagtagctgtcgaaaaacatagtaaaatacctcaaaattgagtgacacatctaccatggctcccttttacaaacacaaaactaaataaggagggaagcttgtttgctgcatagaagtactgtctgcaacttggctacccagcatgaagatatgggtggtgtgttgtttcaaaattgtaggtcttgccttgtctatctggtgacataagagtataattaagccagttaattggcctgtctgacaaattcctcatgtgatatggtaactactttatggccatggccctataggattgagatggagagccatttggctttaaagagatgactttttctcacgaataagtctaatgcagtatattaactggccttaggaatagcataaacaccaggagtctaattaaaatgcctttaaatgcactgttgtttggctcttacagtagtaaacttaaatgtgtatgtgtttgcctgtgtgtatacacaacctatccaatatcaatggttaggatttaggaccaaggaaattaaccaaaaagcataacaccttttttcaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccaggtgagcagtttctgggaaattaaatgtaaaccttgccattcaattgtaactaattcctcccagttttacaaattttaatgcagtattagttcagtctaatagaaagctactgtgttagttcagtctaatagaaggctatttcattaaaatagtaaatctgcaagaatgttatttcatgtttaagttgactagattaaaaatgcctatattgtttgtttttttaagagtattttcaactgttaatatcttacctaaaataggttttctggatttattacagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcgtttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcgcaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttacgataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtttttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaacccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagtggctgatttttggtagtccattgaagaagagagtttgaaagttgtatactgttaatgactgtctgcccatgtcctgcctgaaataccatgattgtttatggaaagtatctttaataaagctggatacagtttgaaagaaaaaaaaaagtgtggcaatttgttttagcttgttctgtaagtacctacataatatccacgattttgcttgttaccctgcaaagcctaaaatatttactatctggccctacagaaaatgtttaagaaccctaatctagatcattaattacaaattcaaatgccttcagaagtctggcaggtcatgtaaacaaatgaaggcaataaatgataagcagtatagggatgtaatgaactggaacactcattcttacttaattcaaattgttttgaaacagcccaagtattgtacactgatgtcctaggttataaagtatgtgtacaaatgatgttcttatttatacatgtaaagtggtaagactcttgtctccatttagttactctggacaaaatatgcaatatgtaattgtaaagaaaacagaactagatgtatctattaacgttttaacttccccctttcagagtggataagtgattattcattatttaaatctaggtccaccctaaactttcagatgtgatacctagtaaatgaattcctgatgaatctactagaaaatgacagctagaaagctggaaagctcattagatacaatttttaattttgttaactttttgacaggttttctaccaccttaattggattttaaaataattatctgacaacctgttgacagcctaaagacaacttctaagagaagcatagttgaaatattcattgaatcaaattaaggaatactaagtaatcatgtatactaactatgatgtaaatgtattctgtaccattaatatctgcttaagagggagtatagttattagtaaaatcattttctacatcatgaatttctcagaacttctcttaggacatcaacaagatcatttagttgatgtcatttatatctcataaaagatctagatacttgatctgtagaacctcctggaagtcttatgaagttcgactaccaggactagttttagcacagcagttgtttgacagtcatctctagagcatggcttctggagtctggctgcctgagttcaaatcccagctctgctatttttaagttatatgactgttggcaacttacctaaccactgtctcagcttcctcatctgttaaaatggggaaaatactagtagaactgttttgaggattacgtaatacacaaagcatgaagcagtgcctgggacacaggtaatacagtagttgttaattattacttctgtactcataaaatacttgaagacttaactcatgtagatgaaagatatgtacagcctttgtctctaagagtaaatcacttggatggtaggggataagcacatcaatttagaatatttctgttgtttggtaaattcagtgaattcactaaacctcagtgaattgtcactaagttatttttcaccattccctttgatcaaataaggtcagttaacttctaaatttggcctattgaacaaagtacagcaatagcaactacaaaatatttacaaatgtataaaggttttggaatttatttgccaaaccaggtgcatgcaatttccacaataaggcaggctcaaaacaagccttaaaagcctttgatatgttttattaattagttcattctttttaaaatacatttataaaaggtatgagaacaagcagtagtgtttcttttcaaaagactggattccttatttttgcaattggctgctgcaaagccttaactctacattcaatgttctaactattctttgaacagatttatagactgtacttaaaaacactaatcctcagttcggaaatacctaatagatacaggaataggatatgcagtctggtagaatgtagatggaactggactttgaaaaaaaaaacctgcattctaattctggctttttactaacttgtgaatatgatctttgtctactcaattatttgatgccttggttttctcatttaacaaagatagaagtacaataaagatgaagatgtattgctaaaattaattaataactgcttagtaaaataagatggagttgttacagatggatagtccatcctaatgtaaccacaagtcttgtttcacctaagtttctacccataaaactaacatctgttgtaatagagatttgataggaaatcccttaatttccttaagaaactatatcccatatccaatgctctatgtaacagactcatacaaggttgagatgctgcaatatcatcctattcatatctaaactctttaagcaaaaccctggtaataaaagcctttgaagtttcaacaaaaaaactgtatcagtatacaatttatacatagggaactgtacttaaaatgtaccttctccagtctccaaaggattcatcataaaatgagcttacattggaggtgaaaggtatcatttaagtattaaattttattaacttctttgaatgtgtcactaaagcaggttaatgctgggttttgttttatcctgagtgtggctcacagctgggaactataacaccttgatcaaggtttgcctcattttccactgcttaaaacaggcattgagtccttagtattgagggaatgacattatcatgggtcaggtttttcttgccataacttggtcaaaggaaatatatccacttgtctggactagtattaacaagacattaggaaaaaggggaacattttatgagaagaaataatagacttggatattaacagtaaatgttgtaatcaaaatggtatttaaaatgtgttcaagtaaaacactgtaataagagaaaaaccacagaacttaatataaattatagctttattttttaaaaagattttataagtctgtcacaacctcaaacacatataggtgaattatttattcctctcttccatcagatgaggcttatcgtgtcaaatcctctgaaaaatataagtaaaaattatttttcacaaatatatatcccctatattactcaacttagttctgaaattttctccttataaatactttaacacagctgctagtggaaggactgtgttgtgcagctgcacatagctataattttataagtctgctttacttttgctagctccctggttcagctccaaggtccaaatcttataaatggttaactgggctgccagaaaagcccactgaatgcatcctgtagtgctctgtgacaagcaagagaagaagtatagcctccagcaaggtcctgtggtgaggcagctctgacatggtttaaatacctaaaacaaaacaagaagtgtagcattgatatacaaagcaaatataaataggtaacattttaaaaagcaatagtaaaactgattcaagttttaaagaggaattccgagattgaaatattcagacttttattataaatagattattatctttcaaaaggaaacataccaactgtacatggagtgcctaaactagtattaaattacatagcaaattaccacggggtctaaaaacagttctgaaagaggtttcaaaaataattctaaaatattcactgcttcacgattttcagagctgatttgttttgttggctgttttttggacacctaactaatgctctccttcctggcatatgcttaagaaatacacagtatcacaatactattatagtactgatatttctacataaatttgttttaaagcaaaccctcaatagctaaacaaatggaagaggggagaaaacgtatgagttacttcaaaagtactttaatattccaagaatatattgtctcattccttgcaggaaaggaaacattagaaaattacatgttgaagaaatctctgagactgagcctgagttcaaaataatgtctgaaaaagtaaatacagaaaagtctcattgatctcaacaatataacagtacaatttttttctgcaaccacacagtttttttaaagcaattaaacatttatatcttgacaaaaatagacaaaacaggcctaaaaaaaattggacaatctagccaaagaagggcaacttagcatgactactaacacttctggaaacaaataattccagctttcttttaatgcttagtttaagaaactaacttgtttcttcaggaagtaaaggagcttcacccaccttagaattactggtatggcaaatgaataaatcaggtaccagaacattttaataacttggaacctttttcactcattcattcaaacttcctgtgtgtcaaaatcttaatgcatgagcaacttataacttctaacataacaagtctgtttttcatctgtatccatgtttaataaacctgtgtagctaaaacatatagagcaatataagagtccagtagaaaaaatgggtcaaggtaggatgcagctaagttcctggaattagctataatttattcacattgccacaaatcaaggttttaactcaattatttgcttctctgccaagggcgaaaggggaaagcggaaggaagaagagaatatttattgaacaaaaacaaaaacatttttgatagtattttatagccataaaacatatctcagatatgttttatgtagaatactaatgtactatatgttactatatataattatatacataagatactaatatagtcagtgtaatataaaaatataaatagaaaaaggatgaaataaaaatatttaaataaaagttctggctgggtacagtggctcacacctgtaacccagcactttggaaggccaaggtgggcggatcatctgaagtcagaagttcaagaccagcctggccaatatggcaaaaccccatctctactaaaaatacaaaaacttggctgggcgtggtggcacatgcctgtaatcccagctacccaggaggatgaggcaggagaatcacttgaacccaggaggtggaggttgcagtgagccgagatttcgccactgcactccagcctgggtgacagagcgagactccatctctaaataaattaatgaatgaatgttttaatattttctccataaactgtatcttacatatcctcatgggacacatcccactttagagactactgttattaattagtcattgttgtctgggtgtggtggcgcacacctgtgagcccagcactctgggaagccgaggcaggtggatcacctgaggacaggagtttcagaccagcctggccaacatggtgaaaccccgtctctactaaaaatagaaaaagtagccaggcacagtggcaggtgcctgtaatccagctacttgggaggcaagagaatcacttcagtccatgaggcagaggttgcagtgagcggagatcgcaccactgcactccagcctgggcaacagagtgagaccctgtttaaaaaaaaaaaagaaaaatagtcgttgttaaactcttgatagaaccttaggtcgcataggattgaaatagggattcaccacacctaccccatggccataaagttatctgcttattactttccaagacacaataaagtatcaactgttaagattctgatgcatgagaaatgaagtaaatgttaagttacctcagaaaggtctaaaaattaacctggcttcacagggaattcaataactatcatacaaataataagtgagtaatatttttataggtaacttggaaatgaaatgttccattcctgatacaagtttccagctaatttttatccgcacaccagatgataatgtatcaccctttcctttcctcagatcctcaaaagaaaagcatagtcttagcttcaatagatgttcacttatggtaaaattcaagcaccacagtagaatgtttgtcaaccttgaaaagccaaacatcataaatgagaattggttttcatagctgtaatacaaaccactgtgcaactaactgttttgattcatcacattttggtacagcttgcttctgggaaagttgagtcataccatatctggcttggcaatttgagcataaacttgcagtgtgcatacagctttttatatgttatcctgagaaacctgaaacagctgcactgctggcaggaaaacagaggaccaccagtaaaatattcaaaacagttgcatcttttaatttatggccatgtttccataaagagtatataaaacagttcagctttataggtaaaatgttataaacagtcatactccttgatgccataaatgtgtaaaaaaagttttatctaaatgattagtgcttgaaaatagtatttcttgaacatagtcataatccagagtaatgagcaaatttttaaatttgacttattaatgctaagttgtacaattctcactgccaaaaccaagtcaattaaaatttctttgcatagcactgaagaaaatgcccttcccttctagcaatcatttacattaaacatgtctgtgagtatgagtcgttgagagtcctgcttatttactttgctgtttttgatctctagggctgcacaaaactgttactgtgaagtatttcaaactattttcaccacggc

SEQ ID NO: 599 - DNA, 1712 bp, Homo sapiens
ccgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattga

SEQ ID NO: 600 - protein, 509 aa, Homo sapiens
MVLWILWRPFGFSGRFLKLESHSITESKSLIPVAWTSLTQMLLEAPGIFLLGQRKRFSTMPETETHERETELFSPPSDVRGMTKLDRTAFKKTVNIPVLKVRKEIVSKLMRSLKRAALQRPGIRRVIEDPEDKESRLIMLDPYKIFTHDSFEKAELSVLEQLNVSPQISKYNLELTYEHFKSEEILRAVLPEGQDVTSGFSRIGHIAHLNLRDHQLPFKHLIGQVMIDKNPGITSAVNKINNIDNMYRNFQMEVLSGEQNMMTKVRENNYTYEFDFSKVYWNPRLSTEHSRITELLKPGDVLFDVFAGVGPFAIPVAKKNCTVFANDLNPESHKWLLYNCKLNKVDQKVKVFNLDGKDFLQGPVKEELMQLLGLSKERKPSVHVVMNLPAKAIEFLSAFKWLLDGQPCSSEFLPIVHCYSFSKDANPAEDVRQRAGAVLGISLEACSSVHLVRNVAPNKEMLCITFQIPASVLYKNQTRNPENHEDPPLKRQRTAEAFSDEKTQIVSNT

SEQ ID NO: 601 - DNA, 21230 bp, Mus musculus
  misc_feature (1)...(21230): n = A,T,C or G
atccgataagcacccgcgggtggccattccctgtgggtaactattccaagtaaattggagtccctttcttttcttgggaaaagaatcaaagtgtcaagagcgaagttgccagcggccatatctatctgaagagatgcacgcagctttgcggtgtgttaggagtgttgcaacgcattagaatcctcctggtgaggagaaatttctggctcagatcatttgcaattgagacaaagctttttttttgggggggggtgcctcaggatgaataggatggccagtccctctgcacatggcacctagagcatcaacaagaagagtccacaggaatgacccggccacctggtgaggcactggtggagagctctgaggacgtattgtgcttattgcacctcttctgattttttttttaagatggaaaaccccaaacaacctctacactgtcctgcatccagatcacaatgtcagatttgcaaccacgcttactctgctgtggagccatctgtttgagccatcaagacaaaattcatcagggaatgcttatgtctaggtcaagacaggacagctgtgtggtgcaggccacagacccagcccacgcaggagcttgtaactctagatgtcccatatccagggggacccacttagttgctaggtttgcaaagcagtccagaaacagatgaggatttcgtgtggagccctgccctagcactgataggcaagcctgggcgcctgtgttgtcatctgacagctatgcctgtcaggccttgccctggacatgtgaggacatgtgctttgtctgggtgccgcacacagaaaatgggcagctgttgctgctcctggcagccggacttgtgcctggtcacgtcctgctctgctaactgcctctcctcctctgctttgcgtcttggcttaagaactgtatgtaaaaacagtgtgtgtgtgtgtgtgtgtgtgtgtgtgtgtgtgtgttggaaaacttcttggattgctctcttctattccatttcatctcctgctggcccacatacaaggtcctatagctaagtctctgactcttcttcccaaacacgatcccagggcagtgggcagtagtgtgcaaatggtttctctgaagtcttgggctagagagccagtaagttctgggttctcagttcctgaagggatccatgttcactctctgcaagtgatcgattggtccactggctatctcatgacctccacaagacaaactgtgacaatccacctaagcaagaggctgagatgggagagtttatgtcttcctgcagatcagtgaaaagatggacatgggcaataatggttgagaggttctccattcttctacagcttagaggtttgctttttttttttttttttagaaatttatatttttatttttaaaattttaaattaattaggttttattttttgtgtgcagtgactaatatatatgggttccagtgatattttgagacacatatattatacgaagacagatttcaagtaattagcatatctatcacttcaaatattgatcagtggctttgatcaatgactctctccaccctcatccactcccagaatccttatctaacgagggtagggtgagtaggactctgtatatttcataagctgtcttgttattccttcttccttgggtaaacagtgtctttttttttccttttctaatatgtgtttgatgtatgtgtgctagtgtacacacacacacacacacacacttgtgtgccctcgtgtgtgtgtgtgtgtgtgtgtgtgtgtgtgtgtgtgtgtgtgtgtgtgactgtggagacctagagttaacactaagtatcttccctgattgctttccattttgtttattgagaacccagagctcatcagttctgactagcctagctcatcagcttgctctgggatcctaaatctctacctccttgaatgttaggatcacagacctccactgcctgtttattgtacacaggtcttggggatctgaactgtggtcttcactctttattgtcacgtgtttatccactagtccattgagcaatttcaagtctccagactcctacctgcaggctttcagaccatgtttcatgtctccctgggtgacctatatttttctatgtacctgacaatggctttgagcttccggttctcctgtgtccttatccgggatgtccttaccccaccatgaccatttttatgaggtgccagggatttgtgtgctcggaaagcaactgagctatatccgcagactgctggatctcaaatgatgtcagactagcatcttccaagatgctgaacaggatccctcccaaattcccagaattcatgtggtaggcaggagggtaatgtcacattcgcagagtccatagaaggaaccctgtgaaagggaaagtgtctggaaaaaaaatgcaatttcactgctcccttgcaaagcagcggcttattaactgctaactaagtgttgccctctggttgtcccagaggggctggctgtaatgaacaaggtggaagaatctggctcatttgtaattacacattagcaccactgaagtgcagttcacacccaccctctccttacggagcatctctcaggccagtctctgtgccccagggccaaactttccattgcttattcaattatgttgttccatagctaatcacttttgcattcgtctaattcttccacagtgaactgcctctggaatgggggacccatttgcatatctgtgtcttaatcaccctctgcttaggggcggatgggagctgccattccccctgcctcgcagctgggcagattccggctgggagtggaaggagattggccctggctggagattggggagtttctgcacctgctgacttccagctgcccagctgagctaactgccaggatggagcaacaggagagtcctttgctgtggacaccacttgcatgcttggcccaagaatgtgtgtaaatagttcagtggtatagcctttgcctcgtctgtgtggtaaggccttgagtttgatccacatgatgaacacaaaccaaattgaaccaaactgaaccaaaacctcaatccaaccaaatgcaaaccaaaaccaataaaaccaagcaagaatgaaacaataagcaaaccaaaaccaattctctccgctcaaaaccaaagccaacaacataagaatgtgtccccttcaagcgtcttctccaaccgtgacactagacagggaaacggacaaacttttttcttttactttatttgatattttctctatttacatttcaaatgctatcccctttcttggtttcccttctgaaaccctcctccccctcctacctccccctgctcaccaacccactcactcctgattcctggccctggcattcccctacactggggcatagagccttcacaggaccaagggcctctcctctcattgatgaccgactaggccatcctctgctacatatgcggctggatccatgagtcccaccatatgtactctttgattgatggtttattcccagagagctctgggggtactggtttgttcgtattattgttcctcctatggggctgtaaaccccttcagctccttgggttctttctctagctccttcattggggaccctgttctcagtctcatggatggctgtgagcatccatttctgtatttgtcaggcactggcagagcctctcaggagacagctatcatgctctgaggacaaacttttttccacgaatatttacttaaaaattttaaattaataaacatgtgtgtgtgtgtgtgtgtatgtgtgtgtgtgtgcacgtgcgcatgtgtgtgtgtgtgaatatgcatgccacagtgcatgtccaaggacaactcttcaggggtctgtccacaactccccagtcgttgtttttctgtttctcctggacggttggttgtcccgtctctgcctcccacgctgtcttgggagtcctggggtcacagatacccaccactgtaggctccaggcattgaactcagggttccaggattgtgcagcaggcattttactcaccaaaccatctctccagcctcggaagacaaggcattttaaaagggaccttatagaatagcttaattgtgttagtggggtttccctaccaagaattggaatctcagtgtggagggatccaacacctagcttggggttctgatgttacactaagcatgtgttgctccactgaatgaactgttctgtggtaatggatgttggtgtggtatccacggtgctcagtttggtagccattagctgtaaatggctcctgaacacctaaaactggttattgtgtctgaagacgcatgctttaaagtgcacttgattttaataatttgtgattaaaaggaagccactccatttgtctcagggctcctggtttactgtcaggcaaggcagggcaatgtgaagagtaactagccctaggtgtgacagggacacaatgtcctgtccacagaacagctctgctctgctttgataaacagctgtggtgtgaaacctccgtaggctgtgtataggtgctccacttgtcatgaggttttgtcctgagaggactgtgagacagtggaaatataaatccaagatgcatttaatgagcccagcctgcagagcgtcgtagcttacctgtgtagcacacggaaccatggcggttgtttcccgttctgatcacaaatgactggatgggagctacctggcatgctcagagaggaataggaaaagatcaaacttcagaatctgccacatgagctctcgtggatgtgcatccccatcacatgatcttaaagttggaacatcatcagggaaatgactgaaaactggggctgtatctttatcccgtttatcctctgggcagttttgctttgccagactgacatgggaatttattcattcctcttattcttccaggcatctcaaatacccctgtgggaggaaagagggactccacctcttggcttcaaggagctggaaacagtcttgtctagagggctgcagtgtctttgaagtatctaaaaatggcatgaaaccatagcaggccattcttcaatatatttgctcttacataatattaagaaaaaatcctatccaaatcttcaagtaaaactacagttataaagagagacagcagttttatctcgtggtttcatgaatcatcatgcctgtggtctgtcacagggagccccatcccgccattaggcaagtgttgacatgcgcaaatgctttaaacagtcaatttaaatttctctgtcatctctactcagtactagttaacagataggtaggatatctttgtttaacagcaccgaggtttctagtcgtttctagaaaggagactatgaataggttggggggaatgaccgtggattctgtctcgatatcccttaatttaaggtatttcagggtgttgcataacaggtttctccaagactgaaacagtctatcatcaggaagctccttaaacaggaaggcaaacaattcagaatagcttcaggaagtccctgaagttcaccagattcactaggtccctccctgccagagtaagtaataaaaacggagagtcatgctcagaaaaaaggaagctaaactgcaaagactctgagagaagccatgctgcagagaagactcagactagaccagctgctccgaagacctagaaacccatggagttgccagcaggaggtttagacctgagtcactagaaaatgacattgtctaatctgctgagctgctgcaggatgcagtgtgctccaggttcccagcttttatgagctgtcacccatgctggggtgggctttggtgatgcagctgtctttgagttgcccctgtaagtagcccttcaccatcactcctatacgttactccaataaaactcattgctttaccaagctgggctttggtggtacctactttgatctgtcataggatccctatctgggatgaattagatgtatgtgtgtgtagcatctacccaggaaaagttttatcacacagcacaagatcaaaaatacagacatatggcaaagcagaccatattacaaggatgagagaattcagcagggtgtggtggcacacaccttctaccttagcacttgaaaggcagtggcaggcagatcctgggtgagtttgaagctaatcttaactacatagtgaattgcaggtcagccagagcttcagagtgagtacctgtttggaggagggtgtgtgtgtgtgggacagacagagggagagagaaggagagcgaggggagagggagagagaaggagagatgaaagaggcaaagagagagagaggagagagagagagagagggagagggagagggagagggagagggagagggagagggagagggagagggagagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatattgaattccccatattatatccactattttacttttagtcttacctaatttttatcccatcaaatattgctactataattttaattggctactgcatccattcctactctcggggcgccataagcacttcagatgtgtagtttgctgaatagaacttacacttttcatccagacctgctctctagcttctccctttctgtcagatggcaggggaatgggtcacaaagctcctcaagtcagatgccattcctcagtagtccatctcatcagggatttcttgactaggttcccactgttccaaaccgattgcgatcttccttgcagtccagccaccatactgctctctccttgaaatttggtctcaatttctggagtaactttcaccctgctctcctgaaatcatgtttttttttttttttttttttggtttgtttgtttgtttgtttgtttgttttttagaaaacagagatagccatctcttatttcaaattccctattgtttaagatctctgtagtctgaggaggttgcaagatttgtcctaagtggagcctaggtggaattgctcagtcagagctgcagttgattgtcacctagtgcttcataatcaagctgcacagctgttcaccactcctcagatctcacacagccacgtgtggctccaggtttgtatacttcagttgccaggggtgcctcttcttccgatttcttaacccatctgtcattcaagcctgcttgaaagtaccagtgttttcgactcatttcttctacagctccttcagttaggattagctattctgtctcttacatctttcaacttgcccatggttcttttatagtggtgatgtttgtaatgtatagattagtgacctaaatggagagattctggtggtatatacattgttccttgatgtgttcccaaagtctagcacaacgtagatgtccgtaaattttgcccaagtaccaatcttagcagtgacagttaactaaatcagaattcttggggaaaacacatacttgccagtaatcaaggaggccagaaggagcactagagctgggttgactagagctggtggttgtgagctgtctcttatgggtgctaggaaccaaactcagccaccctggaagaggggcaaatgttcattgctgagctgtgttttgagctccaaattaacatttcatgaaaggcgtttatgagtgaatcaagggctatcatcagaaaaggcctcgaacttattttaaattaccttgggcctgtctgaaaaactgaaattattgtttaagcccctcagacattacaccactaatccttttctaatgatctcatcctaagaaacagcatcagcaggggactctcgagcctcccctccctgtaacgacataatgagcagatttgggtatttacataataacttaggatgatttcagagcattttaggcaaaatacacagccacttagattggagtcatcgcacccatctcagctctcttaggaattaaagggagatggaaatggaaaaaagcaaaaatccgggagtgtttgggtgtgtcccactctgtctcagttcttaaatgccctgggtttataatgagatgtcataattaggaaactggcttcatagaaaatacaagcactgaagctttgagcaaaatactaaaaaacaaaaatcggtaaaagcaactaactaggttccaaagtggtactgaaaacaggtcgtaatgatcatttatacaggggaggccactgagcccaatctgacctggtttgttatgttgctcatttctgatgtatgagctcatacgggctgcctttgtttagtattttacgtctatgccttttcttcaaaattcgcaaataacccgatggttatttttaccttaagacatttacatgcatgcttgctatgttctttgctcctctttatacttgggaatcattttctatcttttgcccgcagccgctcttttgtaagagtgtctgtcggctctataactaccgctcttgggcttttcctatttaaaaaatgtgttattctcaccctctcatttcaaagaaagctctgctgtgctctagtgttcggctctagttgttgctgttgatgagtctgctctaggcttctaggctggtgtcctgttgaggccacctgtacctcttggtttctgtacctcttctttgtctttggttgttctgcagactcaccgtgaagcatctctgtctctgtgaatgttgttgtttatggcattcgtgagtcacaaggtaactgccaccagtcaactctgggaaggactcattcattgcctgactacttcccttttgttgtaatttccccaatctgccacttggaactttattatcagattcctttgagatctccattgaggtttgtacctcttttttctacttcacatgtttgagtgcagttcaaccctaatccttttaaaatatagacatagttacatattctgagagtcaagggtgaggtaactcacttcaatctctttctcaggtatattttattttatggttttttttctttctttcttggtttttcaagaccaagggttttgagggtttctctgtacagccctggctgtccgggaactcactcggtagaccaggctggcctcgaactcagaaatctgcctgcctctgcctcccgagtgcccggctgttttttttttttttttttttttttaaagttcaagtgttaaggctctctgctcctccctgttccagagacagctgcatcttcttgtgcagtgtcagcctcgtcccgtaaacaaaatggtgaaggtcggtgtgaacggatttggccgtattgggcgcctggtcaccagggctgccatctgcagtggcaaagtggagattgttgccatcaacgaccccttcattgacctcaactacatggtctacatgttccagtatgactctactcacggcaaattcaacggcacagtcaaggccgagaatgggaagcttgtcatcaacgggaagcccatcaccatcttccaggagcgagaccccactaacatcaaatggggtgaggctggtgctgagtatgtcgtggagtctactggtgtcttcaccaccatggagaaggccggggcccacttgaagggtggagccaaaagggtcatcatctccgccccttctgccgatgcccccatgtttgtgatgggtgtgaaccacgagaaatatgacaactcactcaagattgtcagcaatgcatcctgcaccaccaactgcttagcccccctggccaaggtcatccatggcaactttggcattgtggaagggctcatgaccacggtccatgccatcactgccacccagaagactgtggatggcccctctggaaagctgtggcgtgatggtcgtggggctgcccagaacatcatccctgcatccactggtgctgccaaggctgtgggcaaggtcatcccagagctgaacgggaagctcactggcatggccttccgtgttcctacccccaatgtgtccgtcgtggatctgacgtgccgcctggagaaacctgccaagtatgatgacatgaagaaggtggtgaagcaggcatctgagggcccactgaagggcatcttgggctacactgaggaccaggttgtctcctgcgacttcaacagcaactcccactcttccaccttcgatgccggggctggcattgctctcaatgacaactttgtcaagctcatttcctggtatgacaatgaatacggctacagcaacagggtggtggacctcatggcctacatggcctccaaggagtaagaaaccctggaccacccaccccagcaaggacactgagcaagagagaggccctatcccaactcggcccccaacactgagcatctccctcacaatttccatcccagacccccataacaacaggaggggcctagggagccctccctactctcttgaataccatcaataaagttcgctgcacccaccaaaaaaaaaaaaagttcaagtgttaaaagtatgtccccactgtccttctctgtccacactacccacaaccagtgtacaggatgtgtgcaacctttgtacaggatgaaatgctttgaacaaggcaaaatgactgtctattttgaaattgcccatgttacctggtatttgtaggcatcttccctgtcaagttcttggaattctatagaagaaaatatttagtgtaagtctttttctcaagcttgaagaccactgacctagtctttcctttttacagtctgccctttgacaatatgataaagctctcaggataggaaataagctcaccaaccctaggtcatcagtagaacactagagaatacgtgtataagtctctgtctatactgtgtgtccatgtgtgcacacatcagtatagagggagaactgcagacagagtgtgtgtgtgactgtgtgtctgtgtgtacgcacatcagtgtacagcgggagctgagggcagatgtgaggaacactgactgctgcttctgtgtcgagaagacaagggagcacagaacaccttatagagataaagcctgcctaggttcaggtcaagcagaccaggcagggattggttcaggaaatgccagatgataactaatcttgcatctactcacttgcgttcctgtgggggtccccattatgcgagggctaatgatctggaggaggagggtgttgcttatccactaacgactttaaaatgcattaactttgagggcttaggtcatcaatatgtaatgaaaaggaatgtatgtacattgtatgaaatttctgtggcagctgagacatattactatagtaatatgagcctaacacagtctgacagggggttgctatgctaattacaagggactggagagaccgcatctctttttcttgtcccttctagcatctgcagaactcagctgtttgcagagactgggagagaaagtcagcaggacagtgtcaaagcccccctagtaatgttctctcttgactatcggcagctgggaaagctccacttatttgaaagacctctgtgattacatcaggatgcccaagttatccaaggtactgttcccaccacaagctcttcagccttggtcccatcgtagactaagtaaggtgacatatttacaggattaagggattaggagtagttctcaaattgtgggtccagactctctggggggggggtggcatatcagacagcctgcatatcatatatttatattatgattacataacagtagcagaattatacttatcaagtagaaacaaaataattctgtggttgggggtcaccacaacatgaggaactgtattaaagggtcccagcgttaggaagcttgaggaccactggatagggtgaggacaaaatttcagggatgctatcatttgactcactactcacatccagaggttagaaaccaggctaggtaaaactcattctccaaatggaataaatgtatcagggaactgcctcggtttggtaggccaggaactggtaaggactaagatgtgttggatatgaagcacagattctgtgggtcagaagcttatggtagaagtgcccttctgggctctgtccgggcgacttacgccagaccatttgctcctaagcctatgaacattatacttttagttcaaaatcaaaagtcagactaatgtgttttaaataatggataatttcgttgggtaatggggtgtggcaggattttccctgtccaattagtttaaatattagtgcagcagaagggcctgtggttggacagggaaaagggaggcagagctaagagttgcagagacaggatggaggagagagagaggaagcaaggtggacgacggataggatggttcagaaccagtgtggctttgaatagtcacaggtagatatgttattatatatagggataaaataattggggtaagttgtctaatctaggtgggcagcttgtatcattatcaattggcacagaaattattgtgtgggcatcttgtgaattgagaatttagtgatatataaatctgactggttaattataagcttcaagagttttgtttccaccaggttgctaggtattgagggtggctgactgcggggtggacggtcgtgctggcatggcagtgaactgccaagggaactccagagctctggcacagagagactgctgagttgagatcacctggctggagccgtgtggcccgatggtgccccgtgtactgtgagaagcatgggaacttgccggtcatttttaatatttcccgcaacaatgaggtgtctaggaaggaggcatttaaagaagtgagaacataccctcatggtgaagagggatccaggagatccctaagaatggtaaacaagccatggatgtgaaaatgtcttaaagcatactcaaggggtctaacgaggaacaatggaataaaagaagtgtgaatccactctgatcagatacacaagtaaaaactgttcaggctggggctgtggaaggggaagaaaatgcccttaaagagaacctagttctaaacaccagaacctgtaaaccatgtgacctcggattttggtacaatgcagtggaatgtatgatagctttgatatcgtgaagagtgttggaaggtgctggggaagattttgagtcaggaatagggaaactgcccccactcccatttgcctgtatgagttgaaagaggggggtgggagtgtggagagtttaggcaacagcaaaacaaggcatactgtgtcactcaacaccggggaccaggagtggaggtatgcaagtggcctctagaagctggaaagtctgaaaaatggagagtcatcaggagcctccagacagagccaagccttaccaatgtcacattcggatttttcaatcgagggacccagttgtggacttctgaatcgctgaatgcagcataatagcattggttttgagaccaattttactatgtcactctgacttgcccagaacttgttgtgtagattaggctatcctcagacccatagagactggcttgcttctgcccctcaagtacttggattaaaggtgtgcaccatcatatctggaagatttgtattgttttaagataataggtttgtggtcatctgttgtggtaacagtaggtacaggtgaaggacatgtgggttttcgtgggtttgtgtcttgtaatggagcccaatgctgaatggctgttctcttgaattacaacttaaagaacaaaagaagaaatgaattatagactatgggacaattgtcccatcctagggcacttagggggatgatacttctttgctgccataacgtgttcccctcttttatatgctcctttgatttggacacagacatctacagaacacgcaaacactcacggtctccctaaacacacatgtatatacagcacataaacaactctctgtcttcttaaattaagcctgggtgaaggaaacaaaatgctttccatttggggcccattggaggtctggtgggatggcctgtaggttgttaatgttacagctcagactgtgaaatgttctgaatcagatgaccttagactcttggttcagcctaattaagccttttctgcctgtacggaatgttctggtttgcagccgtggttgtgtaactgtttaaactgtacacctttgctccagggagctgccaggtccgatgctctccactcttcagctgttttttttttgtttttttgttttttttttctgtgaagcatgcagtaggatagctgtacccttttccatgaataagaatatcacacactcagttttgttatgaaatttctgggtttgtgactatcaaagggatgaattttgaaggcaggcagtgggtagaaatggccagtgttacttaccgctcagaaaagcagaaggtcttttctctcctgctgtgagtgctacccagtgagcttgcaacaggagccttaaagaatggaaactggaaggggtcagtgggaaggtcactggaagctaacgggtgaaatctggactacggaatcttatcctcggagccagtgtgagaaagcactggttatactttatgttattttattaggtgatcctttgtcatgaactgggcaaaacagtgagcccacacagcttggctgggatcctctgtagggcaggagaaacaagaacaccccattgcttcagcactggcttagactaatgttttgtttgtttgttttttaataacctcccggctttagaataatatcataacttctctcgtctcagactgtttaacctacagtttgccgaaggtgatagggtctcaaaacgagaataaggttttcatctggggcaagtctgtgacttgagttttcacctgtaaagtgaagataagagtgcaatgctcaaaacattgttttggaggggtgggggtggggcttagcaaatggtgcacacaaagtacacaggatattgctaacccgagagtgcttcctctatgaaaagctactcttgttattggcatactcatgaagtatggctctatgtcagaaataaggctaaatgctttgggacaaagatgatcagacaaagtcctgcctggtgcactgttgccatttctcagggcgaaagatgcagcaataactaagaataaagttaagaatctctggggctatgattccttgatggagcagttgtctatcaagtacaaagctcaatttccaattcttttaccacaaaagaaactgaaactaaagccctggatgctgcacagactaggaacagggtagagcacgctgcccactggacccgggaagctttggctcatgaaggacttctctatctttcaacttcagagtgaagaggtgaagggtacgtaggtgttcaggagccaggtagatgggaaggatatttcagacataactgtatccccttctttcctggcttggttcaacatctcacagaggggacaggatacaaagcctgacacacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacctcagctgggtggtggtggcataggcctttaatcccagctctccagaggcagaggcaggcagatttcaaaggtcaaggccagtctggtctacagaaccaggacagccagggctacacagagaaaacctgtcttcaaaaaaccaaccaaccaacccaccaaccaaaataacccaaaacaaacaaacaaacaaacaaaaccaagaccccaaataatccccccatataacccctcaatgtccacaagcacagtatgcttatcaggaacacggggagacccagcagcccagcctctcctggtcttcatacttccgctagcccctgcttttgcttgcagcaatgctagaacaggagaaaaagagagccccgagacaaagggttctgctgcagatgtgagaggaacgagctccatcgcttgctcagctgtagttcttccatgcctctgaccatccctgtcctccctctggtgaaaactactgatgttagttgtctgtagggagcatgtgaaacatcagttatggtgaaactctatctctctatactgtcttcttggtgggcagcacttaagtccattttgtacttagtaggtattcaataaatagtagttgacataagaagtggtgtcttataggaagagaggtttgttttatgatttatttgggttgtaagttacatgaagggaaagcccagtcttgacctgctcattagggtattcttggagctaacacaggtagcagtcaggaggatctatctatctatctatctatctatctatctatctacctacccacccacccatcatctatctatctatctatctatctatctatctatctatccatccacccacctatccatcacctgtctgtcagtctgtctgtctgtctctgtctgtctgtccgtctgtccgtccacccacccacctatccatccatccatcatctatctatctatctatctatctacctatctatccatccatccattcatccacccacccacctatccatctatccatcatctatctatctatctatctatctatctatctatctatctatctatctatggaggtgctaaatatacacatttaacacctttggtctcagtctccacctcctttcttctatgcctgagtagctggtggtgaatatgattgtgcttactgtgcatactaaacacaaatggacatggtgagtgggtggatagatagattgacgcttgaataaacaagttcctggatgagtgaatgagtagagatggctggacagacagacagagagttgggtgggtagttgggtagatgaatgggggcatatgggctggtgaacgaatgatgggtgaatgaattggataattactgatgagccgcttttctagggatgttttcagctgtcataatattcccacagctgactttatctgtgagtatgtgtgtcatcctgtaaagctaaacacacagctgcaggtgtgtcttccttattttctgatgcaacgaggaaacgcttatgaggagagggggctaggtgagggatatagccttccaggtgtataatgagattccttgaaaccaccccgtttacgtgatcatgtttaatcctctcagcaattttatgaaacaagtgttcttattaccaccaaattgcaagcacttaatgaagtggaatagcttgctcgggaaattgtagagcgagggctcgaacctggctaggttgtactcacttagaagcctgggccctttcctaatatacagagcggagaaatcttagtgtctagttgaccaagaggcctcagaaatatgagtggttttgtttgaacccagtgaagccgctaatttcttgccttggcaagtcacttaatttgccttctcggtttactctgtattttaatggaggtaatagagtcttcttagcaggagtgctgtgaaaaatcaatgcctataatagaaagctttgagataaagagctggagggatgggtggagcacagcactgagcagacacgaggaactccatcttgttctgtctgagtgaactcgttcgtaaagcgccgtgtctgtacaagactcactcgtcatcatgagagacccatcactggccaaagccctgaggataagtgactggagtgctcagccctcaataggacatctgtactctttcttccatagctcagggattatcacagatgaggtggcagaaagaaagagctgaaggctgggaccagtgctgtgaagtgctgtcctctgggcgtggctcagttgctgtggtctggacctcaattacctgtggctatctgcataagacgtgcacaacatcgagcccatcagcaatgggggtggggttcacgaggcctcccttccccccatgaggaactattggtagctaatggagtaattttcttcagcattgtaccctacgttaagttgcccatattccattaaataaccctccatcacccaaggccataggatgaaccctgagctcagtgggtttctgtctctcacatacaaaagacacgagaggctggagggatgattcagtggttagtagcacatacttctctaggagaagacccaagatcagttcccagacctatgtgtggtggttcaaaaccaccccaaactccagctctagggttctgacacctctgacccctgagggtatcctcagtctgtcttatacaagcacttaaaaaaattttaaaaacaaatctttaatgacacacaaaaaaaaaaaaataggaggaaaatttgtgaagaagagttcagcaggaataggaggggggctaagaaaggataatgggatggtagtgaatgtgaccaaaatatgttatacacatgcgtgaagttgctaaagaataaatacacgttattttacaaattaaatcaacttccagcgatgagttctcgagaggaagtggaacttggtaaacaatttctagattgaattttcacatgcttgttttaaaccgtgttcttagcactatattattgtaagagaaacctactgttgtgaatagctaacggtggtatttaaattctgctggggagccagaaaggaaagcacctcatagctctcacctcgactttcagttgacacacttggcatggtgcgattgtctgtagtaaactgcatgaagccacaggacacgtggaaagaacttctctccctgtttatgggtcttttctttccagatggggtactttggggtaattttttttaaaaattaatttcacctgatacatacacatttatgttgttttcctcttctgcctctgccatgtgctaccatagattcatatattacctttcatccatcctttggtttgccacctatttccagagcgtcagctctgtgtcagttcaggcagaatggttgtcgaccttccctcctagagagactcaaagtgaagaagaaactacatggctatgcgactcgatcatgaaaacgaggtaagaaaaaggagggaaagtggtaggattgggagacaagccaggaaattgtctaggaaattggcctcgggaatggattttaggtgaaaactgagcgaacaccaggctggaatatcactgctgggatctgtggtgtgtgggacaccgaaatgagtggggcaaagggcaaagcctgaccccgggtgctcttgttctgatgcccagggacatggacaagcacacttgccagtctgaccccgggtgctcctgttctagtgtccagggacatgaacaaatacacttggcagttacagtagcgtcaggtgctgcagtcagagatgtaccaaggagagtacgcctgtggaactcatccctggaccggtgctagggatgccggactgcctagagggtggggttacagacagagcgcatcggtagggaggacgtggcgaaggtgatggtctcccaggaaggccaaggatgccaaagaagagtccaactgacaagcagaggtagcatttcaaatctggaagatggcgtgtgtctggtagaaagggccttggctggcacactaaggaatctgaatgtgaacctctgaggaactatgggaagattttaaccaggaaggaaaatgatggccgttacaccagagagactccgtacagcaggagaaggctcagagtgggctagcccggaggcccagaaccatattaggaactgacaaagaagcattggggataccgggtagcagagacaggcgaacttgagaacgaccttaaagatgggtgattggtaccccgagtgggaggtcacagacagcggtcatgaaaagattctttgctcgctgcaatattcctccaataatgagttccatcagcatcttgccccgctcccccccccccccccgtgtcctgcggaagcacccagcatcaaagactcctgatgaattgattcaggttttccagatatctggattgggagcatttcttgttttatgtaacatccgagtgaccttcctcaaagtgaaagctgacttctggatgaacttcagacctcttgtcgcttgccacaagtcctttcttgacctagcgtttgccagagaacactctaaagggtattggggtggctgtgtgtgatttgtcttttcaaatctgttgttcattttattcactttttttttttttaatgttcaggagttgtgggttttgcctacatactttcagacagaagtttccagtcacatacttgttaagcatactcttccttagttgatagcttagatcacaggagtctgtaagggcacaggagcctgtgagggcacaggagaaagatggtgaagtttcaagcaggttccattcgaaatgccagagtatacctctttgagattgtatttgttaatctccttcccacccctggtctttctatctctgtgtctctgtctctgtgtccgtctctttctctctcctccatgtctg

SEQ ID NO: 602 - DNA, 1230 bp, Mus musculus
acagctgcatcttcttgtgcagtgtcagcctcgtcccgtaaacaaaatggtgaaggtcggtgtgaacggatttggccgtattgggcgcctggtcaccagggctgccatctgcagtggcaaagtggagattgttgccatcaacgaccccttcattgacctcaactacatggtctacatgttccagtatgactctactcacggcaaattcaacggcacagtcaaggccgagaatgggaagcttgtcatcaacgggaagcccatcaccatcttccaggagcgagaccccactaacatcaaatggggtgaggctggtgctgagtatgtcgtggagtctactggtgtcttcaccaccatggagaaggccggggcccacttgaagggtggagccaaaagggtcatcatctccgccccttctgccgatgcccccatgtttgtgatgggtgtgaaccacgagaaatatgacaactcactcaagattgtcagcaatgcatcctgcaccaccaactgcttagcccccctggccaaggtcatccatggcaactttggcattgtggaagggctcatgaccacggtccatgccatcactgccacccagaagactgtggatggcccctctggaaagctgtggcgtgatggtcgtggggctgcccagaacatcatccctgcatccactggtgctgccaaggctgtgggcaaggtcatcccagagctgaacgggaagctcactggcatggccttccgtgttcctacccccaatgtgtccgtcgtggatctgacgtgccgcctggagaaacctgccaagtatgatgacatgaagaaggtggtgaagcaggcatctgagggcccactgaagggcatcttgggctacactgaggaccaggttgtctcctgcgacttcaacagcaactcccactcttccaccttcgatgccggggctggcattgctctcaatgacaactttgtcaagctcatttcctggtatgacaatgaatacggctacagcaacagggtggtggacctcatggcctacatggcctccaaggagtaagaaaccctggaccacccaccccagcaaggacactgagcaagagagaggccctatcccaactcggcccccaacactgagcatctccctcacaatttccatcccagacccccataacaacaggaggggcctagggagccctccctactctcttgaataccatcaataaagttcgctgcacccac

SEQ ID NO: 603 - protein, 348 aa, Mus musculus
QLHLLVQCQPRPVNKMVKVGVNGFGRIGRLVTRAAICSGKVEIVAINDPFIDLNYMVYMFQYDSTHGKFNGTVKAENGKLVINGKPITIFQERDPTNIKWGEAGAEYVVESTGVFTTMEKAGAHLKGGAKRVIISAPSADAPMFVMGVNHEKYDNSLKIVSNASCTTNCLAPLAKVIHGNFGIVEGLMTTVHAITATQKTVDGPSGKLWRDGRGAAQNIIPASTGAAKAVGKVIPELNGKLTGMAFRVPTPNVSVVDLTCRLEKPAKYDDMKKVVKQASEGPLKGILGYTEDQVVSCDFNSNSHSSTFDAGAGIALNDNFVKLISWYDNEYGYSNRVVDLMAYMASKE

SEQ ID NO: 604 - DNA, 23909 bp, Homo sapiens
catggcgaaaccccacctttactaaaaatacaaaaaaattagccaggtgtggtggtgggcacctgtagtcccagctacttgggaggctgaggcaggacagttgcttgaacccaggaggtggaggtagcagtgagccgagattgcgccactgcactccagcctgggcgacagagggagactctgtctcaaaaaaaaaaaaaaaaaaaaaaatctggaaaagataataaagttgtgaatgtaggttggaactaaactgtggaagtccctgaatgacttcaggagtctaggactttaactgtgttagccaggcacccagcattttagtgagacattctgctttgtagcatttgcattgcgggcacagagagtggaggtggcgctgggaagcgtgctcctgccagccacatttttctcctcactggggaaaagaaaagagcctggtggtggtgattggccatgatgtcataggtcagttaccggcaaaagccctacaagaggcaggggagagcacctgcaaactggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagacaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagttttgaaggcatgagagtagaaaagtagagaatggaaagcctctcaagaccctgctgtacattttgaacctcctcttttctttttctcttcctaagtattacttttgtctacttcaggttcgcaatatcatcttcagaaaagcagaccaaagatcaaggaattgttcatttttggcttgagccctttttcttttctctttagctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacggtgaggctcaaatctagcaggcaatggggtgggagagcaaaggaaggttctgagagggctccttttccttcagtgacattgtcacagtgaggcccaactgagctctgctgtgagttataacgccacctaaatggaaaagcaaatagtgagaggaccagccctcctgcctagtagtagtgggattcagtaaagcaacaggacccaagaggctggccctgcggcagagccacgctatagtgctccacggctctagacaccacatgaggtgctggtacctacccctattggccctttctcccccgatgagtccaatccatgactgcctttaactctgtggcttccttcccctagaggaaagccagaaattgtgggaagcaatttagacacactggtgagcatagggctggatgagaagtttccacaggactacaggctggcccagcaggtgtgccatgccattgccaacatctcggacaggagaaaggtatgtgggggtggttccaaactaaggagagtggagattctcgtgtccaccctgtacacacacccacgttgtcttgctctccacagccttctctgggcaaacgtcacccccccttccggctgcctcaggaacacaggttgtttgagcgactgcgggagacagtcacaaaaggtgagctctcagggaaggccttgggcagatttgggccctttgttgcagtaaacaacttctccctcctcctctgcaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcagaactgagctgatccccttccggcaatctctgctcctctgctattacatgaagcgaagagtttctgcctctctgtggctactaccgtaggaaaggttcgtgtgaacaatgacgaaactgtcagtgatcacccaggaaggaaagatttaggtaaatgcagagtgtggagttagagacctcagcataaaacagaggctttgtgtctgaggcagggtttgttagaacacgcacgtacccgccggccttttccatcagcttccattgctggcctggccccggatggggccctgtgttccctccactagaggcaatgatgtcttgcagacaaataagacacagagccttgcagcgctggagaaaagtctgacctctgtgactttgaaccattgtctggcgtgatccatctgtttaccatatataggaaacgatgtcttccatgaggaagaggtgcagaaacacgctttggcaacttaaaacaaatggggacctcattgttcccctgcttaattcaggaatcctttctctttacagacacatttgacaattctctaaatgtttttgtagaatttgcccttcctcactttgttcatgcaaaacaaagtatgggctggaatcaaaaatgttgtctctgcttatccatgatccccaatttcattccctttagaatacgagctctgagaccaccatggaggaggagctggggctggttggggcaacagcagatgacacagaggcagaactaatccgtggcatctgcgagatggaactgttggatggtaagaaaaatggctgcactcagcagtttcttcccaattaagataacctgtcccaaacctgcagttactcttccaacaggcaaacagacactggctgcctttgttccactcttgcttaaagtctgtaacaacccaggcctctatagcaacccagacctctctgcagctgcttcacttgcccttggcaagttctgcatgatcaggtaggccgtggggttggtacccccttctcaaggaagatggggatgaaatggcttccctaatgatcctcttcttgctcttagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcggtaagagacccctcacaacgtggtggcagttcccaggagccccggagtctgttgagagtcagtgtgagaatcaccagggctcttcccctaggctttggcatcaccgcgaacatctgcttgatacttgacctgtacaggcccctggctaagagtcaccccagtgggactgacacttctggttagaagcttcacctctttcccccactccagctttcaactctagacagctttctgactgcttctggagtggcagagcatgggataattgattcctgctgagggccttttctaccagtgttagggtgtagcccggaggtctcggtccccatgacccgcaattccattcctagcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggctctctctgtcttacagggcaatgcaatctataatctccttccagatatcatcagccgcctgtcagaccccgagctgggggtggaggaagagcctttccacaccatcatgaagtattgctccccgggccctggggcacattttccacatagcacgggcttaggaatcagacacacctgtatttgaattccacctcggctactctttagctgtacagccttcggcaataacttagcctctctttgtgcctatttcctcttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcgaacatcctcatcttcccttcctgcagacagctcctctcctacatcaccaaggacaagcagacagagagcctggtggaaaagctgtgtcagcggttccgcacatcccggtatgctgccctccctgagggttctttgtgctgagcggggccctgcaggggagaaaggcccatccctcaccccttcaatgcccccactgtggcatccctgggactggggaggctgatggggaaggttgagcctttactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccactggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggttggcagcagaccggcccaggctcgtggaagttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgaccacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagttacttgtcctgtcttattctagggtctggggcagaggggagggaagctgggcttgtgtcaaggtgagacattcttgctggggagggacctggtatgttctcctcagactgagggtagggcctccaaacagccttgcttgcttcgagaaccatttgcttcccgctcagacgtcttgagtgctacaggaagctggcaccactacttcagagaacaaggccttttcctctcctcgctccagtcctaggctatctgctgttggccaaacatggaagaagctattctgtgggcagccccagggaggctgacaggtggaggaagtcagggctcgcactgggctctgacgctgactggttagtggagctcagcctggagctgagctgcagcgggcaattccagcttggcctccgcagctgtgaggtcttgagcacgtgctctattgctttctgtgccctcgtgtcttatctgaggacatcgtggccagcccctaaggtcttcaagcaggattcatctaggtaaaccaagtacctaaaaccatgcccaaggcggtaaggactatataatgtttaaaaatcggtaaaaatgcccacctcgcatagttttgaggaagatgaactgagatgtgtcagggtgacttatttccatcatcgtccttaggggaacttgggtaggggcaaggcgtgtagctgggacctaggtccagacccctggctctgccactgaacggctcagttgctttgggcagttactcccgggcctcactttgcacgtgtgcttacctagtggagacaaaagtacatacctcggtagagcgcgcacgcctgtaaccccagcactttgggaggccaaggtgggtgtatcacctgaggtcaggagtttgagaccagcctggccaacatggtgaaactccgtctctactaaaattacaaaaatcagccaggcttcatggcacatgcctatagtcccagctacaggcatgctgaagcaggagaatcgcttgcaccccggaggcagaggctgcagtgagctgagaccacaccactgcactccagcctaggcaacagagtatgagactccatctcaaaaaaaaaaaaagtacctacctcagagttcaaactagtgaatattaggaagtgcttgagacagtgacaccaaagtgcacaataaatactcgccagtttcattattattaaagaatccatttgaatgtcagctcaacacagcctcctataccgaggcattgtgaaccgcatctccccagcttctccaggcttttccaagaatcagggacactgtagcctgttggtctcagtgtatgacagacacggaggaagcacatctttagctgatacttaaacagagaccctgagcgcacatacacccgcgcacacatgcatggagcttcaccttctctgtcattctgcagtgaccaggagagcaagagctcccacctcccttcaaaacactgtgcccatcccgggcactaaggcctctttaaagcacggcacctccacgagggagggccacagccacatacactccacctggcaggtggacagcgtgagcatgtggaccatagcagggacaaggtgccccggccagccccaacgccctctgccgctgacagggacagaagccctctccagctgcgtgtgctgcagaggccatgcgtagcctccagctgcattctattccactccagtgcctgggccagttagcaccagtgtggaagacagtgagctggctccggacaacagggatggaggaaaggtcccacattcacattcctgatacgtggacaaggtgaggggccgcaatcgctctggcagcattttaaagatggggaagtagcagacacccacgcgtgaaggcaggagagccccaactgtggtggaaatggccccagaatggtagggccaagcctagctccagacaccccagagccctggagaagccaagactgagggagaaagcctgagggaggagcgccccagtccccagggaccggcctggtgcagagctgcagctgatgttcccctctgtgcagccccaccctctgcctcgctgagctccctgctgcgagggcctcgggtgcaagggggaggcaggtctctatctcatggagctgtcagatgagacatcgcgatcggagtcctcagcctcgcttggcggcggcggcgggtcgctaagcgggaccgcagtgaaagcaggagactttctagaaaaaaacaccagttgtcaaccttggggcaggcaggaatcctgaagacggacggcactcctcctcctgctgcctcaccctctggcagcccgtgagaagtaccggaagcgagggcggggccgcgggatggcgagggagcggcagggactgaactctctccaaacccaccctgacagggaaatgggccccgcctgtgtcttgggaactcagaggctgaggtcaggcatgatggctcacgcctgtaattccagcactttgggaggcagaggcgggtggatcacgacgtcaggagttcaaggcaagcctggccaacatggtgaaaccccatctctactaaaaatgcaaaaattagccaggtgtggtggcgggcgccttggaggctgaggcaagataatcacttgaacctgggaggcggaggttgtagtgagccaaaaaaaaaaaaaaaaagaaatagctgaagtcacagtaggagagaagctgctgagcctccagcaccctgactctagggccttggctttatgtctatctgcagtatttttgtgatttttaaaaattcactttcttgttgcggtgtaacttacacagggtcaaatgcacaaatcatggccctgactttagataaaaatctgcccccacaacccttctgttccttgccagtttttaaactgcctctaaccaggggaaccaccagagctggtggccttgggaggtttcagccctcccgtcatgaatggacatagctcatccaactgccaagggagagagctgtgggtctgggccagccccaccaggtaactcccaaagggcagccccacagcaagatgtgacccagtcattgcctgagggtctctggggctgtgttccaacctttctccccgctgtgtccccctggaaggccccatgcccaggggaggcgcctaccggtctccagactgggtgatgagccggcggcaggtctccatctgcacgtccaggccgcgcttcatgctgcacatctccatgtactcgtgcaggtgccggttcatgtcgttcttggccgtggccaactccagctgtggtggggcaggcagggccatcggggttaacaggtggcgttcacagcgcctctgttgcccccgccaggaggccaacacgccaagagcagtggctgggccgggggcccaggcagccattactgaaggctcagattttaaaataaaccagaccaaggcagaaggcagcgaatacaccattgtttcctctgcttttcctggaaatctttgcctatggaggaatgcaaaggtactgctgcaggctgtgttcttttaagactgataagagtggtgaggaaagtcagtgtgggcgggatggagcagatccacaggctcccagggccacacaggttcctatggggcccggctcacccctcatcccctgtactgcgctggtcctgggctgtcccctcactgcactgtgagctcccgtaagggttagcgacaggttttcctcatcctggcagacccagacctcgaagggaattaactctctctgtgacccgtggcatacaagcctggctaactgctgaaaggggcccaatcctcttaccattctctccttatcactttattttctcacctaaaagccattttcagacactaaaaggaagactcccatattggaggtgccattgattctgagacctgtcctgatttcagaaatgtcacacgtggaaaacacggggctcagaatcaaagaaatccggtctccctccccgggcccattctgcagcccacactctgaggcaggcggagaggcagggcccaggcagcacaaactcagtgccagggacagtcgactgcctctctttgttttgggtacaaagggcaggggccgcaaggggaagcaaaatgaaacttcctggagatgacgttcgtgactgcctgagtgaagagaacggggaggataccagctgccataatgtggattggacagagagggtgggaacttagagaaagaaggaaacaggttacagggccagacagcagagatggtcaggacagtgacatttggggtgagatggcggctggctgggtgagaagccctagtggggacagcttccctggcaggcttggatccacagctggggccccacagtagtgggaggagcaggacacggtgactgttcaacccagggggaaaatacagtgccaccagcccttgttcagatcagctgcctacaccccaatttctccaccttggaagaaccggagtgcagggagctgggttctggaaccatcactcagggagactgggaagaaggaaatgaaccaaatatattctactgaaatacaaggctagtactgccaccagtagtctctgcatatgtctatgtccccacttaattcacaaatttacagcaggaacaaggtcaggaggtgaacgtgcatgtcaggagatgtccttgacaagccaccttgaaaactgcaggctcgctgtgtgaacagacttgggggtgggacgggaggagacagagagaggtgaggagcggtggggaagaactgcctcccgcccaccactctgggccttggctttaccttgctccatcttagtgaccctgagagatcaaaggtcacaaagataaaggcaccttgggtactcctgaggtcagcaagtcctcctaacggttcccctaatgcagaagtccccaaaccccaggccacggaccagtacctgtctgtggcctgttaggaaccaggccaaatagcaggaggtgagcagtgggcaagtgagtgaagcttcatctgtatttacagctgctccccatcactggcattacagcctgagctccacctcctgtcagatccgcggcggcattagattctcacaggatcctgaaccctaccttacgtgaactgtgcatgcgagggatctaggctgtgtgctccttatgagaatctaatgcctgatgatctgtcactatctcccatcacccccagatgggaccgtctagttgcggaaaacaagttcatggctcccactgattctacattatggtgagatgtataattatttcattatatattataatgtaataataatagaaataaagtgcacaggccgggtgcggtggctcatgcctgtaatcccagcactttgggaggccgaggtggtggatcacctgaggtcgggagttcgagaccagcttgaccaacatggagaaaccccatctctactaaaaatacaaaattagccaggcgtggtggcacatgcccgtaatcccagctacttgggaggctgaggcaggagaattgcttgagcccgggaggcggaggctgcagtgagccaagattgcgccattgcactccagcctgggcaacaagagcaaaactctgtctctaaaaataataataataatttttaaaaatagtaataaagtacacaataaatgtaatgtttgaatcatctcaaaatcatttcccccgggtcagtggaaaaactgtcttccacaaaccagtccctggtaccaaaaaggttggggactgctgcctaaagtcattgcactgggagagaggaggagtcagatgatttgaaaatacttttttttttttttttcctgagatggaatcttgctctgtcacccaggctgtggtgcagtggcacaatctcagctcactgcagcctccacctcccagattccagcaattctcctgcctcagcctcccaagtagctgggattacaggtgcccaccacaatgcctggctactttttgtatttttagtagagacggggtttcacatgttggtggccaggctggtctcacactcctgacctcaagtgatctgcccgcgttggcctcccaaagtgctgggattacaggcgagagccaccacgcccagccaaaaatagcttaaaaggcatgattccatttaagatattattttcgttctttcagatcatgttttacactgggcacttgaggtccagggaagactagggagagatggcagcccgagatctcttctcacgaagatggccgcacaaaggcccctagttggttgaaggcacagtgaaaacacaaaccttaaatccaccatccaaaagagggagacaagaatcaggtcaggcaggaggaggaaacagtgagccgcggtagacgggagggtggggagtactggtttcccttgccatgtctttagctagcagcacaaatccaggaaacctcatctacctggccaagaaaaccaggtttgatgcaggagcaggacagtttgatgtgtgttgggagaatgagtatataggaaaataatttctcgacttccttctcaaacacctccaatgtgacagcaataagaataaagtcaaggccgggcgcggtggctcacgcctgtaatcccagcactttggaaggccgaggcgggtggatcacgaggtcaggagatcgagaccatcctggctaacatggtgaaaccccgtctctactaaaaaatacaaaaaattagccgggcgtagtggcaggcgcctgtagtcccagctactctggaggctgaggcaggagaatggcgtgaacctgggaggtggagcttgcagtgagctgagatcgcgccactgcactccagcctgggcgacacagcgagactacgtctcaaaaaaataaataaataaataaataaatgaaaagaataaagtcactctctccttatccactggtttcactttccacggcttcaggtacccaaggtgaaccttgatctgaaaatattaaatgaaatattccagaaataaacaattcctaagttttaaattgcacgctgttctgagtggcctgataaaatctcactctctctgccgggcgcggtggctcacgcctataatcccagcactttgggaggccgaggtgggcggatcatgaggtcaggagatcgagatcatcctggctaacacggtgaaaccccatctctactaaaaaatacaaaagaaattagccgggcgtgatggcgggcgcctgtagtcccagctactcaggaggctgaggcaggagaatggcgtgaacccaggaggtggagcttgcagtgagccgagttcaagccactgcactccagcctgggtgacacagcgagactccgtctcggaaaaaaaaaaaaaaacctcactctatccagaccaggacatgaaccctccctctgtcccaaggatccacactgtctatactgcctgcccattagttacttaggagccatctcagtgatgagattgactgtcgtggtatggcagtgcccgtgttcaaggaacccttatttttacttcataatggccccaaagcacaagagtagtgatgctggcaatttggatatgtgaaagagaagccaaaatatgctccctttaagtgaaaaggtaaaagttttcaacttaataagaaaaagaatccgatgctgaggttggtaagctctacagtaagaatgaatcttctatccgtgaaattgtaaagaaggaaaaagaaatttgtgccagttttgctgtcacacctcgaactgcaaaaggtaccgccacagcgcacgctaagtgcttagttaagatagaaaaggcattgaatgtgtgggtgggagacatgaacagaaacacgttccagttgacagcaactggacccaagctatcaggaggtcagtgctatctttggtttcaggcatccactgtgggtcttggaacacatgccctgaagataaggggggactacgtatgaatctcccatgtgggcctgaagagaggctgagacgcagagaaggctccatgcctctcccaaagtcagagcgtcgggaaaggaccacctcaccaggccaggagagctcacgggggtcccgtccatccctcctcccacagcaacagcaacctccattctgtggttccacaaatccttcttcctttgtttgtatttttgagacggagtcttgctctgtcgcccaggctggagtgcagtggtgcgatctcggctcactgcaagctccgcctcccgggttcacgccattctcctgcctcagcctcccgagtagctgggactacaggtgcctgccaccacggccagctaattttttttttttgtatttttcgtagagacggggtttcaccgtgttagccaggatggtctcgatctcctgacctcgtgatcttcccgcctcggcctcccaaagtgctgggattacaggcgtgagccaccgcgcccggcctccacaaatccttcttgcagctcctaaagcctagagtttgagctaaagcaccagctccacttgcctctaggtacctctagaaggtacttcaaggcttgggaaaaagcatggagatttctctgttatctcaaaggctgagtggaagaaacaggaaagtcccagtccatctctgagtgccatggcactgatagtgttaataataataaaacagtccccactatgctacactcgctatgagccagacactgccctaagctctatatatgcattatttcatctgatcttctaaacaaccctataggtgaggtattattaaattcctcattttacaaataaaaaggcccggcacagtggctcatgcctgtaatcccaacactttgtggggccgagttaggaggactgcttgaatccagaagtttgagggcagcctggaaaacatagtgacaccctgttctctgtaaaaaaaatcaaaaaattagccgggcgtggtagcacacgcctgtggtcccagctacttgggaggctgaggtaggaggattgcttggatccagaagatcacggctgcagtgggcctggagtgacagagcaagaccctgtctcaaaaaaagaaagaaagaaagaaagaaagaaaaagaaacaggtgtagggctggacacatggctcatgtctctaattctagtactttgggaggccgaggcaggaggatcacttaagcccaagagtttaagacctgcctgggaaacacagggagacaccatctctacaaaaaaatacaaataaaaattagctgggtatggtggcacacacctgtgggcccagctactcagaaggctggggtgggaggatcactccagcctaggcaacagagtgaaacagagtgagaccttgtctcaaaaaagaaaggacagaaagacaagggagagagggagggagggatagagggggaggggaagagagagagagagagaaaggaaggaaggaaggaaggaaagaaaggaaaggaaaggaaaggaaaggaggggctcagagggaacaagtaacttattacaagttcagggtggttgtaagtaacagagctgagatttgaaccgatatctgtctgtttccagagcctgaggtcttcagagcccaccaggaggactatagctgagagatcactcctcctcccaagaccttggtctctagggtcctgcagcagggatgaggccactgcgcctgcagccccactcaaaaccctctgggacaccacgcccctggcttccgctcctgcccttacctctatctggtcaatggtctcctgatactccttctcccgggttttgaacagggactccgtatctttaatcaccttctccaggctatcttcctgctgctggagtagaaagggaagcgggggaggccagccaaggagggatgggatgggacgcattccaaagggccaagtcagggagagagagagagaggaagtctggttaaagaaactggagaaagaaaagcaaaaggataaaggaagaggggagacgcaggtagaggatgacagccacatggggggacagagcaaggagaggagcgggggagtgg

SEQ ID NO: 605 - DNA, 1339 bp, Homo sapiens
ccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 606 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 607 - DNA, 43672 bp, Mus musculus
  misc_feature (1)...(43672): n = A,T,C or G
aaacaaataatacattaatagatataagccagacatggtgtatggccaagacaggaagcttacaagttcaatgtcaatcttgggatgcatacaagacagtcttaaacatccttaggctggagggatgcctcagtggttaagagtgagtactgctcttgcaattatatgagttcaggtcccagtaccacatcttactcaagtctagccagatattttatctcttagatagaggcaggtacaggtattctggacatagagctaaacaatcaatgacttcacaaccactttgacctttgatcttcccagagaatcttctgtctgcatttactgtccaggaaaattacaaaactagactttggtcttccttaaagctttgactcagtccttagtggcctttcccaagttctctctgttagtattagtaatatcttctcttcttccatcttccaactacccccatactacctagaactcaaagccctcttgttgttgagcttagccattcccttcttcaagagccatattctcttcatcccatgggattcaatggggactggcatcatcagatgacaacaggcacaagactagacttgccagtcagcttctcccattccccagcttcagtgaccaggtgactgctccaagataagctcatacaataaccaagtcagataggtattatttttgagaaagatagactaatacctgagtagaattatggggcaatttttggtcttgatatacatgagccatagttgctatcatttgaaagggaacctaacagaaaaataaagcccacaaaaataaagtcaggaggtggaaaaggagaggccaaatcattgttgacaccattttagtgtttaggaagggccatctctgaagcagcaatcctgggcttttcgtttatatagaccaataaattctcatttgccttaacaatttcaaattaggtagcagtcatccatgagtcctaatcaatctacctccattcccacacattgattctacagtcactttgggagaaggggaaacttccttcctttcttccttctctccttactccttcctataactaaataacttcaataggatttccaactagcaaaaaatgtgttgccttttataatttgttaatgttttgcttggaggcctgggagttgaacctaggctctaagcacatgtcaatcaagggctagctgagctggctgtgactgtacggcaggcctaggcaggaacactgcaagatcaagatttaactgggctacaaacaaaatccaaggacagcgtaggaaacctaacaaggctctgactcaaaacaaaaaatttaagaaaagaaattggggagtgtggctcaatagcagaaggcatatgtagtataaggcatatctagtatatgcagggctctacatgggctcagcctccagaggtatatttaacactggaggtggggatagtgctacgtcttcatataatgtcttcataatatatatataaagggctgcctcagattaccaggtctgcctaactgctgaccctccactgcttctacatccatgttctgggattacaggaatgttccaccagcacataaagatcatttttcttgttctctcatgaaagtgtgttggaattagcagtcttaaacttataggatgacagcatatcccttatctcaagctataatttatcccatctagattttgtcacttccagcaaggctggcttttgtcctttgctgggtgtgcttggcctgttatgggacttgctacttctttgctcactgccttggctccattcacagagtcaaactgtgttctcagccgctctgtactgcgtgcttccttataatatgctgacatgggttttgttccactgtccttggtactccaggacctttgtgccatcatgtgaatgccggggacccctttgtgagtctccccaacataactcccagtttggtactgttaaaaggcgagacttagctgctttggtagtaccctgcctgtagtcccagaactcagagggatcaggggttccaggacagcttggctgacacagtgaggccacatctcaaaataaatgaattaaataaggaaagaaatcatattgttgtagtataatttctgtgagagattttataataaaagaagaaaactatgtggctcaaaaatttttataaaaatgctttctaggatttgtcttttgaatttattaaataacgcactaaatgcttccatctgacagtgacttcatttctgtgaacaaatgaagtgacttaaatacaggctcaacaggagctggagagatggctcagtggataagagcactgactgctcttccgaaggtcctgagttcaaatcccagcacccacatgggggctcacagccactcataatgagatctgacgctttcttctggtgtgtctgaagacagctacagcatacttatgtataataaatcttttttaaaaatacaggccaacagagaatactcatctaaatctgtgaatcccgggtaaaaatgttaagtgaaataaacgtaggcggaaggaacaaaagccaccaatgcgaaggtcagacggaatgcagttaatgtctaaattctctttaaatacttaaaaaacaaaacagaaagtcagcagttatcaatgagtcaatcaacttccagattcattctacccttacgagcttagcatccttcaagctcactgaacaggtgatttgtgttggacggggaccgtagacaacatttgccagatccttgccctaaaatagccctaaacatatgcaccctattatgtttgactcagccacatgctaagaactaggattcagtcttcttgagacaactatatcaacacagaaactccataaaatactaactggattacagagaaggttaagtcttgatagcaatctataagtcaactactcggtgtgtaaatgactcatcatgcaaatagtttgacctcacaatctatgcaaatgagattatcttttcatgctaccaattaaaacctagcctggagctatttgcagtcttgcttgtttactatatagacactgtgggatattcatgggaaacactgctgtaggtaatacagtgaccaagcaaacaaaatccaaacccaccaggcctgctgaagaaaaaggatgaagatagcgacagtgttttatattgctggaaactgacacctttgccctactttattggctacatttctattgctgtgataaaatattctgagaaaagaaccttaacaaaggtgaggtttgctttggcctggtctgaaatgcagttcatcacagcagggatgtggctggagcttgaagcagccgctctcttgcagtctgttggaagtcagactgcttgtgcttcgatgggtttctcctttgtattcagtccaggctccaacccatgggccaatccccttcacatttagagtggatctcccctccgcagttaacctaattcagatgatctctcaaaggtggctcccaggtgatgccagatcctgataagctgacaatcacttatcgttaaccatcactcccactccatctctatggggtcccaaggtttacctctagataaaggatcctccttgggtcagtgtcagatttctctaaaccaggcagagaagaaaggtctggcttgggctttgccttcagatgttaactagctagtcaatgaggcacagagcctgcatgcttgtaaagtataccaaaactctgtaaatgtatatcagaggaaaagaatgtctctcaggactttaatctacttgaacactttgtgaaggaaaggaacctttaactgggcctgtaaacatgcatgaaattatacagaggacaggggagtgattgcaacctaggaagaatgtgtggactcaagacacacggaagtgctgctagcagtttcctgacatgaggtagtggaccgaagaaccaggggttgactggatagcaattgtcaatttgttaaggccagaggctatcttatgcaggcaggcccgtgtcacggcttcagagttttagaagagccttttcatagtcagttctatcattcagtagtcttattcacccccaaggcgtcctttgctcacacagctcacctgtatactttgtaactttcggttcatttcccatgttcatattaactctttgtgtggaggtaaaattaaagaggaactatatgttgtttaaatctcaatacagttgtttaatctgaaactacacacacacacacacacacacacacacacacacacacaatctgactcagcctctgttgttggcagtccatctttgtttggcttccttgggttgctatgcaaatatagagaacattactgctttgggaaacaggattaactaaaatctaggtgcttaaactattccctagcccaatacaaacatgccagtgtgtttattcaacagtcactccaagggctcttgatgggctattttgcttcccactgtagtttactcgtagtaattcccctttaataccctattaaatgagagcgaaggtttccttttgtgtgtgaatgttctctcttaccactggcaaaatacaactctctctctctctctctctctctctctctctctctctctctcacacacacacacacacacacacacacacattctgagttttactttgcaacagggtctcaccatgtagacctggctggtctggaactcactatgtcgagcagactgtcctgaaactcagaagccctctgcttctatgtgctgagtgccgaagcccaccactcatcctcagctctgcaatacgatttctcgtgctgtctacatggttatcaaacagaagttatagaaacagaattaacaggtgcctggtgggatgctcagccctgtctaagcacccagcgtggcggtgtgcgcttgtcacagcagctctaagagactgaggagagaagcccctgggtttgagactatcctacatttcatggtaagactgtctcaaaaagcaaaacagacacaacttctaatgttctgtaaactttatatttatatataatacctcattctagaactatgagctttctctgaaaagtgactgaaagagaaaatattaaattttattttggaagatggagaaactagcaaaagacattggaaatcactgataattcattaactatcccagtagctgtttttttttatgtttaaacaaagtatttacctaacaaattgtgatgttagatcatttgtcagtgattaattataccaaaggaggtagtgctgtttaattccagtacttaggaggctgaaactgcagactcattaagtctgggctagcctgaactacaaagagaccctgtcacaaaaattacttttaaaaagggcatggatatagctcagtgatagatctgcttatatgaagtaggtcctgggttcaatcaatttttcagtactggaaatcaaacaacaaaatatcatataagattttttttctttgagctttgagataggatctctcatgttgtacagactggcctaaaacttgctgcatagccaagactaccttgaactcctgatcctcctacctccaactcctaagtgctgggattataagtgtatgccactaggccctgaccaaaccccacaatttataaaagtgcttctggagccaactaagacaggacacacatctgcagccccagatattctggaggttggggaaagatgatcagaagttcaaggccagtgtggtacaggcctacagtcaaaataactgggaggctgaaacaggaagagcagaacttcacagcccacccacccatccatccatgtatccatgcatccatgcatccatccatccatccatgcatccatccatccatgcatccatccatgcatccatccatccatgcatccatccatccatccatccatccatccattttctatctatctatctatctatctacctacctacctacctacctacctatctatcatcaatctatctatctatcgaggtttattctataaattctgttactctagagaaggaccctgacaaatacagggaactatcagaaaacaatattgtgtcaacccttccttcacaagccaaaagttaaatctgttatcacaaccagtgcaatacttatttttaagtgaagtcctgacctctagtggctacatagaataaccagtctactaaataattttaatgtcacgatgagaaaatgacactgcaactttcctaatgagaaacaatcagtaaaataaaataaatgtgaaactaattgaacttttatttttaaaaaatcaactttgaggccaggtgtaatggcaaattcctgaaatgacagcagcttgggagttggaggcaggaggatcaagagttcaaaggcatctacagctctgtagcaagcctgggagatccttctggaaagtaacagtaaaaacatcattgacaaaataagggttagtaagtagaaggtcagtgtgtgaaaataggggcacagacggaccaaaccacacagggccttaagtaacaggttcccagaccttattagaaacccagaccttaggccggtcagtggtggcgcacacctttaatcctagcacttgggaggcagaggcaagaggatttctaagttcaaggccagcctggtctacagagtgagttccaggacagccagggctatacagagaaaccctgtctcgaaaaacaaacaaacaaacaagaaatcctgatcttagcataactgactccattatgtaatgctcacatggctaaaaacctgaacaaagacctaatcaaccacagtccatagttctggaaaagtttctaaatgtacttaccttgctttttggcttctgcttctagctaactgttcatgttaacaagtgtgtcaacccagaatatggtttttgtgcttaaaaatctgccctgagaaaggttggggctacactgggatcccaaacacccaggatagtggcttgtcctgctcataaagactttctgttggcttaaacctgtgtcttgagtcttctctggtggatatgccataacaatatcaaagatgagtttatcttgtgaacaccaggggctgagcaaaaatatttaatattcaaatatttaactaaatttctagtacccaggtaatcttgtatcctccctgttaattaccacctttgtggtcagctcacccggtatccacacaaggcctgaaccagcttcatcaaggttctggacagggtcccaagggagaccagggatgaaagagaatgaagagataacaaaaaaaggaaagagtcaaaagctgggctcaggagggatgcaagggctgatgacccaggccgttacgcttattaactgcagacctctttaagtggggagacaaaacaagtcaaatagagagcatcaggcagtagaattacagggagttcagactacctcaagctcaaccttagcaaggcacattctaggagggcaaaccaagtgctttacatctcagtgtctagaacatctgaccacatacttacggactggaagccacgtgccagtttctggactatctcaggcccctggtgacagtccataggccttggctggcaggaccctgcctacgagagggggaaagctgccaacacccatcaccaaggcctccaggcagtcttcaatccagtctaagcccttatacatgctggtagtactgtgactcctctctcctagccttcacttcacactgagaagaatgccttgaattcagtgataaggaccggctacagagaggcaagacttagggagcaggggagaaaatgaaactcaagaaaatagcatgtagccaggttagagctaggaagccaagccttcaaccacaaaactgagacacacaaatgtgggggcactcaggacatcaagatccctgacagtgactggcatcactagcactctgagggccagagagggtgggcctctgctggaacagctttctgtctgatactgtctgatattgatgttttaaaactcagtgtagggttagttgtggtagtctgcactaatctcagctctcaggagccagaggtagatcaatttctgccgttttaaaaaccaacctggtctttataacaagtttcaggtcagccagagcaataataataacaataacaacaacagcagcagccaggacctgtgctggagccttgctctatccttattgcaatgctagcccagtccaggtggtgcaaaggtacactgtgaaccatgagcaaaatagcctaagggccagaaaaannnnnnnnnnnnnnnnnnnnaaaacaaaaaccaaccaaaaacatgatcatcaaatccttacagaatgaaatctgcatgtttgctgtggtttaatctaccattgtgaaagtcagccgacatctccattgccagctactctgtctaggaggttatctgttgtactctcacgacttctgtttcagatctaggctgttttgatttctgacacaagaccaatgctcacctagagtcagtgacaaagtccagtggagacagaattgtcttcatgaatggcttttttgttggtttgtttgaggcagtgtcttgctctgtaagtccagcctgtaagtcactgtgtaacatacaaaccttagatttgtgtctctcctgaatgctgggattacaggcatgaaccaccatgacagccaagggctggctttgaataaaactcttctacgaattctgctgagacaaacatttgactccagtagtgctaagactcaaatacttgtacaggagtgtttccagcagttctaacacaacagtatgaaggcagaaaatggcccatcaatttaaaaaaatcctcaaagccgggcagtggtggcacatgcctttaatcccagtttgggaggaagaggcagaggcaggcggatttctgagttcaaggccagcctggtctacagagtgagttccaggacagccagggttacacagagaaaccctgtctcgggaaaaaaaaaaaaaaatcctcaaccattcaacgtgctttgaagtgcggaattaccaccaaatatgatcgatcgtgcctctcctagatttttagaactcaacactgaggtggttaaaacaaaactgaatcggtgttgggggacagattgcctgataaagacacttgcggccaaccctgactttctgagcctgaaccccaggatcgagaagaggaaaacggaatcccacaagttgtctgtcctgtgacctccaaatgtgccgcatgcatatatgcacgaaataggtgtaaaagggacttaaggacttcgccggctcctgacataccacaagcaagctttaagctctgcactcactaactttgataaagatgtttcacaaagtttggaagttcaaccgcttccagccctacgaaagttaacgctcatgctctcccgcgccacgcaaaccggccggacaacttgctccagccttctgcgcacacctaaagctactctaaagccctagaaagccagggttcctcggctgcgctagtagcgccttccaaaatgtccagccaccgccccgcttccaaccccgcccacagccccgcccagtccgccaatcagaagagcggccgccggaactcgctgttggagctgtaagtgagcgttgtgtcgggccttgtacgacctcaaggcccgcccccttccactagcaacgcaccaatcggaagcgcggccgcaggaagtggcggttggaggtgtgggtgggcgttacagcaggccttaggtgagttctgcggccggaggtggtgggtgacttaggtgggctggccggcgggctagcgggtgtcggtctagtgtcgtggagcggccgggatctgaagtgacgggaggaggtcgatccgcgtttcggagattccggggttgggcgggcacctcggcggccattctgcgtgaacgcccctccgcactccgcggcgccgctcgcctgcacttttgctaatagcttgttctttgggctctgctacaggtatttctggaaaatcgctgcaaggttggcagaatgcttcttcagggcggagtgcggtgtgactgttgagtagaggttgcttctctgtggagttggcgttctgagggtaaagcctgggttaaaaaaaaaaaatctgcagttgggacccaagttcaccagggaaattagtttagctgatgtctactctgggagccatcttttatcgccatcagagtacctagttaggacgccaagtgcaaaagcgatgtgcatagactggagacagattatgattgatataaacttaacatcaaaattaagaaaaaaaataggtgagtgctctcatcaagtcagttcgtaaggctttgcttaaggaaaaaaaatgggtgcaggtttgagtaggctgaaggttgggaataatagaacctcaggttataaattgagaagggacagaatgtgataagactgtgataataggtgagtcgtttgcattgaattctttgtaaacttgagatgtcaataagtttataatgggttcgtttataatagtttccacatgggttcttggttcttatatgtacaagcagagtataagagataacacaaagtttgttcttttacgcaataaagtagtatagtatcccttctaatttagtaaaaagtaactgtaatttgagttaccacattggatttgtgagtcttgttatttaggtttagtggtcaaaaaaaatcacctaaattttgcttatacttcctctagtaactcaaagacaggaataatattcttaaaaagatacgtttttttttggggggggggtctgggggacttttgggatagcatttgaaatgtaaatgaagaaaatacctaattaaaaaaataaatttaaaaaagtttaaaaaaaagatgtttttggcttggcttttaaaaactagtactggactggagagatggctcagtgattaagagcactgactactcttccagacatcctgagttcaaatcccagcaaccacatggtggctcacaaccacccataatgagatctgatgccctcttctggtgtgtctgaagacagctacagtatacttatatataataaataaataaataaataaaatcttttaaaaaaacctacagctacagtgtacttataataaataaataataagtaaataaataaaatctttttaaaaaacctaatactatcagataatatttctttagcctgtactggcttaaggaggtccttccctccgaaaaagttttgtataggaaatctggttttctgtcactagaatttgtactttaacagagttgtgtagtttctgtggcagtaagtgcaaattgataggtgaaaaattgtaaaacaacttagtgtcttcagagcagagggtatcatctttggtaggcaggaagggttagaacagtgggcttccacggtggtgtttccttatttctgggtcccccactctactctagactttgaccagaatccagatactgggacatgggcatccatcctaaagctgggtaggtcacttggtttgtaaggcaggatgagaccccctgcattatgggaaagatttttcaaagatgtttctcctttttttaagtaaaagtattagagaagtctggaaatgtagcctggggcacttgggggaataggagttttctggttttgccatcagtgtgattaaaaactgaatttgaaagtgaccccacatagctgtcaaagccagtggtcaggttgtagaatctgcagggaaggcagtttaaaagtgttgttgtaaaagccagtgttttctcagtgttgtattactttggcctgtgtgaggtagtggtttgaattctctgacttttttgccctactccatgagagctgtttttcatctgtttgtaggtgggtttaatacattctctggtagaagtttgttttaaagatatgttaggaacgtatgtgccttgagtacttttcctgataatgacagtctttcttttttgcagtcttatgctaacagttcctatttgttttttcctgcagtatagaagaagacatggtttccaccccacttccacagcacgtctaagttttatcttttttggggtccttatctgttgccacaatggtaagctgtgaatatagcgtgttaaaatgtgtatcctatactattctcttcctttagctccataaaaatattgtgaatagaaagactcagataacttagtagtcatgcctaacttttttctagaaaatgtctaactcatatcttgtcaattcagtggtaggacatttaagttagacaaatccttcatgtattaaaagtcaactctgctttgccatttttctgagtctttgataaggaggttgatataaatgaagcttattttgggggaggccctcataatttaagtttcttcttccatcttttttgtctatgtttgttctgtgcatgtggcctatatgtttggtaaagaagtgatcgcaatgtcgatgttcctcctttatccctgtcccccttttattttgagacagtccattaggcctagaacttgctgagtaggccaggctggcccctgaggtatacgtcccccttattgggatccctgcttgtgccccactgtcttgctttcttgtacagattctggagtttgaactcagttattcatgattgtgtggcagtcacgtggactgaactatttccccaaactccttcacctgggtgctttaaaattaataaatgtaggcaggtttagtttgacacagatgtaattccagtacttgggacactcaggtcaaaggatccccaagagttgaaggccagcttaggctagaaagagagctccagccagcataggctacagagtttctaaaccctgcctcttcttcccccatcccccatcccatcctcacttttgtgcagatatacctgcagtggagcccagaggacaagctgttactacagttgagaggcaggtggggtggggtggggtggggttagagacaggctgtagaggacgtgtgtcgtcatcttcctgctctgtaggacttgcctatttacttctacttggttagaaataatgggagttgtccctgtgggattcttgcctttcatgtatacgtattaaatggtatacctaagtgcttgaagggagtagtgaacactcaatacgagcatgtctagcttccaggtcctgactgcagtgccattttagcatttgttatgatcaagtgcccagccattaaaaaaaaaaaaaaccttagtaacgcattggaggatagaggagaggaaaaacacattgctcttttttcagaaaatgaaacaaacacttaataacgagtgtcaagtgttattttttctgaaaataattaatattgccaaatctgctatttgctttttccagcaacaagctgtagaacaagctttggattgcgcagaggtgagccctactgattaaatgttgaaatactggggtttgtaactgacagaaagtccttaataggacattttgataaccctcaagagaacagtattttaaaccagaccacagaatttgtaaagttgtttttctatcttgatgagtttctctaaaataccttaaaatatgggtcactgcactcaaatgtgtaattttaaaataaatttaaaacttttagaatatatttgtcctgtggaattgcattttatggtactaaaacactgggctgggtcttgggctctatggcctgtgtacaagcgtgagctcaggcttgtcagagcctaggagactgagtgggctgctctcactgtcctgctgcgggcttgcagctcgcttgcactcactcgtaggaaagcggaaggcaagccctttgaccaacttctctgtttcagtacatcgtggaaagtgctcagcagagacctcctaaaaggaaatacctgtctagtggaaggtatgactgcttaatcggtaacgcccaagtcagtgaaataggataactaccacttactgtagacattgaaatgttgtcagttctttgtatgggcaggttgagcatccttgatactccacaatatgcagcttaggaatcttgatggagtgtcacaaatgggcattttcttttctttttaaaaaattttttaatttttcatttatttcttacactccatattccattccccaccccctccatccaccctccgactggactgctctacatccccacacctcctccccaccccatgccttctccacatggatgcccccaccccctaccctacctgacctctaaacttcctggggcctccagtcccttgagggttaggtgcatcatctgaatgaacacagacctggaagtcctctactgtgtatgtgttgggggcctcatatcagctggtgtgtgctgcctgtttggtggtccagtgtttgaaagatctcgggggtccagattaattgagactgttggttctccttcaagatcgcccttctcctcatcttgtttcagccttccctaattcaacaacgggggtcagctgcttctgtccattggttgggtgcaaatatctgtatctgactctttcagctgcttgttgggtgtttcagaggatagatccctttttgtgagcactccatagccttagtaatagtgtcaggccttgagctggatcccactttgggcttgttgctggaccttcttttcctcaggctcctctccatttccatccctgtaattctttcagacaggaacaattatgggtcagagatgtaactgtgggatggcaaccccatccctctcttgatgtcctgtcttcctgctggaggtgggctttataagtttcctctccttactattgggcatttcatctaaggtccctccctttgagtcctgagagacgagagactctcacttcacaggtctctcgtgaattctgggggcagggagggtcccaaccttctatttcctgaggttgcctgtttccttttttttttcttctggccctcagggcttcagtcctttcccctcacccaataccagatcagattcccctctcccctcaaccccttcccctaccctgtccactttcccttcctccctacttgtgacaaatggacattttcatgtctaacttatgtgacagattacagttagaatgctacacagtaaaaagtggtatataagattgtcttacatgtctttatgaagatgtatgtgaccctacactatagtctcatatttcagaaactaaagtccaaaacagtacaaatctaaagcattttaaatcatccagggatcctcagactgcattatgggttcttagttgagccggttagtgtaaccatgttgaattggcattgtacagaaattaaaagacatgttgatgtagaaacattgaagccaatatcttgtaatatatacagggtaatgtactatattaattaaagtcttatctttcaagttttggttacagaattaaaatatttaaaataacgaaaagcaaacaatcttcacattgaatatttattgctttttttctagaaagtctatatttcaaaaactttatgacttatatgttgaagaatgtgaaaaagaacccgaggttaaggtaaatataaattctttaaagtattgggctttggagttgtggtagaatggagaaggtctttagaacattatgtttgaagcagctagtgatttgtatgttcatagttgaacatctttttcagtcagactgcagtcagctgtaaagctgagtggttacattccctagctaatctgagttagtaggtgaagagcactgtacacgcagtcataggcgatcatagacaaagccacagtgtcgtctgttggctgcctttgagacctggcttttcagacgtgcggatggatctcagtaacccttttcttgagatttatccacacacatgggaagagttcagatgtaccagtgaaaatgaattgtatcagagaataagcttatagctaactcatttttattcagcataaaggtatctatagttataatcaacagcaattgaccttttttgttgttgttaagcaaagttgcaatttattcaagaaaggatttctcgtgtgtggtttgtgtgagatgtgggttttactgttctggcatagaactcatggagcgcccccagaggcttgggattgtgtgtacacacagctttaaggaaaaaaatgtatatggacttaaacatgggcattaggcagttcataatttacccgaaatttaacttctctggctaaaagtgtttgaggggctttgtgagcttctactgtctgatttttaaaatgtcttagggggaaaaaaacccttaaatttataagtaattattatggcatatttttccatgttttattcaagtattacctagcagattgcatatttaaagcatatgggttttttaatgtttgtaaagtcataataatttgcataatttctatatccatcattttagaaactagaactaagagagagagaaggggagagggagcaggagagagagatcctaaagaatctaaagggagtctgcaagccctgcatgatgtatagttgtctgcctgcttttaagctacagaggcagagctgagcaattagtgggccctggagccaaagatgctatctgcccatttaagaaaaacatttccagccaataggtttttgttgttgttgttgttgctgctgctaattgttttatggttttattttgttttgagataaagtacccacccccttcattttcagattgcatagtgtttccattttgttttgtttttgttttgttttgttttttggttatctgagacagggtttctctgtgtagccctggctgtcctgggactcactctgtagaccagtctggccttaaactcagaaatctgcctgcctcacgagtgctaggactaaaggcgtgcgccaccacgcccggctgttctgttttgatattgataaaaatgtgtgattcttggggccagtgagatagtacagcagataaagggatttgctatgaagcctaagaggattcccaggatctgcatggtggaaggagagaactgacttccacaaattgttctctgacatccacaggaagcctgtggtgtgggataccccacctgacacacagtaatgagtttaaagttagacatttaatataaggtaatcaaaacagatttgtggttttaaatattgaaaagaaattatctcatgtttttcctaaaatagatgaaatgagtttaatctctaagttggtttcatgcaaaaccacatattataaaattgtggattttgatatgtgtgcacgtttctagatatgtgtttaaaaaattcaggtgtttaagttatatcatacttgaataaaatatatgggacatatgatataatattttaaaatattataaataattgaatttatagaaaactgtctaaacaatttttttcaccagttagctcttttcaggctcagcatttcaggtgacttgacttgctgaacaacttcacatctaaggagattatgagttgctaagaaatttggccttatcactgtgcagtgaaagcagtcccccattcttcatgcataggttgcgtttctctttctttctcctttcttccttttgtttctgtcttccctttgagaccccagtgggccttcaagtattatgatgatactttgcctcagcctgctgtatgctgtgcttatagacatcagctgccatgctttttgttgttgtttgtttaaaacactgcttttcagccttcctagtgctgtggccctttaatacggttaatatagtttctttttttttcttctttatttttttggtttttttttgtttgtttgtttgtttttgagacagggtttctctgtatagctctggctgtcctggaactcactttgtagaccaggctggcctcgaactcagaaatccacctgcctctgcctcccaagtgccgggattgaaggtgtgcgccaccaccgcccggtttcttatgttgtgtaccccaactataaaatgacttgtgttgctacttcataactgtaattgcctcataactgaatcataatgtaaatatctgatttctgatggtctgaggagacccctgtgaaggttattagacccccaaaggggttgtgacccacagactgagaaccactggtttaaaagctagtattgctatgtaataagatccatgctggcctggaactcaatctttttgccttggcatcttccgagtgctgagattgcaggtatatatccatgcatagtaagtttatggtgtgagttattttgcctaaagcatgctagtgacattactgtcctgtgaattgtgacagtttccaggtattcgggattgtagtatggaaaggtcaccaacaggtatatactgttttcataaacttcacttctttttaaagcagaaattaagaagaaatgtgaacttgttagagaagcttgttatgcaggagactttgtcgtgtttagtagtcaatctgtacccaggaaatgaaggctattctctgatgctcagggggaaaaatggatcaggtaagaccgtataaagtatgcctgccacaaaacacctctgcttttgaaagttagctcttaaaaaattaaaagttgacctttaatcagagtttatcctgattaaaagacaaattcttatttattccatactctttctcttcatgacctttgccagaatgtttgacattgttgtagagtgtagatgattcttccagagcctgcatttgaaaattattgtaattgattgtatctttaaaactttaggttaattaattttgttttatgtgaatggatgttttgcctgcatatatatctgtgcaccacatgtgtgcctggtacctttcagggtccagaagaagagattgcatacactgaaacaaacttatagatgattttgagccaccttgtgggtgctgggaattgaacaggggtcctctagagcagcctgagctcttaatgcctgagccgtctcctcactccctatctccttttatattttactttatttagttggaggtggggggaggactgggccacttgtgtagtaggtcccagtgagagcactcaggtgttcaggcttagttccaagtgctttggccttagccacctagccatcccgccagcctgattatgtcttcgagttaatagaacaggtgattcttaacagttatatttcttttaatgctctctatactttaagatattttagctgcattttatatactgagtataaaaacttgtaaagcattcattgccttttaagtaatttttattgagacagcaaaaaaatagtaaacactgaagatatttctaaaaagattttctaatactggggatgtgaagagcattaaaacatgaatattcttagatttcactgaaagaggcacctcagaattgaatcatgtgagcactacaaggagcttagctagtgaagaatatagcttagttgttagactactcgcctagcatgcacagagctgggagtgtagtccatggcaccgtatgaacccgatgtggcatccctgatctagaatccaaactcttagcatgcagaggtagaaagaggataagacacgcctattttcctgttcttatttaaaatgttatctacgcaacacgttctttcagcactacaatatggcactcaaaggcttatgagactaagcctttgagctgtgtttttaagatttatttttattttaatttatgtgtatgtgtatatannnnnnnnnnnnnnnnnnnntatgagctgtcctgtggataccaggtatagaacccaggtcttctgcaagaatggcaagtgctcttaatcactgagccctctctttagcctagtgtattctatttttaacagtaatttaagttacagtcctaacctctctgtgagctggttcttataaactttgtttttaaattgagattctgagaccatccgattgccttatgaagaaggagaattgcttgaatacttagatgcagaagaattacctcctattttggtggatctccttgaaaaatcacaggtaagaaaacaaaacaagacaaaatactgttttacaaataacatatgtataatagcattgctaccatagctacttagaaggctgaaacaggagcatcttaaggaagtttgaagccagcctgggcaatgtagcaaaactccatttctaaaattttgtgtgtacatatatacgtgtgtgtgtgtgtgtgtgtgtgtgtatacatacacatatgcgtgtgtagatacatatgtgcatatatacatacacatgtttatatatatgtgtatatatatgtatacatacatatatatgcaaaatgaaatgtcttttttaatcccttttgtggcactggttagtgaactaaggcctcatatatgttagactatcaatttacaacaaatatacctgattgccagaaaaaatgttttgtatggtatacagcatgtgtgttgtgtgctgttttagttgttttagtttagtttagtttacaaataacatatgtatagtagcattgctaccatagctacttagaaggctgaaacaggagcatcttaaggaagtttgaagccagcctgggcaatgtagcaaaactccatttctaaaattttgtgtgtacatatatacgtatgtgtgtgtgtgtgtgtttgtttagttgttacgtatcatttgtgtgtggttttgttttatgagacatgaatttgtttgtagcccggatggctcagaactggtgatattcttgcttcatccccttgaatgctaccgttatagactgagccgccacacacactagcattctcagtagtgtttaaggcatagtgccgaggactgctctcagtgggtccctcaacctgcagggaatcagggtttccataatcaggtggacaaggagtcggcgggatgacaaacagacacgaacacagagagaatgctgtatctgaatgtaatttctcaaagtgagcatcagactttttttttttggttggttttttcgagacggggtttctctgtgtagtcctgggtgtcctggaactcactttgtagaccaggctggcctcgaactcagaaatctgcctgcctctgcctcccaagtgctgggactaaaggcgtgcgccaccacgcccagctgaacctcagacttatattaaggtcatccaaggtacattgaagttaccctttgcaaaacgacttttacgcaaaccagaggaatgcatacataaaagctaacaggaaccaatggggataaaaatcaatgttaacaacttggatcaaaagctgccccacctaaggtcagtttattcttagaagccatgggcaagggttttgtgcccttcccatagttccaattctagtctattatataatccaccttccccttaggccattgtaaattcctgtgtatgggagtgacttggctgttgttctgagtatactttgtagactagccctgagatttctagctctataccagtaaattgtaatgcctgattcctctactgtctcactgtcaacactggaggcttttcatctgaatgagtgacattcttacaagaatcaaagcccaagattggctcaaccatttcctaggatattggaaccctggtgaaagctaatctaacttagctatatgtcaaaatcaatccttagaggcccttataataaaacaatatagaagggaagcacacagatccgttcactgactaacgcaaggacaggtttggagcattcattttacaggatgccaaggctccaggagactgagtttccctgaaactttttgcctcagaactgcctcctagcttttgggcctgtcacgcagttacttaccactggagtgggtgtggcagcatagcatgagatgccgcagcagtgccgtttaaaatgtttattgtaccttacttatttgctgcactgccataggcagcttagtacttctacaattgctgtaataaattaccctggaaatgtcccaaggttaaaattcaattctggaagaatctgttttcgctgtttatgaagtgtgcttacacatcagaaacaaggtactttaaaaagtaacctggaggtgaccacttgccctgctctccttgctgtcttggcctgactcccatcccttcctggtaccagtggaccaatattcttgcatctctcttcacactttctttgctgttatcatgggtgaattccattcctaaggcctgcccctcatttcatttctaaatgttacccttctccgtggcttacaaccataatttcccaccagatacagatcacaaacatgctgtgttctcaacttgaaaacctctcctgacctcattgtttttctcagctgctgatttagaggtctccttatcacttccaagcttgtctgtgatctcctttttatcatctttctttgctcacctatccagcactccttagctgactctaccggtgtggcatcattagtcactttctgtttgaatttcagtcagttagtatacaggtggaatgttgcatgcctttcatcccagcattggggagagtcggaagttaaaggcatcttcagcttcatgttcatttaataagtaaagtaaatagaaaaatgattacagggaaaacagtttacacatgtgtggttggttgtttggggaatattgaatggatgaagatactgccaatagctggatgtttaactgagttgattaaaagagggttgttctcattaatctcggctagagaaatagctagtggttggccttaggtagcaggttatgtgctgtacagagctttaagggcaggagtgattagaataactaggcgggtgtaggtaggtattggtatagtacgctcccaatggctaacaacagaatggtaaaaggtgcagtgttggcttaatgtaacattgtaaatagtcattgtcaagattgtgattagtagatcccgagcataaatagaagtgctttaaagaaagcgtgcacacaaggaagtagctcctagattaactgttaggattgggtctggttgattaaaggtaatgactactatggtggtattgatttggatttgagcacaaatagctgtaatggtgtaaaatacctgaaatatacatttgcgagggatggataggaggtgagttgcagcaaagagtgctaaggtttcttaagcctgcaacacagcatagttggagttaagtctgtggctagctccttttgttagtacactctaaaagtctagaaattttaggaaagcaaatagtgaaggtttatctaaaggctgaaattctggcacagttgattgacagtgtgtaacagtgacaaactactacataacaatggcgcagctagcagagtgcagtgatgagcctgggagctcagtctcaggagctacagtaacctcccctctaacgtacggacgccagagtcatcctgatgtcagtggatgcaattgctctttcatcctgatgtcagtggatgcaattgctctttataatgatgaacctagaaataaataaataaataaataaataaataaataaataaataaataaataaataaaggtatatccagtaaagagacccactgaatgtatagagcttaaagaatgggaaccattcactacatggttgcttattttggtgaactcgtttattatttgaaagcttgtatattatctgaaaaatgacatttacctgaacattgtttttttttttacttaacaggttaatatttttcattgtggatgtgtgatagcagaaatacgtgactataggcagtccagtaatatgaagtctcctggttaccaaagtaggcacattctcttacgtccaacaatgcaggtatggaaagtttaattagaaagtactggcttttgttttagttggatttttattaaatgtctgtatatttgtaagaacatacctgttttttaaatgttttgttttttctagactttagtctgtgatgtccattctataacaagtgacaaccataagtggacccaggttagttctctctctaaccccaagtaggccacactcaatgtgaagcatcagtgagacgctcccttgctgacgttagagtggtgtgttaggttggatgcttggacaaaaccaaggttcccttacgagctttagggtcttgtacttcctgtatatttagaaatccctcaaggaactgcttatagtccagtcccagttgtttccagccttgctgataaactggagttaagttaaccaatgaagcctaatgtaaaaattgttttttttatcctcttgaacaaaagcttcattgttactattgaaaacaaatagattgtgattttccttcatataggattctataattctacaggaagcctggcttttatcccttccttccttcatccctttcttcctttcttttctttttctttttgaggtaagatctctagcctaggctggcttgggatttgagatcctgctacctgagcctcctgaggtctgagtgtctctctctctctctctctctctctctttctctctctctctctctctcactcacacacgcacacgcacacggtctaacaggacttcttagcgctgacatcagctaattgatactttagttctagctcttgtttacctgttgctttggagagaaaatgtcagtaatgtgaggttatcctctgtgaaatgtgcttgtgaattaagattcagtttatctgtaactcgtgagtgatgaggtttaatctgggctgttatttttctatctataaggttggaagttgttcttgttagagacaaacttgcattcacactagagagcagaaagcatcattttcttaagccgaggactagtaaaagagagagtataactattctcagatattctaccatttctggatccactattttaaacagccaaataaatacccactccgtggatgtgactgttttataaatcatgcagataattcggtttccattagaagtttctttatcttgttaatgttcaaacttgagttactgctacattcactttagtcttcagcaacttcctgagaatatttctgggtaaatgatgtatgtttacattatcaaaaatgcatctgaggctgacatacaactgtgtatttcaggaagacaaacttttgcttgagagccagctgattctagctacagcagagccactgtgtcttgacccatcggtggcagtagcgtgcactgccaataggctgctctataaccggcagaagatgaacactcgcccaatgaaacggtaaccaccagcacttgggtaacacaggctcttaagtttgacatcgttgctagccagagtgccctttcccttggcatgtgagggctggaattctaagttcaaaaatgggatttttcatggccttgtattgtggatttatgttatagacctttttaaaaaatattttctgcattattataaagtaatattttcctcagtcttttaaagaaggaacttttataagtttatggtctgttcaccaaaatggttgtgaggctgtaagaagactagatagaaacagaagggtagttgcttcactgcttctcaacactaattggaatcagttaacaaggaaacaatgtgtaacttaacgagttttgagaaaatacaatcacaatttttagagattagcttataatgactgcctctctagttctggattcaaactagtgtggctccatggtcatgagtattttgtcttgttctttttctttcacctgtgcttaaagcttgctggtgtgaaagttgtatttatagatggagtgtgtgagtgtgtgtgtggtaagtgggtatctgtgatggagtctgtgatctgtgcctgctccttttccccgtgtggtagagttgctgcttcattgcttcctgtctgttgtaggtgttggaagaggtactccaggtcctccctgaaccgccagcaggacctctctcacggccctcctccccctcagctgagactacttgatttcttacaaaagcggaaggaaaggaaagcaggccagcattatgacctcaaaatttccaaagcaggaaatgtaagtagtcgctaaggtgctcgctgtacgaatgactggctgtgctttagggtttccgagtgactgtactgtttttacttttcagtgtgtagacatgtggaaacggagcccctgtaacttggctgtgccttctgaagtagatgtaagttcatgaaaaagctgtacactgacacagggtcaaaggccagcattaggaagccagtgctgtgaggaagtgaagggaagaaaagagcagcttgtttgaaacagtaaaagttgtcatttcaagagtctgtcgtatcagtcatgtaagtctgtggtattgagtggaccgccaatccagcctcagttagttacataagagcatacatttgaatagagttctgtgttaggagcagaaagaatgttaaggcttccaaatgtggaaagagtatggcatattttatatagtgacaggaaatgaccttgtgccattctgtagtggtccttcataattaactcaaaatgcttccgtgttcaaactggtaaaatttaaagatgagtaatcttagaaatttggaattaccaatagtattgtttactaatattcataagacacatgagtgctaagtgatcataaaggcattataaaggactattttagatttcattttttgtttctcttagtatgtattttttagatatatatttggtgtgtgtgtccgtgtgcagactataacacatatggaaaaccagagagcaaccattgagggatgagtctttgcttctaccacggtattcctgggctgcagactcggaacttcaagtttcagtggcaagagcctttacctgctaagcaatcttgccagtttacttaattctttatgatagttgtttcaaaaattatttactatttcaagaatgctttttgtaacaattctagcagttcttgctgttttaacagttaaagcacaaagccagagacatctatagactatgtatacaaaccaagaaagaaagccatattatcttgttgcatatgtggcctccaggcatccagtgctcttaacctcttaaccatctgtagtcccacatgcgacacttaattaaacatatcaggaggtttaaaacttgacaagtgcttggtgatactgctagttgagacccttgtgcccacattgattctgtgaactgtgcaggttcttgtctttgttccgatactgactatatttgattcaacatcttcattgtttaggtggaaaaatatgctaaagtggaggaatccatcaaatctgacgactcacagccaacaatgtggccagctcatgtaagtaatcagttccaatctctttgactaatgatccagttgcccgtgtattttttttgtttggagacagtgtctcttttggcccaaactggcttcaaacttgtagtgtagtcaaggttgacctcagacatactgatcctctggctttcactgcccaggtgccagacgtgcctcttccgtattgtaaagtatgttgtttataagctgggctctgaagttattaaacagaaaacaacttttaatgtataagtttttttttaagtgtatttggagtacttgtgggcttcaggaaaatataattaaccctgagtgtgtttttcactttacagagaagttttaatataacactacctttttatgtggggcattggagcccatgcctgtaatctcagctcttggaggcaggggcaggaagctctcaacttgatggccagtctgagccacatagggagctattcaaaaaccaaattaggagtccagcccaatggtacataactgtaagtccagaatagggaaactgctgctgggaaaaagatgtctctgagacagcctgggctacagagtgagactctttcagaaaactagtgcaatgttctgttctgcctacttgttggtggtcctcacctgtcttgtttcaaattagtgtgttcttgtaaagatgttcttgtttgagcggtggtctcctgtgtgaccgaggcttgcctggaactttgcttctttacagctgctctctcacttgtcgccattctgccgcctgcctctgcctcctgagtactgggattataggcatgtgccacagtgcctggcttaaagacagctctgaagggaaatgttctgatgctctcatcgtaatagtctcttaaagggagaagttggaataacattttgaatggactctaagcacaagataataagatttatagacatctttaggatgttttgtatgaatggcatatgacaaaaatatttccactttgaaactttatactcagattgttaactattgcagttgtgtgtacaatgagtgaatctctgtgagtgtcttcctggcttggagagatgccacattggagcacttagcataaaggaaggtaaagaaagggctctgtgaactcagttccctctgagggcttgggttgttacattcctttacatttatttatttgtttattatttgtaagacaggctcttatgatatagttctagctgtcctggaacttattgtatagaccaggctggtcttgaaagagatgagcctgcctctgtctcccaagtgctggagttaaagacacatgccaccacacctgacaagtccatgtacctgtaatgtgggaatggccacaccagccatgggttttgttgacagttggatgagaaactacttgttaagtgctgtgacaatgtccagtcattttttttatacttttcattgtgtgtagaaatgtataacactttcctaataaatgattcaataacatgcacaatcatacatggccttaaacattcctttagtgccatgtatatagcagacagaagttagtctttattttattatttgttgttgttgataacttttgctacttgagaagaaatgacttgggattctctgttcttttcaggatgtaaaagacgattatgtatttgaatgtgaaggtggtaatcagtatcagaaaacaaagctgaccatcttgcagtctcttggggatccactttactatggtaaaatacagccgtggaaagcagatgaagaaaatgacagccaaatgtctccatcccagtgagtcctgatgagtatatgtaatagacagggccatccagaacctatagagagctaccaaggagctgcttgctagctgatgagtacatttccctctgagggttggtacctgatacagaacagtgtgttttgacagtggatgtaaggttgagtgcagttgttacttagaattagtttttaaagagcagataattatattcaggatagtcttgggatttcgttgttggtatattttatattactggcaatttatgtagttgattttctaagtggtacatcattagtgaagggtactaattatcatttttggtttgggagtaactggggagtgtaggcagggtctgtgactccctagtttgcctggaacatgttatggagacaaggctggtctcaactccctgagatcagcctgcctttgtcgctgccttctgagtgctgggataattttgattctatggtttcttcgtttttttgttttttgttttttaacaaatcacaaaatgaaaaaaaaaaaaaagtagagttcagttgtatgtcaaattattgttaaaacccttaccaaaatttgtgaagaacgatgggtgttagagttacttcatacccaggtaacagtcgccacgaagagctagcagcagttcgtggattgacagctatcagctggtttgattatgcatatctctgaagttcgtccctcattcaccatgtggctatgccagcatggctacagtgtaaggcacagtagctgcgcctttgtaaaggtgcggttcccatggccatggactgcttcggggagacggctgatgcccctgccgttattctgcaggatctgcactcttctacgttcttccatgttcagaacctgagagctatgaagcttaggtttggctttccttaactgagtgcttctctttcattttgtatttcagctcctctgctgatgaccattcaaactggtaattaaaaaataagattcacttgttttaatatgttaagttataatgtcaaaattttaaaaactggaaaagatttttttttttagtatttcttagaaacgatttttgtttcagttggcaataagctttcatcttgtgtaaaataagtttaagaatgacttccagaattgagttaagtgaatgaaaagccacagaccactcagtagttgagtaattttactagagggacaatgtttgtaaacttgtatagtggttcttggtaattttattctagattgtgtaaattacaaataaacattaaaataaatttctcctaaggtgagccagccaaattgattattttatgatgaatgtacaacttgagcattatctctcatgtttaattaaatttttaatgtaatgataccttggtagagttttaaatgaatttgtaatatattgatgtgactaagtgtgaaaggctttaaagattaactcaagctgttttaagacactcttgcctgagacttgtctttcttggtccgttttaggtttgtcattgggtcaaagactgacgcagagaggtaaagtgcgtttgcttctttagtgttggttagagtgggtgtgaagctgcatttttgcaggggagaatatcctatatttgggtcatggatgttgattttgctacatatttaactggatgttccatcatcattactaccttgggtaaatcacttaaaatctctgaggtacattttcttgatattttaatgagcattaataaagactatataaaataatttgttttaggtaagaatacttaggtatatgagacatgattttaagggggaagtttataatccaagtctaagggaaaagaaatgagacattttgttgtctgtttattggtttaattatattgtagtcaaggatgaccttataatttctctattagaaataagatcttaaaagtatacctgtaggtgcattcattcatcatagttagcagaaaagatttaaacattacctcgtcattggaaagatcagagtatggttcttttcatgacattcatttagtgtgtgtgcttgtgttgttcctcagagttgggtggcatgtgggcgttggttactccctccaccgcagcgcttcaggggcgtgtacctaggtcgacaggcttggaggccatctccacagcacagaacacactttttaaggcagggtttcttcatgtagctcagtctagtcttggtgtcttgaccaggctctctgcctttctgctgtggaacagctggcctgtgctatgtggctgatgagaattcaccttgaggctctaggtttaggtcttggaacttgtggttggcagttaggggcacttgccacgatgtgatttttttctgttaaatctggtgggacttcttttcctataatagcattacttatttcctatatgatttgtgtttaagacaaatttgaccaatccttacctatttttcctaacgttttagggtagttaatcaataccaggagttggtccagaatgaagccaaatgcccagtgaagatgtcacacagcagtagtggttcagccgctctcagtccaggggaggaggcagaagtatgttgacacggttcctaccttgtacccattgtttgtcgaggagtctcagagacgggaagaacacaggagttgtaatctggctttcacttttagctttttattattccacttcatgtttaattaaagcttccaacgtcctcaatgatagataggtacagtttgttattcctgttaaaggctggttgagaaggctggcagggctccttcactttctgcccttgcccgggactcacctcactgcagacggacgctgcagtcccggagtgtctgattctgagtacagttaggaatctcaggtaggaactctaatgatattaatttatcttaacagttgtgtttaacgtcacttctcagcaggcggagacctcgtccattcagtcttcagttttgggaaagggagtaaaacaccgacccccacccatcaaacttccctcaggctcaggaaatagttcctcaggtactagcagaatcctcacctctgatctaatagtgctttcttaaaacggtactcagttttactgtcataagtcacagaattgtgacttgtgaatagggaaaagacttttatcgttttctgtgtattcatgactgtgtgactatgtgaatacctttgctccagaggtagcagatgtgggtgggttgtgagatccgagctccggtctgtaggattgctcgagtgctcttgtattgactggagcagctctccagccctagaataacttgtattcttccaggtaactatttcacagcacagcaggccagcagcttccttaaatctccaactcctcctccatcgtgtaagccaagcctttctcggaagtcttctgtggacctcagtcaagttagcatgctttctcctgccgccctgtcccctgccagctcatcccagagtgagtcatgatttaaactcttgctcacattttcctacatttttgcattggtgtttcttgaggcagctgttattcaatctgtgaatagtgaaatttgaatgtactgtgtacccaaaatgtgtaagtcgcatgaaactccaagtagacttcttgttggctgtatgtattccgtgtttactgtaactgctttctgtatctgtgtatgcacgttgtgtataccgttcttttaggcttgttgcctaaatatcttaaaaacttacctggcaataatattgcaaaatatgatttacagtgcaccctaggatcttttttcttactatataaactgtgactaatactaaaaagaaaatgtgagattatcaaaggtactatctctatctttgtatgtgtaagacaccagctggttccaaggttacatgccataaatggaaaagtagtatttgagagcatgcctacactgctgtaagcaatcattaaatgtgataatctgaacataggaaaatagaattctcacttctggatttccttttttaacaacaagtggagacttaggaataatagattaaatttgggataatatcttcaaatgaatatctgaataagttaggtactaatttggggggattccagttttttagcttttttctttttctttttcttttttttccttttttttgcttggtggctagtgtgggctgtcagtgtactgcacagtgctaagatggtcctagatattaacacctgcatcccgatagctcaaaaggtgtaatttttctgccttcttgttttgcacaaagaaaaataaataaattttctgaaagtcttgttgacacttgtcatgttgtgggtgtggattgtggtgatctgctgcagcacacagttgttgtgttaagtcagggtggagtgacagctactggacattcacctctctctcctctctttctgcaggacatgaaagctaaaaaggaaacacctcaagagctttgctttacttttttggtttcatttttaaaaatttttttaagttgataaaactgtgcatacttcattcacgacagattttctatacattcaacatttaaacagaagtacacagttactgttaaagatgcagtattatctataaagtacctgctttattctttgtaaatttctttgtcagggtaaacttgatatgttgggaattaaacatgtatatctgagtgccataactgatagcttgtgtacttactaagtatgttgacagtttatcttcgacagttaaactaaaataagcagtatttttttaagaagtcttaaattagtgaactcacaagtaacaaaaaattaacttaaagtcattctcagctttgtaggcaaaagacagcatgtaggagactaactttttattgggtgttgtggtagagtgtaagtgtatttccactgttaactgtgatctgagtggggtttctaggtgatatactgcatccttaattgtaattgagtgtagcaacactcttggatcgtgtagagagttaacacttgcagttaactgcttttaaacaaattggaacaaatttgtcagtgctaagtaagattccattaaccgtattttaaaaggaccagccatttataacaaactagcaatttttatttttctcaacgagcaggatctggaactcctaagccatctcctcctacaccaaccccttcatcggtcccacaccctcctgacgctcagaactcagctcctagtaccccttcagccaccccatctccccaagaatcaggcttcacccctcagcccactttgttaactcagtttgctcagcagcaaagggctctgagccaggcaatgcctgtgacaaccattcctctttctaccatggtaacgtccataacaacaggaagctcgctctccccggtcatggcagactctgctgggctaacctccgtcagtgtactgagctctgctgggtaagttgacagtgttaaagacagttttatttctgagatgaagatacattgcttactatactgaaaggtagtttttttatatggtcaggagctgtttcatatgaatgatagagtattagtaacaaatttattacctgtacaaagatgtacttcccagttggctagattttgtcatttgcctgttaatgtctttaatcacttgggcaggactttgcttctctgtattccgaagtgtctaaggatgtgctcaatacttaaggcagcttttcacacttcagcagtaagagaaaacttggcctagaaaatgaaaagttaaaaaaaggattgtatttattttggggtgtgtgccacagtgtatgtagaagtcagtgggtgacttgcatattttgggttttttttccttctaccatttgcatgttcaggcttagtgcaagtgcctgctgagccatctcacctgccctaggagttaatttttaattcggaagtgatggaagttgctttatagccttttgttgttgtttttattgaagaattgtgaggctggtatttgttttcactgtgtgtaacgctctgtcccttcccctgcagtggagcccaggctctgaagagtggctcaaactccatgctgggctgtgacactggggccatacctcctgcaggaaaaagcctgtgcagcggccttctgccatcaggaggtctcgtagcaaacacactgcccagtgccgtgcaggcggctcctcaagcaggttagaataaaataaagtccatgggaaaggctttgctaaaagcattaagtgttgcttcacaaagttttatttcttagatacttgaaaagccttttgtagttctggtatcagataaccacctagcaaacagcttctaggaagaaacctgttaaatctataagtctatgcacattatgtcttctgatatgaaataaataatgaaattatttttagctaccttgtctatgtagtaatactccagagaaaacaatacaaatatatattctactggaaacaatatagcatggcagccaaaaaagcctagattcttagttttgtaatctttggaagttgctttttttccatcatttcccccagaaataaggtagtgataatactaataagaggagcattctgtgttgctattctttgtagtagtagcaggtcttgggtagttattaccatgtggctaaaatcagaggggaacaggagtgcccgctctgatgcctacaataatgactgttgtaatgcccaggaccaattcctgttcttacccttctcagttatggaaaatattttctaattctagttgtgcctattttaatgagaaggagtcatgaaatttaaattcacaccatgaattttagatgcttagatttacatgaaaggaacctcctagtactgggtgttctgggctcccttgctgttcttagagaagttcttaatctaccccagtctcaggctcatctgtatgacgtcacatggtcctttggagaaaggggaagtctgccagtgcctttgttcagatggacagccacgtacagaggtcatgctcctgtgtaagctctgccacagtgagacactaagtggatgcttgacctgaaacagctgcacagcagtgaaatctcaagccatttctccccagggactcgttcctaagttcctaaatgggacacacctgaggcattctcagtgtctttcttttttttttgttgttttgttttgttgttgttgttgtttttgtttttcaagacagggtttctctgtgtagccctggctgtcctggaactcactttgtagaccaggctggcctcaaactcagaaatccgcctgcctctgcctcccaagtgctgggattaaaggcatgcgccaccattgcccagctctggctcagattcttgtacaagcctttgatggcatcacattcaaatttttctacatctcttctgtaaataatacctaagagaagactacatatgtaacatgtttttgtttatgagatttcccacttcttcctcccaaatcttgtgattacaggtacaagccactttactagataagttttaatctgtatccagactgatgtatacaaaaatttcacatattttttttgaagaggccaggtggggacttttgagacagggtctgtctttgtagttttggctgttttagaactcatatcaggctggcctgatatatatatatatatatatatatacacacacacacatacatatacacacacatacacacacatatacatatacacacacatacatatatatacatatatatatatatatatatatatatatatatatacacacacatatatacacacacatacacacacacatatatatacccacacccaaaagggtatgttcttttaacattttggtgattggtattttgtatgcaaagtttagcattttttgtatgtagtggaggaatgtaagccgctgacagttaatgtgcttgcacggtgctggtagttttgttaccatcgtggtgtatacgtaatcctaggtgacttctttcaatagtaagagaagtgaaagtctttaatgcctcacatcttagatacaatgtcaatgttgacaataaaatggttcttttgtgcaagggttttaaaactaattatgtgtaaattagtcatttggagaaaggacagtatgtattttcacatgtcgaagtataaattttcatctgtaatattttcagttccattataaccattagttttatttaacaggtatcccatttggtttacaaaatacttcaagtctcagacctttaaatctactccaggtaaacatgaaacaatacttttgattgaaatttttatattttgatttttaaaaaacaatgtatatttatacatgtcagcttttgaagtttatctggaatcttctaagtagtgctacctttatgtagttatgtgcaaaataataataataataataataataataaagggtgttctattggtgaagctttcattgtcttttactccctgcctgggcaagagctagctaccccaaagggagtttctgaaaaggcacctgcctacaaaagtggcagcaggaacacttgcagacatctgtcctggtttttgtgcttgagggcttcaaaatgtgtgaatgcgttattttctccatcaatgattatgctttcttaatacagtgacagctgcttctcattctgtaaatgtttgttgggtctaatatatatctgatgatgaggccttgccttttttacattactctgtcaccctacccatagagcaacagaaaacgagcctgtttcccatgggtaaggcctgaaggcctagcagagagaggagagaactaaatagaacgggctgggtcctatgctagctctttacttgctgggccctccacctgttccttgttacttatccagttaccctggcttgttccacatccccttctttatatgtaatcctttttagttagcaagtatataaaataatgggtttcacgatgacatttttacacgtgttcttttccatacttacactcacccctcttcctaacctgctgcttccatgatggtcctcttgcttcctccacatagtgccccctctgctttgagcgtgtgctcagctctctaaaatgtgaactctatgtactattagatgtttgctggttcttctgcacttttctgctgttactctcaacttgttttaccctcttcttcaaggccctttaagctagtaacttggaaaatggatagttgtctacagagaacttaaaaggtagacccaaagctaaataaagatctaatgataatgccaagctgtgggttattaggaaatagcaatacctggcagatgagctaatttcatatccagtcataactgagtgagaagtctgctatgaactaaaactatttctgtacctggtataaataccctgtgagtacctgcagaccaattgcatagccatcactgctaatgtgcacacagctagagatggcactgctctaattagaatcaatttccttcatgctgtgttaacctgcaccttaagccttctgtgacagagataacaagaaatgtggacaaagccatcttgtctgctagtaaagaagtcccgagcatggacaatggcagatttagtgggttctgttttcttaaccagaggattgctgttcttaaatttaacttgaattcaaaataagagcaacttagtctccatgtaaaggctctttgttttcatccctagaacttcttgttatattaaatggtaattgtagggctattggcaagacttgaacaaatttaagggctgggttgtcttacatacatttctgaattgtacccttttaacttttgagacagggacagcttgtgaagttcaggttacctttgaactctgccttctcttgcctcagcctaccaagtgctaggaatactagcactacactgtgtccttatgccctgttagtttgttcagttcatagcacatgcagtgatcatttgtgctgatccatgagaagtgataaatgtttaataataagctgtaaatctagatactattaacttgaatcaggaagatttgtatttgaaaatatacaccaaaaagcagtaggacttaaaaataacttctgggtgtcgcctgctgcagggcaggcagcttgcttggttttgcttctgtgtggaagccagacagaggctgatgctgatccgtcatcacgcctgccttctcttgctgtcttcgtctttcttcagaacctaagattgcccgacttctagtaaattatccatgaatgtttttaaggaaatgtaaatacttcacatgaaaacaatggaaaggcagctaattcttgtttaaatcctgaatagcttcctggtggttcactcatttttaacacccagcagcaacagcagcagacgcagctccctcactttatacaacaacctcagcagcctgcagcttccggttcccaacagccagaggagcaggtatgggattcttttagtactcgtgtgcgcacgtgcgagcgtgtgtgtgtgtgtgtgtgtgtgtgtgtgtgtgtgtgttcactatagaacttagaacttttcatatttctgctgttttaatttgttggaagaaatagtttcagagttgtttctcttttattaacatcagtagctgccagttattctaattatagctgttttgaatgtaggtgtccatcttacagagtgtcacacagccagacggtgaatggcagtcagtcgcgtgactccacctcacagtgtcttttctgaccagcctattatcttctgcttgtagaaatggattgctgttgtaatagatctgtctgcgttgttgggaagtattaggcagtgggaacaggcagcagcagatactgcacattgccagtcaggatgtaattaaataggaacagcagtaaattgaagtctggagagaaagggagaagtgtgcctggactttgaatatgctgtagaatcatttgggaaactaagcatacttattcctgggtcccaccttgagtatctcagctgatgctgagaactacccagccaccctcttgcctagcactcctgcaagtcttcagtggatgaaactcaccctctagtaggtttctcagatgagacatgttgaaaacttttcctgtatacttagcacactaaggggtttgctttgccgataagaggtctagttgtctttcttacactttttaaaaacaaatgttgcttgtttcctttctgtccatgtgtgggggatggtgatggtcagaggactagtgggaaagaagttattaccttcttccactcttgggttctggggtcaatcttggggacaagtgccttcactgggtggaggtttttgttgttactgttgtttttgaggcaagctcttactctgtattgcaacataacttggaactcagcagtcattctactccagcacctaggtgtgaacctgccagctgtttgcctatttaagtttgcattttagtagtattgagtacattcacatcattgcacaaagaatattttattgtgcaaaattggaacttttcatttgttttgttttgttttgtttgagacagggtttcctctgtataatagccctgactgtgctagaannnnnnnnnnnnnnnnnnnnccctctgtaggactaggctggcttcaaactcacaggatatcaacctgtctctacaccccaccccacccccaccccaccagttctggtaaggcatgcgccaccacccagctaaattgaaactttataaagagctgataacttcctcagcgcaaaccctggcagccatcatagtgtgtgctgtgcttctgatcttaatcatcctgagtgcaccatgcagggaggccggttcttagtccgcatgtccttttgtctctcttattgtgacaccagacagatgattcatttggatatgtgaacagaacttgttgggactcagagattgccttcctttctggagacgccgcactgtttgttcttcaccactgtttgttcttcactatcctgctgcattgtattgcatcctcgacatcaggcattgtggcccagggcacagactgtccagacagaccgccactgccggctaactaacttgctgacttctgctgttgggcttttcttacttgttttgctcagtttcttgtggtagggaccagactcagggcctcctgcaggttggcatgtggctctaccactgcacttcctgtttcagtcagttttgttttgagtagctgctgtccaagtgagtataaggtgagaatctccctggctgacggagtaggacagcttctctgcatttctttgaaaaatcagtatatccaaatccttggcctatcttcttttttttaactaaggttgtttatttttgtgttgttcaattgaagacatgtatacatactcgatatgagaaattcctagtaattcctcctgttttgggttactctctggctctggtctgtcctgtgcagttttgtacattctgctcatacctgtttggagaaatggttgccaagtcaaactaacaaaccctattctccttttgtttgtttgattttttttttttttggtttttgtttttatgttttgttttgttttgtttttaagacagggtttctctgtataaccctggctgtcctggaattcactttgtagaccaggctggcctcgaactcagaaatccgcctgcctcccaagtgctggaactaaaggtgtgcgccaccactcccggccctttctcctttaatttcctcttaagagttctgcagttttgtctttcctttaatttattaagatgctttttctttctttctttctttctttctttctttctttctttctttctttctttctttctctctttctctctttctttctttctttctttctttctttctttctttctttctttctttctttctttgactttatatgatcttgagagggctgacaagagtctatcttgttaaaatatttttatgtatttgggtgttttgcttgcatgtatatctgtgcaccatgtacttgaatggtacatgtggaggccaaagaggatgttgggtccactggaactggagttagaaatggctgagtcaagccgggcacatgcctttaatcccagcacttgggaggcagaggcaggcggatttctgagtccgaggccagcctggtctacaaagtgagttccaggacagacagggctacacagagaaaccctgtcctcgaaaaaccaaaaaaaaaaaaaaaggctgagtttccatgtggactctagaagaacagccagtgctcttaactgctgaactgtctctccagcctggattattttaactcttataatcctatttatttagttgttttgccaaaggccctgaagttaagtttatctttaagttgtcttacaaaccgtgtgtgtgtgtgttttgcaacagaaccttactatgtagctatgtagcccagggtagctttgtagttctgcattagatccaagcactgggattgccagagccacaggcccaataatatctagattactgagttgagtaattctaattcagcattttatttattttattttatttattctttttgcattttgagtttattttacaatagcactgttctggatgtgatacaaggtttgtgattttagggtttgttttttgcttattgttcattctgaagactgggtttcatagttagtactttcttagttcttgctacttctacactactgttaattctttctcatacataagctgtcttttcactggctcagaaaaagttgccctttttgtacaagctatttgcttttttcccccttctcagggttctgaacaagggttaactgcgcaggaacaggccttaactgctcagcaagctgccgttattaaccttactggagtaggaggctttccccagtcacaggcagccggtaggtatccccctgcttcctattgagatctcattgtgtaaattatttacctttcctccttgcaagcagtaatccgaaaaacactgaagtaatagttggccaagagttttttcctttaaaaatttggcagttgattaaaaagattggtcttaacaataatattttttttacaatggttagctggcaaacttttacatatttttctgagtttctagaaagctgtcaaagcagttttcattgtttgtactgtaaatggttaattgttttcttgattacctaagaccacattttcctagattgctttttttttttttttaagacaggggtttctctgtgtagtcctggctgtcctggaacttactctgtagaccaggctggccttgaactcagaaatccacctgcctctgcctcccaagtgctgggattaaaggcatgcaccaccaccgcctggcctagattgcattttttttttctgtttgtagttacaagacttaaatcttcataattagcaaaacttctgagctacttgttataaaaatgaaactaacttgactgctcccactttcagtaggaaataataaaccaaaagcaattgaattgaatcgaataagccatgtgatagaattttataaaaaaattaacaaagctataatgggatttgagaatcagtcagtgattgttcgagtgctgactgtgcctttagatttctataacttggcttccaaatttacatgtc

SEQ ID NO: 608 - DNA, 1969 bp, Mus musculus
tatttctggaaaatcgctgcaaggttggcagaatgcttcttcagggcggagtgcggtgtgactgttgagtagaggttgcttctctgtggagttggcgttctgaggtatagaagaagacatggtttccaccccacttccacagcacgtctaagttttatcttttttggggtccttatctgttgccacaatgcaacaagctgtagaacaagctttggattgcgcagagtacatcgtggaaagtgctcagcagagacctcctaaaaggaaatacctgtctagtggaagaaagtctatatttcaaaaactttatgacttatatgttgaagaatgtgaaaaagaacccgaggttaagcagaaattaagaagaaatgtgaacttgttagagaagcttgttatgcaggagactttgtcgtgtttagtagtcaatctgtacccaggaaatgaaggctattctctgatgctcagggggaaaaatggatcagattctgagaccatccgattgccttatgaagaaggagaattgcttgaatacttagatgcagaagaattacctcctattttggtggatctccttgaaaaatcacaggttaatatttttcattgtggatgtgtgatagcagaaatacgtgactataggcagtccagtaatatgaagtctcctggttaccaaagtaggcacattctcttacgtccaacaatgcagactttagtctgtgatgtccattctataacaagtgacaaccataagtggacccaggaagacaaacttttgcttgagagccagctgattctagctacagcagagccactgtgtcttgacccatcggtggcagtagcgtgcactgccaataggctgctctataaccggcagaagatgaacactcgcccaatgaaacggtgttggaagaggtactccaggtcctccctgaaccgccagcaggacctctctcacggccctcctccccctcagctgagactacttgatttcttacaaaagcggaaggaaaggaaagcaggccagcattatgacctcaaaatttccaaagcaggaaattgtgtagacatgtggaaacggagcccctgtaacttggctgtgccttctgaagtagatgtggaaaaatatgctaaagtggaggaatccatcaaatctgacgactcacagccaacaatgtggccagctcatgatgtaaaagacgattatgtatttgaatgtgaaggtggtaatcagtatcagaaaacaaagctgaccatcttgcagtctcttggggatccactttactatggtaaaatacagccgtggaaagcagatgaagaaaatgacagccaaatgtctccatcccactcctctgctgatgaccattcaaactggtttgtcattgggtcaaagactgacgcagagagggtagttaatcaataccaggagttggtccagaatgaagccaaatgcccagtgaagatgtcacacagcagtagtggttcagccgctctcagtccaggggaggaggcagaacaggcggagacctcgtccattcagtcttcagttttgggaaagggagtaaaacaccgacccccacccatcaaacttccctcaggctcaggaaatagttcctcaggtaactatttcacagcacagcaggccagcagcttccttaaatctccaactcctcctccatcgtgtaagccaagcctttctcggaagtcttctgtggacctcagtcaagttagcatgctttctcctgccgccctgtcccctgccagctcatcccagagacatgaaagctaaaaaggaaacacctcaagagctttgctttacttttttggtttcatttttaaaaatttttttaagttgataaaactgtgcatacttcattcacgacagattttctatacattcaacatttaaacagaagtacacagttactgttaaagatgcagtattatctataaagtacctgctttattctttgta

SEQ ID NO: 609 - protein, 543 aa, Mus musculus
VLSFLGSLSVATMQQAVEQALDCAEYIVESAQQRPPKRKYLSSGRKSIFQKLYDLYVEECEKEPEVKQKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLVCDVHSITSDNHKWTQEDKLLLESQLILATAEPLCLDPSVAVACTANRLLYNRQKMNTRPMKRCWKRYSRSSLNRQQDLSHGPPPPQLRLLDFLQKRKERKAGQHYDLKISKAGNCVDMWKRSPCNLAVPSEVDVEKYAKVEESIKSDDSQPTMWPAHDVKDDYVFECEGGNQYQKTKLTILQSLGDPLYYGKIQPWKADEENDSQMSPSHSSADDHSNWFVIGSKTDAERVVNQYQELVQNEAKCPVKMSHSSSGSAALSPGEEAEQAETSSIQSSVLGKGVKHRPPPIKLPSGSGNSSSGNYFTAQQASSFLKSPTPPPSCKPSLSRKSSVDLSQVSMLSPAALSPASSSQRHES

SEQ ID NO: 610 - DNA, 70123 bp, Homo sapiens
  misc_feature (1)...(70123): n = A,T,C or G
tggggccagagtcccgagtgatggaagctccgggcctaggggcgggtcccacctggctgcatgagtttgggggcagcacaggaggttgcttccgggacgtggggcacaggggacccaccaccgccactgctgctcccacagccgttcctgctgccacccctcgcacctccccactgcagccggtggggtggcagtggcctctccggaccacccgctgccacaatcaataagttaccagacctgatccagccacaaattgtccctggtagggtctacccaagtggacgaaaccataattaagaaataccactaactggttgccctctgactgtaacaatgcttattttaggcaagctttaaaatagatatgtaggatctggatctctaaaaagagcattatttgttcaaagaaaacattaatacagtactgactattccatttggtgccacaagatgtcacttatatacaagcaaactctgtatataaaatagaaataattttgtttcagaattttttgggtcctaatttgtaaggacacctggtcatccatcctggatgataaaaatatgactacaaaatgcttcctgacctcaaaaggcttaaaagcttacaaagaagcagatgtgtgctcaagtagctgaacacaattcacagtatgttcaatgcaatgccagaaatgcacactgtctaagcaaaaattggcctggacaaagttacatagtcaaggaagacttactttaaggctattgcaataggtgagagagaccagaatatagcatgaactcaactccactgaaacaaaggggaagataattgggtttgggttttttttttttaatatttgtgttatggtaaatatacataagataaaatttcccattttagcaatttttcaatgtacaatttagtggtactgagtatattcacagtgttgtacaaacatcaccactatccatttctagaacttttccatcaccctaaatagaaactctatgtccattaaataataacttccaattcctccttcccatatcccctagtaaaccattcatctttttgtgtctcatgaatttgactagtctggatacctcatataagtggaatcatgtaatatttgtgcttttgtttctggcttattttacttagcctgttttcaaggttcatccataatgtagcatgtatcagaattccattcctttttcaggctaatactccactgcatgtattaaccacattttattgatacatttatctgtcggtgggcatttggagtgtttccaccttttggctattgtgaataaagctactataaatgttggtgtgcaaatatctgttcaagtcccagctttcaattcctttgagtatatacctagaagtagaattgctggatcacatggtaattctgtgttgaactttctgaagaacaaccacacggttttctacagcagctacacaattttatattctcactagcaaggtacaaatatccagatttctccacattcttgacgacacttgttattttctgttcttctgataattatcctaatgaatatgaagtggtatttcattgtagttttgattttcacttccctaatgatgagtgaggctaagcacctgttcatgtgcttattggccatttgtacctcttctttggagaaatgtctattcaaattattttcccattcttaaattgggttatttggtttttctgttgttgagctgtagacattctttacatattctttatttatacatatatcaaatatgttatttgtaatatatttgtctcattctgttggttgccttttcactctactgatgtacagaagtttagcaggagaggttttaagagctggagtagggggtagtaggccatctgtgttaactgtccttacctaaagaaaacgcaaactttactgtatcttcgtgataggaggtactgttataacttggagctaagcaccctctgaagttggttactgccctcctacagaaactggagacacgggctctatcttccttgattattacatttcaaggagatggccctccttaagaaagacattccagggttgtagaattggtaacaggcattttttaaaagttatatatcaaaggagcaaaaaaacagcctaaaagttttttcatagtaaatgatctaagaaaagggaggtcagtggcctagagttggtaagaaatcctatctaaagttaggagaactaagagaaatattaatgagactttattttggccaccttggttaaaataaaacatttggaggccgggcatggtggctcatgcctgtaatcccagcactttgggaggccaaggctggcggatcacctaaagtcaggagttcaagaccagcctggctaacatgatgaaaccccatctctactaaaagtacaaaaattagccgggcatggtagcgcccactactagtaatcccagctactcgggaggctgagacaagagaattgcttgaacccaggagttggaggttgcagtgagccaaaatcatgccactgcactccagcctgggtgacagagtgagactctgtctcaaataaataaataaataaataaatacatacatacatacatacatacatacatacatacatacatacaaaagaattagccgggcctgatggcgggagcctgtaatcccagctactaggtaggctgaggcaggagaatcgcttgaacccaggaggtggaggttgcagtgaaacaagaatgtgccatcacacttctgcgtgggccacaagagcaaaactccatctcaaagaaaaaaaaagcatttggggccattacagatgagaaaaactaattccaactggaagaaattccagcaagtatctcagaggtattaacatttatgtagtcaagcaggctggtataagattcaatgggcaaatttattaaaaaagaaaatgccagataaagaaaaatcattcgttaaaaaaaaatagagaaataaaagtttataacaagatagacaatgcagccagcaagacagcaggatgtaaaggagttatcatggaagactctgtctgggaacatggatagccttggaccatggagggcctaaatgtcatattaggaattcagacttcattttaaggacactaggggctcaaaaaaatgtaacagggggcatatgacatgatctgggtattggaagtgtggaaagcagctggagagagggagtcaggcgggagagaaggctttgtctttccgttgtcacggctgtggctggcacacctggcagaacaactgtccacaagccagcaggtagggcctcctcacacactgctgcaaccaccctttctctgtcttcacttgcacctgccctgtcctgggaggagtgacttgagccagaaaagaagctgtgacatcagtagcaatggtaccagagtggcgagcattagggaaggaggaacagagtgatactcataagaaaataatttctttcagagcacagccaggcagccaagctttcaactctaaaatcgaggacccactaacgtagggggagctcaaggtaacagccctgacagcaccagaggaggaaagcaaggctcctcatgagttatttgcatcacaagtacccaacacagccagacttgggtgggtctcctccaccaccactgttggtcactgaaagatcacttaacatgttactctgtgcctctttttttcaagtaaactggcagttagatctagaggcttgattaaattcagatttaggattttgtaaaaaaaaaatttcataaacagtaatactataaagtactatttatatagtatagtacatagcacataaatagcacatacataaagtggatcactattaagtttcctttcaaccttctacccatttggttatttggtaaccattagtaattattccctagaagtattattttctcacaggttgcaaaatggtgatattctatcacttttttatttattcactggaattcttctattaaaaaattttcccagactgggcgcagtggctcacgcctgtaatctcagcactttgggaggctgaggcgggttaatcgtctgaggtcaggagttcaagaccagcctggacaacatggtgaaaccctgtctctactaaaaatacaaaattagctgggcgtagtggtgcatgcctgtaatcccagctactcagggggctgaggcaggggaatacttaaacccgggaggtagagtttgcagtgagccgagattgcaccaccgcactccagcctgggcaacaagagtgaaactacgtctcaaaaaaataaataaataaaaaataaagttttcccctatcaactctttggttactctgaatttcagtttgtgtaggaaagcaaaaaatttggtttaaaaactttttaaaagcaatttcagaataatgagttagtgccctagcaatcctcaatgtgaccagtgagaggtttaataaaagcattgaaatttatgtattttgaaatttttgatatatttcaaactacttcagtcaaaaaaatctttctgattctccttgatgctccaagtgtcccttcttttgccagtaggagctctttcaaattggactctgtatcattgcttacacaacacacacacacacacacacacacatacacacacacacacacagtcagaggattcagaacacacatgtcttctgcttctctctaagaccccatctagttatcctcaactgctagtggatctgttcatattccaatggccaaaatgagtcacatagccacatgcaaaatcaccatgaggaagtatactgtgcccacactgaagccatgggaaggagagtgagaaataaaaatgttttaaaatcctgtgaactaacactactatctaccacattgaatgtgatggttaattttacatgtcaatttttctaggctacagtacacaatcaaacattaatctaggtcttgctgtgaaggtattttgaagatacatttaatatctataatcagttgactttaggtaaaggagactaatcttgataatgtgggtggaacttattcaattagctgaaggctgtaagagcaaaatctgagattactcagagaaaaagaaattctgcctcaagactgcagcatcaactcttgcctgagattccagcctactcagctgcccaacagatttcagacttgccagcttccataatcacgtgagcaaaatatttaaaatgaagggatggctctggtcagagcaattaaccaaggaaaagaaatgaaagtgttcaaattgggagaaaaaaagtataactatctcagttcacagattacatgattctatatatagaaatcctaaagaatatacacatgtaggcacacatacaaaattaatagagctaataagtaaatgttcagagtacaaggccaacacttgctatggtttgaatatatccccccaaaggacgtgctagaaacttaacccataatgcaacaatgttgggtggtaaggcctaatgtaagttgtttaggtcatgaggtctcaccctcatgaatagattaatgccaattgtaaaagaacttgaggcttcaagtttgatcccttgctctctagccctctctttgtccttccaccatgggataacatacataccaagtaggctctcaccagatgctagcccttcaatcttagaatcttcagcatccagaaccgtgagccaataaacttctgtttattatatattacccagtctgtagtattctgttacagcagcagaaaatagactaagagaataccccaaaatcaattgtgtttctatacatcagcaatcaccaatctggaaaattaaaaacaatttcatttataatagcatttgctaagaactaaatatgtcccctcaaaattcacatattgaagctcaaacccccagtgtcactgtatttggagatgggacctatataagaaggtaactgaggttaaattgatcacaagagtggagttctgatgctatagattagtatctttataaaaaaaaaaaacaacaaaaacgaccagatatctttctctgtgtgtttctctgtctgtttccctttccttctcccacttcctttatcatatgagaatgcagaaagaaggtggctatctactcgccagtaaaagagcgctcaccagaaaccaaattggcaagcaccttgatcttggactgcacagcctctagaactatgagaaataaatttctgtcgcttaggccattcagtttatggtattttgttatggcggcttgagcaaactaagatagattttgctaccaagaagttgcatgttgctttaataaaacctaaacatgtgaaagtggttttggaactaggtaatgggtagaggctgaaagaattctgaggtgcatgctagaaaaagcctagatttccatgctagaaatatggatgttaaaggcaattctggtaagaactcagaaatacagttgaagagaaagcctccatcttcttagagaaaacataatcatgaacacaattttggtaaatatatgtttgttaaaggccattcttgtgaggtctcagatggaaatgaagaatgggtcactggaagacagaagaaaggcagtccttgttataaagtagcaaataacttggctgacttgttttctagtgttttctggcagacagaatttgtgaatgataaaattgaatatttaactgagatttttaagcaaaatgctgaaagtgcgacctggatcttcctgaatgcttatagtaaaatgcaagaagagatgaatgaaagaagaaattattaagcaaaaaggaaccaagacttaaatatttggaaaattatctgcctgtcatgttgcagaaaatgagaaagtacattctaaagaaaacaccaaaggtatggttagactatcatttgataaataaatgatgagattatatgagcagaaacactgcctgtttcaactgaaggggatgcagacaagacaaaaatgacagaaggcttttacatgtcctagattctacaggacaggacaatagagctatctagctgctaactttgtactattcctttttttttttttttttttgagacagattctcactccattgcccaggctagagtgcaatggcgggatctcagctcactgcaactttcacctcccaggttcaagtgattctccttcctcagcctcccaagtagctgagattataggcatgcaccaccaggccaggctaatttttgtatatttagtagagatggggtttcactatgttgtccaggctggtctcaaactcctgacctcgtgatctgcccaccttggcctcccaaagtgttgggagtacaggcgtgagccaccgcacctggccaaacttgtgctattctttaagaaaaggggagaatgacctcaaagcaattcagatgttatcaaggccattacctagcaaaacttttgggatgaggctctgcctggaagagcatgcctggcagagtgtggggagaggtatagcatccacctagggtccagaaggcagggccaccacccttgtaggtctggaaggcagggcactgaatcaaaatggattattcttgagccttaaaatctactagaatttgccttgctagatttttggacttgcttgggacctgtcatcccttcctttttgcctatttcttttatttccttcctttcttgctcctatttttgtttgtttgtttgtttggaatgcctattctatgcctgttctgccattgtattttggaagcaaacaacttccctggttttacagtttcatagctggggagaaaatttgcatcaggatgaatcatatctcaagtctcacccttatctgttttaggtgatatttagaagagacttcggacttcagattttagagttgatgcttttgagactgttgaagtggtatgaatgtattttgtattcaataaggacatgaattgcaggggtacagaagtctgttgaccaaattatatctccacaaaattcatatatgtaaccccaaaccccaatgtcactgtattggagataagatctataaggaggtaattaaggtttaagaagatcataaaggtggggcccttatccaatagaattagttactcataagaagagacatgaaagctagtgtgcttgcacaatggattcttggtgatgacaccaaaagcacaagtaacaaaatagataaattagatttcatcaaaattaaaaaggtttgtacactgaaggatattacaaagaaagtgaaaagacaacctacagaatgggagaaagtatccaccaatgatatatctcataagggtctaatatccagaatatatgactacacataactaacaacaaaaacacaaacaactcaatttaaaaatggggaaatacctgaatagagagttctccaaagaagatatacaaatggctaacaagggcatgaaaagatgctcaagataactagccattagggaatgcaaatcaaacccacaataaaataccactttataccctttgggatggttactatcaaaggaatagaaaattatcgtgttagtgaggatgtggagaaattggaatcccccgacaatgctcttggtatgtaaaatgaatggttcagctgctgtagaaacatttgtttatgggttcctcaaatattttcacgtagaattactataagacccagaagttccactatgtttatacccaaaagaattgaaaacagggactcgaacaaatacttgtatacaaatgttcatatcattgctattcacaatagcccgaaagtggaaacaacccaaatgtccatcagtggatggacaggtaaaactgtggcatctaggtacagtggaatagtagccataaagagacatgaagtaccgatacatgcaacaaggtgtacaaggtgaacctgcaaaagattatgctacgaagacagaccaaaaggtcacacattccatttatatgaaatatccgtaataggtaccacagtttgaaagctgattggcatttgccaggggctgagagagggaggaatgggagtaaccacttaatgtgttcggattttattttggagtgtactttaatacacttataatgtgtgcaaccactaactctaattccaagacactttcattcattatgacccttggcattgtgaacggcaaataataaatgctcattaaaaagattcaccccaggccgtgcatgatggctcacgcctgtaatcccagcactttgggaggccaaggcgggtggatcacttgagatgaggagttcaagagcagcctgcccaacatagtgaaacagtctctactaaaaatacaaaaattagccgggtgtggtggtgcacgcctataatcccagctactccggagactgaggcagggagaatcgcttgaacccaggaggcaaaggttgcagttagctgagatttctccactccactccagcctgggcgacagagcgagactctgtctgaaaaacaaacgaacaaacaaaacaaaacaaaacagaccttacaatgtgtgctagtaatgcggtttctgaatttttagaacccttctctggggtggtttttttaaaaacataaactcattggcagttgatatactacagaaggttgtacgcattggactagtaaatgtaggtaacggtgtcgctgtttttccatttgtatgtgctaagcaaagagaaaagctagttctatgtttcttccactctagaaattcaacagggtcgtttttccccaaattcacatctacaccctccctcccactttgcggactcggactccaggattgagcagagatcctgggccccgcctcccgcccggacgcaagtctctgcgggcctcaccggcgtcctgcgcggaacgcagcgctccaggctcctggcagcggccccgccctcccggctcctccccttccgcccgccttccccgcccctcggcccagcctgccagtcggaagtgcggccgccggaactggctgttggtgggggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagaggtgagcgggccgcatcccagagcccgctggaggaagacggggtccccagagacccggcaggccggggcggaggttgaggcagctaaactcccggtggacgcctacatcgcctttcgcggtgttgctaagccgaacttttaattttagtttgacttttgggttccagagacgggtatttccggacactggcaagaattttgccttgcgtgtcttcgaaggcggttttcttggtgtccatattgcataaaggcttgtcgctcctctgtggagatgacggttgtacaggtaaagcctaagttgtgacaaaagctcctgcaatgggaagactctggtcgatcagggaaatcagtagaattgatagcaacgcgtagaattgatagcaacgcttagaattggattaattactggccatggttacccggcgctcagaaatgaacttggagaacagttgccctggaagccatctcccgtagccactgcgtagtgggggccgcgtcttcttgagtgcaattcatcaaagtctctagtaggactcaaaatataaagtgacgagcaggattttcggagtcgagtacagtgtacttgggttgatcaccatgttataaagttagatccaaattaagaaatacatattcgtctctgagcagaattgggtcctttttttaattgctttgctttttttaaagaaatgtaaaaacagatgccggtttgattagtttgcaggttgtaatattggaagggacctaagattggacacagagttctgaattctgatctaggtctgtgatgttaggaaagtcagttgttctgattgccttattctgtaaaacggaaatgataatgattacagtttcctcacaggttctagtaaattctgtgtatagacagaatgtttgctttgtgagagatatgaagttattagtttttgtctgaagtacttaaataatttaaagttagtaagcccccatccccaatttagtgacaagaaatcttaaagtcatcacattttgtccgaaaagtacatagtgtatcttcatcttcaaattcagtggtcagaaaattttcacgttcacctaaattcaacttaaacctcctacgagcttttcaagggtaggagtaatatcttactcattgtaaatgatcgtaaatcatttacagttgtatggtgcttgtgtttgtgttgtattaggaggttagtccattttttaaagtttcagacggagtttcactcttgttgtccaggctggagtgcaatggggcgatcctggctcactgcaacctctgcctcccagttcaagccattctcctgcctcagcctccggagtagctgggattacaggtgtgtgccaacacacccggctaatttttaatttttttagtagagactgggtttcaccattgttggtcaggctggtctcgaattcctgacctcaagtgacccacccgcttctgcctcttacaggcctgagccaccgccccagccaactttttttttttttttttttttgagacggagtctctctatgtcgtccaggctgcagtgcagtggcgcgatcttcgctcactgcagcctccacctcccaggttcaagtgattctcttgcctcagcctcctgagtagctgggatttcaggtgtacgccaccacacccggctgatttttgtgtttttagtagagacggggtttcgccatgttgtccaggctggtctcgaactccagggctgaagcaatccacctgccttggcctcccaaagtgctgggattataggtgtgagccactgcacccggccttctgtatttttttgtagagacactttccccatgttgctcaggcaggtctggaactactgctcctgggctcaggccatctggcagcctctgcctcccaaagtgctgggattactggcgtgagccacaccccacctggccctttccttttttttttttttttttttttaatggcttggcaaaaaacaaagctttggggttcaccaaaaatcaaagcaaaactgttttacctggaaaatcttgttttctgtcatcagaagttgtgctttagttcagctgtgtagacacccagtagtggttacatgaagttaggtgaatagattaaaaataatttttatttgtcatcagtctcagagcaaatgttttctatttatttttatttctaacttttttttttttgagacagggtcttgctcttttacccaggctggagtacagtggtgtgatcatggctcactgcagcctctatttcccaagcttaagtgatcctcctgcctcagcctaccgagtagctgggacctgtgccaccatgctggactaatttttttttcttcccttagtagtgacaagtctcactatgttgcccaggctggtctcaaactcctcagctcagatgatcctctcacctgggcctcccaaagtcctggggttacaggtgtgaaccaccatgcccagtcttatctcagagcaaatgttacgcaccatcctttgctaggcagagtgagcttcaaccctggcagcacgtttgactcgtctggggagctccaaaaatggggactgtgcctcactctagaccacttaatcagtctcaagcaggtgggtcacaggcatcccacagtttgaagctctgcaagttactcttgtgcagccaggataagaactcctgtagttatagaaaagaaggttttctttttttttttttctttttattatactttaagttttagggtacatgtgcacaacgtgcaggtttgttacatatgtatacatgtgccatgttggtgtgctgcacccattaacttgtcatttaacattaggtatatctcctcatgctatccctcccccctcctcccaccccaaaacaggccctggtgtgtgaagttccccttcctgtgtccatgagttctcattgctcaattctcacctatgagtgagaacatgcagtgtttggttttttgtccttgcgatagtttgctgagaatgatggtttccagcttcatccatgtcactgcaaaggacatgaactcatcattttttatggctgcatagtattccatggtgtatatgtgccacattttcttaatccagtctatcattgttggacatttgggttggttccaagtctttgctactgtaaatagtgctgcaataaacatacgtgtgcatgtgtctttatagcaacatgttttataatcctttgggtatatacccagtaatgggatggctgggtcaaatggtatttctacttctagatccttgaggaatcgccacactgacttccacaatggttgagctagtttacagtcccaccaacaatgtaaaagtgttcctatttctccacatcctctccagcacctgttgtttcctgactttttaatgatcgctattctaactggtgtgagatggtatctcattgtggttttgatttgcatttctctgatggccagtgatgagcattttttcatgtgtcttttggctgtataaatgtcttcttttcagaagtgtctgttcatatccttcgcccactgattgatggggttgtttgttttttccttggaagtttgtttgagttcattgtagattctggatattagccctttgtcagatgagtagattgcaaacattttctcccattctgtaggttgcctgttcactctgatggtagtttcttttgctgtgcagaagctctttagtttaattagatcccatttgtcaattttggcttttgttgctattgcttttggtgttttagacatgaagtccttgccctcgcctatgtcctgaatggtattgcctaggttttcttctagggtttttatggttttaggtctaacatttaagtctttaatccatcttgaattaatttttgtgtaagggctaaggaagggatccagtttcagctttctacatatggctagccagttttcccagcaccatttattaaatagggaatcctttccccattgcttgttttggtcaggtttgtcaaagatcagatggttgtagatatgtggcattatttctgagggctctgttctgttccattggtctatatctctgttttggtacaagtaccatgctgttttggttaatgtagccttgtagtatagtttgaagtcaggtagcgtgatgcctccagctttgtcttttggcttaggattgacttggcaatgtgggctcttttttggttccatatgaactttaaagtagttttttccaattctgtgaagaaagtcattggtagcttgatggggatggcgttgaatctataaattaccttgagcaatatggcgattttcacgatattgattcttcctactcataagcatggaatgttcttccatttgtttgtatcctcttttatttccttgagcagtggtttgtagttctccttgaagaggtccttcacatcccttgtaagttgtattcctaggtattttattctctttgaagcaattgtgaatgggaattcactcatgatttggctctgtgtttgtctgttattggtgtataagaatgcttgtgatttttgcacattgattttgtatcctgagactttgctgaagttgcctatcagcttaaggagtttttggtctgagacaatggggttttctagatatacaatcatgtcatctgcaaacagggacaatttgacttcctcttttcctaattgaataccctttatttccttctcctgcctaattgccctggccagaacttccaacactatgttgaataggagtagtgagagaggtcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcgttgttgaatttcgtcaaaggccttttctgcatctattgagataatcgtggtttttgtcatgggttctgttcatatgctggattacgtttattgatttgcgtatgttgaaccagccttgcatcccatggatgaagcccacttgatcatggtggataagctttttgatgtgctgctggattcgatttgccattattttattgaggatttttgcatcgatgttcatcagggatattggtctaaaattctctttttttgttgtgtctctgccaggctttggtatcaggatgatgctggcctcataaaatgagttagggaggattccctctttttccattgattggaatagtttcagaaggaatggtaccacctcctccttgtacctctggtagaattcggctgtgaatccatctggtcctggactttttttggttggtaagctattaattattgcctcaatttcacagcctgttattggtctattcagagattcaacttcttcctggtttagtcttgggagggtgtatgtgtcgaggaatttatccatttcttctagattttcaagtttatttgcgtagaggtgtttatagtattctctgatggtagtttgtatttctgtgggatcggtggttatatcccctttatcattttttattgcgtctatttgattcttctctcttttcttctttattagtcttgctagcagtctatcaattttgttgatctttcaaaaaaccagctcctggattcattgagtttttgaatgaatctttccaccaaatattagaaacatatgtacccaaggagtgaggtttcgttttgtttttgtttttgttttttgtatcaaataggctagataatgtatcttttttttttttaattttagtttaagttctggaatacatgtggtgaatgtacaggtttgttacataggtatacatgtgccatggtggtttgctgtacctatcaacccgtcatctaggttttaagccccgcatgtgttaggtatttgtcctaatgctctccatcccctttcccccaaccccccaacaggccccagcgtgtgatgttcccctccctgtgtccatgtggtctcactgttcagctcccacttatgagtgaaagcatgtgatgtgtggttttctgttcctgtgttagtttgctgaggatgatggtttccagaatcattcatgtcactgcaaaggacatgaattcattctttttttatggctgcatagtattccatggtgtatatgtgccaccctttctttatccagtctatcattggtgggcatttgggttggttccaagtcttcattattgtaaatagtgctccagtaaacatacgttacgtgtgtatgtgtctttatagtagaatgatttataatcctttggtatatacccagtaatgggattgctgggtcaaacagtatttctggttctagatccttgaggaattgccacaccgtcttccacaatggttgaactaatttacactaccaccaacagtgtaaaagtgttcctgtttctctgcagcctcaccaacatctgtttccagactttttaatgactgccattctaactggtgtgagatggtatttcattgtggttttgatttgcatttctctaatgaccagtgataatgagctttttttcatatgttggccgcataaatgtcttcttttgagaagtgtccgttcatatccttcacccactttttgatggggttgtttttttcttctaaatttaagttctttgtagattctgggtattagacctttgtcagaaggatagattgcaaaaaattatcgcccattctgtaggttgcctgttcactctgatgatagtttcttttgctgagcagaagctctttagtttaattagatcccatttgtcaattttggcttttgttgcaattgcttttggtgctttagtcatgaagtctttgcccatgcctatgtcctgaatggtattgcctaggttttcttctagggtttttatggtttatggttttatggttttatgtttaagtctttattccatcttgagttaatttttgttaaggtgtaagaaaggggtccaatttctgttttctgcatgtggctagccagtcttcccagggccatttattagatagggaatcctctccccattgcttgtttttgtcaggtttgtcaaagattagatggttgtagatgtgtggtgttatttctgaggcctctgttctgttggtctgtatatctgttttggtaccagtagcatgctgttttggttactgtagcattgtatagtttgaagtcagacagcatgatgcctccagctttgttctttttgcttaggattgtcttggctatacaggctcttttttggttccacatgaaatttaaagtagtatttcctagttttgtgaagaaagttaatggtagcttgatggtaatagcattgaatctacgagtacttagggcaatatggccattttcacaatattgattcttcctatccatgagcatggattttttttctatttgtttgtgtcctctcttattaataagaggattttttatcagcagacatgattatatctgtgatttgtaaagtgaactggatagtgatcaagcccagtgggcaagctattaaaataattcaaaggaaaaatgagaatagcaacagtagtgatagagaagagattttaaaaaatgtattttttttctctctggagatgttaagtatttttgagaaaaggagtaataattgtaacttggcaagtgtgttttgcctttcctagttgaaactacttttcagcagtgagtggataggttgtggtacatgaattttattgttactcattattaaaaagtgtcttaaaaatatgtatgtcttaaaaatataagtaattttccttgttaattatgaaatatgtaatctctttttttttcctcttaatagccttatgttaatattggggttttattgtttttgcttttcagtactgtaagattgatgttaaaggcatggtgttcaccccacttcatcagcgtacataagttatctcttcttttggacccttattttatgccataatggtaagcttcagctcagtatgttcgaatttgtgttttagaatgttctcttccttcatcttcataaagatatttgtatggtagatatagaaatactcttgtaagctgtacaggttatcccaactgggaaattacttagcaatcccattgcaaagtcttctctataaaatatattgctcactaatcagtgttacagtgatcacattcatccatctatctgtgcttgtatttatgaagtattaaaaatatttacctatatctactttgccatattccaaatcgttggcaaggaggatgggtataaatacaaatagttttggggagtatagatttctcgtattttaaagcttttctttagattttattaaaatttaaaaacaaatgtaacctgctaactgcatataacgtatttcaggcagcatcagtgctaatcttctaatggcacatttctgttcactgacttacagtcactaaacatagttaggagtaggcatttaacttttgccattaagaaatgacagactaagggagaaaaacactttttaatgttttaaagaagcagcagcatttgacagagaataaatgaacattgaccaccatgttatttatttagataacccctattctgcgtcacaaacttcagaaaacatctgtcttccttctcctcttggttcttgcctatctactcctcccctattagagaaaagtagaagtatcacagtggggttctgacaacaccttgtattttgcatctatattacctaatcattttcctcttaagtttttgaaggagataatgaatgaatgatgcttttatttatgtatgtatgcatgtctcactagaccctttgaagttttaatttcagaagatgaaatatttacttgagatgactggctgtttaaaattgtcctagactatatatatttgattttgtttattataattttttgatacaaacaaattttatgggcaaaatttaaaagaaccttctgtatttgtgaagtgtatatgtacagaattatgttttcatggtggaacatgggatcagggaaaatgggagtcaggaatcttaacttgaatcctgggaaccagtttcattgggaatccgcttcttataagttttttttttttttttttttttttggtagtgacagaatctcactatattgtccaggctggtcttgaactcctgatttcccaccttggcctcccaaagctttggaattacaggcatgtgccacagtgcctggccaagattttttaacaaagcaaattagtgtagatttattataactgaacgttttgaaaagatggcagatttcagactttgttcacttatcatatttagatatttgataatgtgggttttttattgaacagtgcaagaaggcccactatttttggaattatacaaattctccatccttaggactaggtggtcacttaaaagttcccatgatttccaaagggtggcagtatttgtttttcccccttaccctcctgggactttggtgggtggtaggagtttttacccacatgcaatttggtaggttgaggtattggaatctgcaaaataagacagaagaatttaagtccttttaaataaaaactgaaagttctgtgcctcttaataaaatttaaaaatgactatcattatgaatgaaaaagactataaaacagaaaactagaaagaaaaccactggtggtatatttgggttttgttttatttgtttgttgtttttgttttttttgagatggagttttgccctttttgcccagactgtagtacaatagcacgatctgggctcactgcaacctctgcctcccgggttcaagtgattctccttcctcagcctcctgagtagctgggactacaggcgcgtgctaccacgcccagctaattttgtatttttagtagagatagggtttcaccatgttggccaggctgatcttgaactccttacctcaggtgatcctcccgcctcagcctctcaaagtgctgggattacaggcatgagccaccatgcctggccatgtttaattttgtttagaacctagtacttttattcatatgtgtctttagaaatgatggctttacaaatgaagacatagcatagcttcaccatgttttttcctcgtctctaaaaaatgaacggatagggatctactagtagatctcaaaccttacatgtagtaacagtaatatatttcatcaattctgaggttcattttcttttatattttaatattactgaattgatgatgagttgatactcaagaatatcttagaattgatagcatatttttttctgtcttaatgttatgcagaataatgatgcatgctttcaatggcatcttaaattcattgaaacatggcaatgatagccatcatttattctttctaggcactgagctagagatgttgtaggtttttttcattaatatattagcaatttctaagttaatgttaagtgccagtacaaccgcactctcaattttcaagatttttagcagatgaggagagtttagcctttcttcattttgattgtatactttatggccagtatatttttttgaatggtgctcttaaaaattaatgtctatgaagtgatgatagctgccatatccaaacctcccctatattagcctcacaaacactgaccagagagaccgtgttagcattcttatttagtttgttgttagtaatcaggtgcccaagactcatattttttctttgttatatatatattgatcatagagtggagtggaggagacaaataaaggaaaatatattagacctgttttagaaaacattagaaatgttaaatgtatattaaatttttttgtggaaataactaatattaccaaatatactatttactttttacagcaacaagctttagaactagctttggatcgtgcagaggtgaggtgtgactaagttacatattgaaatagtgttgtctttaattgacaaaagctcagttttaagagatttttgtatgtgatttttaaaggagcacattactattttaggacaagtatgcatatcattttgctgtaaatatataaaaataccaggtgatatttggatcacctgttacttggaatcctcaagataataatgttacagaataaaacttacttgaagaaggatatagaatttctaaaattgtattttcctgttttgacaagttttctaattactcaaaggaaaaaatagctaaggtatacagtatacaatttttcatacagtaagcatattttgaacaaccataaaatatattgataatatttctgacctgtgaagtcatggttgtgaaactatgattttgcttatggcaatgaaatactctgctaaatcgtggtgcagttcaaatttcatttgtttgaaacttatctttagatgttaagtagtttttcctacaagatgtaattcagagagttaagtgaatagcctttttagccttacgtatgttttagatatactcaatacagttgttcatagtcaaaagcaaaaagcaagctgttctcataaacttttgttttttagtatgtcattgaaagtgcccgacagagacctcctaaaaggaaatacctatcaagtggaaggtatgaataattaattggtaacatcttagattcattgaaatatgatgatagctaccttttattgcattcctcgtagggactgagctagaaattttataggttctttgcatgtattaggaatttctaagttgatgttagctactatattcagctccaccccagtttttgggaaattgaggcaaaaatgtgaaaatttaggaaaaaattaaataacattcatgtcatgatgattactctgttaacattttatatatttgtttcattaaatttttttagaaaatctgtatttcaaaaactttatgacttgtatattgaagaatgtgaaaaagaacctgaagttaaggtaagtatacatttttattatgttgtagcttttgaaatgtagaagagaggaatttggaggagttacatttggagtattatttttgtgtgtgtgagtgaactaacatcttttttaacctgaccctagtcaattctgtagctgacccagagctctggctaatctggcaccaggcagagatcacctgctgaggtaggagtgaaggaacagttatattgagtatcagactgtctcactaggaagtcataagcaaagccacagtatatattatcttttgcttcttcttcccccgagaagtgatttatgaatttatagcacttcctcctgagaagttatttacagatttatagcagtaacctgttttctcatgatgatttaaactggaaagccagagctattacagagcatgtatgaaattcaagtacagtaataaaaagtgagcttggtcataaaccgagttcatggccaatttaacttaattcatttttatttggcataaagatatgggtagtagacatgtaacagaagtcgatttattgatgtcttggagccctcgggttggaagggtctaaacgtctctatgagcttttgttgtctgtctttaaaaatgaatacagttttactatttaggccaaaaacagtggaattccagtagtgtctaactttaaaatctttacattaggaaaaaaattatttttaaacttataagtaaatcttacagtatgtttttcataagttctactgatacatacttgacatacaataaattgtacatgtttatagattttttaagttttgacatgtgcattatagaaacacctcatgaaaccatcactacaagcaatagaatgtacatattcatcatgtcagtgacagaactaaaataagagagctacatatatgaagattctaaattggaattggcaagccactctccaccagctaaatgtggcctactgcatgtttttataaatgaatttttattggaacccatcacacctgttggtttgtatgttgtctaggcctgcctcacaggtacaaagacacattgagtattgcagcacaaactatttggcccacaagcgtaaaatactatctggcccattaagaaagaaaatttgcaacctctagtctaaatgggatcaactctgtggtagctaatttgttttgttgaagaggtacacatactgtaaaaatttatctaattctgtcttaagtcaaattatgagggttttctctacactgaaaagactaacattttaagtctctctttactagtttaacatcaaagtggttaaaagttgtttgcctttttaaaaaatgttcagattgcttagtgttttgattctatggtgatgacagattaagaatttatcacttctttctgtatgtgtgtatgatatatgtttaatatatatttactaaatataagatattcaaaacactttgttttttgagattctaaaaaaatttactgttatttttgctaaataagatttgatgacatgatttgttaaatctgtaagtaggtaggttttattttaaattataagcatttttaaaatcatggactttgttgtggtttttaaggagctgttgaattggatttatagaaaatgtccaaattgcttacttcgtcttaccaattagatatttttaggttcaacatttcagcttagagctgttgaacttgtttgtatcttatttagcctataaaatatttaagaaatgtgcacttcttagatacaaccaaagagaatgccccaaattctttaggttagacttctacttagtggaaactgtatgcttctgtgttttatatatttgcatttaatggttttatatactacttatttaaatatttttatttcttaagtattcaaaagtacttgttttatatttaagtgcttttattgtgttataggtcacccatttttaaaatatgaattaatttgcataaaacatagtagtaaataaaaattaagtttacatagctgtcccatacgtagtggctatagttttgtgagccttctccatttattcagaatcataatgcagaaagagcaccaaaaggctaattcaagcctgattttgttaaatcatagcattatttgttaaggttatactggattattttcatgagctctgcctctttttaaagcagaaattaagaagaaatgtgaacttgttagagaagcttgttatgcaagagactttgtcatgtttagtggtcaatctatacccaggaaatgagggatattctctgatgctcaggggaaaaaacggatcaggtaagaccctctagagcacagctgccacaaaatacttttgctaggcaggatgtgcggtttttttaaagtagttttttaacctgctaaagcatttgtccttcagatagtgatgacctagtgataaaaacagattttgatcccagttttcttccttatgatatgttttggtagaatattagaaattatctctcttacaattatctttcctgaatgtgcattttagaagtattctaattgatatgtctttcaagtccaattataaaagcatctcagaaccaaaggaaaggttaaaaaaaaaaggaaaattatagaggcataacttacagatgattaaaatagaatttcctttcattctattgctatttatattttaagatagcataccgtgtttaaaggtaggtagtcctgcagtttgaacatgagtctgaaatcttcaaaattaagcagactcactgccttttgagtaattttcacatattaaaatatttctattaatactgaatatgaacatttctgttaatggtgaatatgaaaataatttaaaaatagaaacacttcagtttcattaaagaggtgtaaaaatttaatatgatgataatgtgaattctacaaggaactcacatagctggaattttgtgtgtgtgttggtaattaattgtaaagtgtaacaccaagagaattttgttctaaaagtgaccacttttcagataaggcaccaaattgtccctctgatttccagattagattaattggtcttcagtgaactttcagttactttgacattggaattttatcatattctgattattttgctttgggctgtggttcagattgtgacgttatgccagatgttttttcataatgtgttaggttttttttttcccccttaagaaggacattaggagggccttttggttttgttttttatttttatttttttgatccttgcttggttgaaatgccttttggttttattatatatagttctttgaaaagccatttgaattatacagctaagctttcagtgagcatgatcattttcaaacttcatgttttaaattaagattccgagaccattcgactgccctatgaagaaggagagttgcttgaatatttggatgcagaagaattacctcctattttggttgatctcctagaaaaatctcaggtacaaaatttttgtctttaaaatgtctttatatttgttatatgtatatgatatatatatgtcacatttttatgtatgtatacatatatgtatataaacgactacatgatgtttcatgacagatgatatttaatttctatcactgttcccaacagcctttagaacatgaaatcaggctgggctttggtggctcatgatgcctgtaatcccagcactttgggannnnnnnnnnnnnnnnnnnnnnnnnnnnnnnnntcctcctgtaccactgcaggattagagaaggaaggattagagaaggaagaggaaaaccagaattgcagtgattgcaccactgcactccagcgtgggtgatagagcaagaccctgtctctaaaactaataataatagaagatgaaatgagacatatatagctatctggaaatgggcttattgtcggatatttaacctttagggtatactgaaacgtagagacgtagttcttctaaaatagttagaacaattagctcatcaattggaaatctccctatagttacaatcaagaaattatgaaagaaactactttgaatatttatgaagtttttcacttgggggccagaaactggcctttacatctgtacttctgttcatagcttgcctaggtaagcactcccttgccctgttctactttcttcttactgccttaacttaaccccagccatactgtgtactctactgaggaaaaagaagacatcacatgagaactctcgtttcctcctagcaccagtcgactagcatccctacctctctcttcatatctgcctgccttcccgttaaaatagttgatgtatactgtttatagacatccatcccctccacttgttttctggatcctccccttccttctcaaggacttaaaattataacctctctttttttctatttctctttctctattaaatgcagaatgcaagcatactgtgttacaggttgagcatctcaaatctgaaaatttgaaatccacagtgttccaaaatctgagcactgactgacacttaaaagaaatgctaattggaacatttccgatttcaggttttttgattagggctgcttaacctaagtataatgcaaatatttccaactctgaaatgcttctggtctgaagcacttcagataaaggattcttaacctgtatgtctcaaattttaaaaaaatcctcccttgacctcatatccttctccaactactgctcttgttactcttgacagccacgctactcaaagaatttatagtcatttcctcttttgcagatcccattctttccaccacctatctcatttggcatcatgacatcgttctgcagaggctgcatttgtcagttaccagtgatcttcatatactgaataattggtcacttttctgttctcttcttaattggcctcttagcaaagatcagtggatataactgcgtcctgcttgaaatgcctttctgttgacttctgagacatcattttcctggttttcctctgctttctctaatccttcggtcttttttactataatccctgttccatccataaacatgtgtgttttcaggttcagtccttggctctctgtttttctttagtaatattctccctgaatgatttcagccagtttcatgggtttttaaaatgttacttagtctattgcttatatgcctcaccatggccattccaccaagctcctaacttacatattttcttggatatataataggttcctcaaatttaacatgacaaaaacagagctttattttacctcccaaaccagttttatcaccagtctcttcagtctaacagatgactctgtccttaccttccacattcagtccatcagcaaatgccagtctctctttaagatacatgatcgtgcccagtgctctgaacaaaacctttgctttcctgtttgtcttcatcttctagatctcatcctcactcgctgcattccatccatccttgtctcatttccacaataaaacactccaagcttgttcctacagtaagaacttctcatatgttattccctctgtctggaatgatctgtccctgaagtgtctggccgtttcttgtgattcagatcttaggtaaaacctaaggtttctatctgcacatacaatccagattagcccttccctatttgatttcctttatagaattcatcactatctaaaattactttgttctgtttacatgtttattgcctgtcttcccacaactgagagcaaatgttgtctgactactgtatctgtgaagctgtacctggatagtgcctagcacatagtaggcattgtagttgctcagtaaatatttatttaaaagaatgacaataagaatgacaaaacatggagaccacagtacccactaaaagttctgaatgggtgaaaaacatactatgagtgaccatggcaagtcataactagcaagacttcgatgataatagttcttacatttgagcatagaaaggactgaaaaactatttttctttttttttttttttgaggtggagtctcgttctgtcacccaggctggaatgcagtggcccaatctcggctcactgcaagccccaccgcctgggttcatgccattctcctgcctcagcctcctgagtagctgggactacaggcgctcgccaccacacccagctaatttttttgtatttttagtagagacgcagtttcaccatgttagccaggatggtctcgatctcctgaccttgtgatccacccgcctcggcctcccaaagctgggattacaggcatgagctactgcacccagcctgaaaaactatttttcatttgaattttatatttagcttccctcttattaataaaggctaagggcaaaattatatttctgaaaattttagcagagcaaatatagaagttatatctagaagctaaaacactggcaaggttggttggcaatttataacaatgataaactttatagtaatgacaaagttagtgaaatgtaacagtaagcctgtgagctgcagaagaacagcagttccaaggatctgtaacataatagtatgtaaatgccaaaagtcaaactgttgacttggtagatgccaaagtcaatctataattagaaactattaaatagttttaaattgcttcttgtgtcatagtgatgaacatgaaatacttcctctgaaaaggtttacatagtgttaaatctaccaaggaaatctactgaagagtacatacatgagtggccagaaatgttgcatgaatgtaaagaatgcgaaatgtttgatataaacccacttatttaggcttttggaaaaaaaaatgacgtttacgtatttttgcccaaacaggttaatatttttcattgcggatgtgtcatagcagaaatacgtgactacaggcagtccagtaacatgaaatctcctggttaccaaagtcggcacattctcttacgtccaacaatgcaggtaaggatgtttaattaagaaatactattttagattttagttgggagttttatttatcgaattcttcatatgtttgtgcatagattaataagttttttaaatttttatttcttctagactttaatttgtgatgtacattcaataacaagtgataaccacaaatggacccaggttagttgttttgttttttaatctcaaacaggcaaaatataggatgaaaaaaaattatcattaagcaaaagtgattttctgcttatttttattcaataattaagtttgatgctttatgtgaaaagctggtattcctttataagatctagaagttaagggtctctttatatgtgtagtaatccctcaagttgcctaagatcattttaaggtcaagctggcctaatatattcaatgagataaaacttagttctttatctcctctcaaacagaagaaaaatgttttgtttttaccatggttacaaatagatactggtttttttttttcaaataattcaagtttctaaaccctagcctagcctatctttctttgccatttatactggttgccttgaaatgaggggaactctcttacccctgagaataaccagttaacccctccagttctggctcagtgttatatgaggggacttcagaaagtttgtggaaaactggaattaaaagataataataaaaaatataaacttttcttctcaatataagctccatcaagttcaagatgcttgtaaatgatatcaaccatttatttagtccacccctgaagaactgagggtcctgggaactgaaccatatcaatgcaatcttttctacattattaactgaagaaaaatgggtactttttaaactttttttttttaagattaggaaacaaaaagaagtcagaaggagccaaatctggactgtaaggtgcatacctaatggtttcccatcaaaactcttacaaaatttctcttttttgatgagaggaatgagtagaggcattgtggtgcagaagtctctagtgaagctttcccaggcatttttctgccgaagctttggctaactttctcaaaacactcataataagcacgttatcattctttgttccttcagaaagtcaacaagcaaaatgtcttgagcatcccagaaaactgtttccatgatctttgctcttcatctgtctgcttttgctttgactgaatcacttctgcctcttggtggccattgccttaattgtgctttactatcttcaggattatactggaaagaatgctttagtatcttggtcctacttgttgaaaatttctattgaaagctctgcttttgcagctgatcgggatgcagtggttttggtacccatcgagtggaaagtttactcaactttaatttttcagtcaaaattgttcaggctgaaccagttgagaggcctatagtgttggcaattgtttctgctgttaatcattggtcctcttcagttaggttacaaacaaaatgaatttttttcctcgtaaattgatgtggaagatctgctgctgcaggcttcgtcttcaacatagtcttgtcccttcttaaaacaagttacccatttgtaaactgctgctttctttgaggcattcttctcataaacttttcaaaaagcatcagtgatttcacaattcttccactcaagcttcaccatcaatttgatgtttgttcttgcttcagttttagcagaattcctgttgctctggtaaaggctgttttcaaactgatgtcttatccttcttagtgtttcaaactaggttctgttcagacatgttataacagcttagtacatgtttattttggtgcaaaaagttttgaaacctatgtatagttttttcttaatactcatttttcataaactttttaaagaccccttgtatatgagatgtccactcacaaaagtgttcagttgcctgactatagtgaggaataattactaagtcaaaagaaaatatcagtaatggtagttatcctttctgtgacatgtgattataaactaagcttcagttcatcagtaactaccaagtattgtgttttggtttgggctataatgttgtcatctacaaaaagattaaaagctattaaaagaatattggaaaacagaaaaactcattggttaccatcagagtttgctagggcatcagattcttactctgaagattgataaaggagagaatataatatttatcctgcccttcttgttatgaactgtattttaggcagccaagtaactgagggaaaattcttaggaaaatttccagctaataggtgcaaaagaaatgatagacttttaaaaaataaaagtttgaaagtcttaatgaagtagtgaatctagacagcagtatttcttggatgtgaaaaccattagatgataggttaatgggaaattttataatgtagaaatctgatcaaacccactgattgaagatgagacagtcaattattgtgtacctcctggtttgatgcaagagacagtacacaacagtagtaatagcaccaataaagaactcttgtccaaaaaaaaaaaaaagagcccatattaaatcaagccactagttgtaactagcagtttataggaattcagtgaataaaataaactcttaagtgacacaatgaggaagaaaccagccagatctagttaatggacatgagaaagcaactggttaattctaacaaattcttatttagcaatattattaattgattcacttttttaaaaaaaatagccttagctatcaagatatttcagaggttaagcaaaataataggattcagtaaaatatgttatgtgataatagtaaagagcctgtatgtttggaattgggtatatagagttcacacaatattagcagagtcatttttattcttgtaatgtagttgagttgagtataggataggactgttacttcacagttactgaaaaatgccataaccctttatgaccctataggttttgtgagagcagagggttttgttttgctcactaccttatccccagttcctggaaaggtgcctaacacatcataggtgctcagatagtttcttgaattaatgagtagccactcttacaacctgaccattccgtgctctacaaattatagtcatacctcggagttactgtgggtttgattccagagcactgccgtaaagcaaatactgcaataaagcaagtcacatgaactttttggtttcctagtctataaaaaggttacatttacactatatagttgaccttgaacaacacagaggttaggggcagtggcccttgtgcagtcaaaaacccatgtataacttctgactcctctaatacttaactactaataactactgttggctgggaagccttactggattttttttttttttttttttgaggcagagtcaggttgcaactcaggttgcagtgcattggcacaatctcagctcactgcaatctctgcctcctaggctcaagtgatcctcccacctcggcctcctgagtagctgggactataggtgcatgccaccatgcccagctaatttttttttatttttggtagagacaggatttcactgtgttgcccaggctgatctcgaactcctgagctcaagcgttctgcccgcctcggactcccaaagtactgggattacagatgtgagccaccatgcctggcgattaacatgtattttgtatgttatgtgtattgtgctctgtattcttagaattaactgttagaaagaaaagaaaacattattaagaaaatcctaagagaaaatatgtttactattcagtaagtatatcatattaaaggtcttcatcctcatcatcttcacattgagtaggccaaggaggaggaagaggaaaagttcatcttgctgtctcaggggtgcaaagagataaagaagatggaaggggaggcagaagaggcatgcacactcagtgtaacttgtattgaaaaaaatctcctagctggtcgcagtggctcacacctgtaattccagcactttgggaggctgaggcgggtggatcatgagggcaggagatcgagaccatcccggccaacatggtgaaaccccgtctctaaaaatacagaaattagctggacatggtggcgtgcgcttgtagtcccagctactcaggaagctgaggcaggagaactgtttgaacctaggaggtggaggttgcggtgagctgagatcgcaccactgcactccaacctggcgacagagcaagactccgtctcaaagaaaaaaaaaaaactccagtttaagtggacctgcatagttcaaatccatgttgttcaggagtcaactgtactgtagtctattaagggtgccatagcattatgtttaaaaaaaaatctatatacattaattcaaaaatactttattgctaaaaaatgctaatgatcatctgaacctttagggagtcataatctttttgcttctggaaggtattgcctggatattaatgactgctgacagatcaggatctgacagattgagatggcagtggcagttttttgaaagacaacagtgaagtttgccccattgattgtttctttcatgaaagagttctctatagcatgtgatacagttttaccctacagtagaacttctttcagaattggagttagtcctctaaaaccctgttgctgctgcattatcaactaagtttatgtagtagtataaatattacgttgtcatttcaacaatgttcacagccaagaatagagtctatctcaagaaaccacttttgccaggtgccatggcttgtgcctgtaatcccagcacttttgggaggccgaagcaggcggatcacaaggtcagcagttcgagaccagcctggccaatacggtgaaaccctgtctctactaaaaatacaaaaattagctgggcatggtggcagttgcctgtaatcccagctactcgggaggcttaggccgagtagcaattcaagaattgcttgaacccaggaggtgaaggttgcagtgagcctggatcacgccattgcactctagcctgggcgacagagggagactctgactcaaaaaaaaaaaaaacactgtatatggtcatccataagaagcaactcatccattcaagtttgatcatgagattatagtggttcagtcacatcttcaggctctctacttctaattgtagttctcttgctatcaccacatctgcagtgatttcttgtcctgaagtcttgaaccccttggagtcatccatgaaggttggaatcaacttctcccaaactcatattaatgtttctattttgacctcctcccatgaatcatgcatgttcttagtgtcatctacaatggcacatcctttccagaaagtttttaatttactttgcccagatccatcagaggaatcactatctatggcagctaaagccttacaaaatacattttttaaatattaagacttgaaagtcaaaattagtccttgatccataggctgcagagtggatattgtgttggcagctatgaaaacattaatccccttgtacatctccatcagagctcttgggtgacaaggccattgttaatgagcagtaatatttttgaaagaatcttttttttctgagcagtaggtctctacagtggccttaaaatattcagtaaaacatgcagtaaacagatgtgctgtcatccaggctttgttgtttcatttatagagcactgatagagtagtaattcttaaggattgtaggattttcagaatggtcaaataagcattggcttcagcatcaagtcatcagctgcattaacccccaacaagagagtcagcctgttctttgaagctttgaagccagacattgacttctctctagctatgaaagttctggatggcatattcttctaatataaggctgtcttgtttaatttgaaaatctgttgtttaaggtaaccaccttcatcagttatcttagatcttctgcataacttgttgcagtttgtatatcagtacttggctgcctcaccttgcacttttgtgttatggagacagcttctactcttaaccctcatgaaccagttttctgctttaaacttttcttctgcagcttcctcacgtctctcacatcatagaattgaaaagagttggaatttgctctggattaggctttggcttaaggaaatgttgcaactagtttgatcttctatccagaccattaaaacttcctctgtatcagcaataaggctgttttgcatttttgtctgttatggatattcactggagtagcacttttaatttcctttatgaacttttcctttacattcaccacttagctaactgtctggtaccataggcctagcttttggcctgttgtagctgtttataggcctttctcactaagcttaatcatttctagctttggatttaaaatgagagatgtgtgactcttcctttcagttgaacactaagaggccattttttgcctaatttaaatattataatgtttctagaagtaagaagtcctgagaagaaggagaaagataggggagatcccacactggggagtggtggatcggtgaagctgtcagagaacatacatcatttcttgatttagtacacattgaatatcacagatcaccataatagatttaataataatgaaaaagtttgagatacaaaaaaaattaccaaaatgtgacacagacacaaaataagtgtgtgctgttgggaaaatgatgctgatagccttgcttagtgcaaaattgccacagatcttcaatatgtaaaaagtgcaatatttgcgaaccacaataaaatgaggtatacctgcattgaatttccattagaagtttctttatgctgtctggtttctaaaagtttacatgcacactaacattggaacttgaaataccatattttactgtagtccttagcagaattccagggaatatttctagattaagtgcaatatatgattacatatttgaaaatcttaaatctggtattgacatatgctcttacacatttcaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtaattgcctttgtggaagggtgaaccaaaagacacaagtagctataaattttgctatttatagtatcttttccctccagggtatggttgctccgattttggtggggaagggtagagatgaggtctctctttgttgcccaggctagtctcaaactcttggcctcaagtgatcctcccactttggcttcccaaacagctgggaatataagcatgaccaactgcaccagcctctgatttttttttttctttttgaaaataggattcttaatggtctcatattatatatttttatatagtattattatttttttaaatgctctatgctttagattgaactgttgcattttctgcagtcttttaaagaataaactttttctaagtttatagtctgtttgccaaaaaggtaaagaggctgagatcaaatatgaacagaaagaataattttttcattattttcctactaatgaatgactgatttaattgttgttaatcctactttaaggaaagaatttgtaattttgagatttgagaaaatatgatcatagtttttagaagtcagttataaactgaatccaggcacacctaccttttgtttttgaaacaaaccaagcttattcctccctcggcatcttttaaaaatgtcccttcaaatagtcattccctgatctttcagaatattttcttttccccaccctccatgggaaacatgaggggatttttccccggtagtcactgtgagaacctctttgagctcctggagataaaacccccaaaagtctgggggctcccagtgactaggtccccttggagttttgaatctctcagacatgtccacagtaggcctccagcaattcatcagttatacttgaggttccctaccctggcactggttcctgaggaggtttctgctaatgggtttctgcttcagcaaggcatgatggtctgcatttgcctattggtttctccaagtttggggcagtggtttgtcttgtgaccacatctctttgatggatctaagaagaatcgttgatttttctgtttattcagctttttacctgttaggatgaggtggcaacttccggagtcttacatgcctgtacccaaaactggaagttatccccttcactcccatctttccatagctaattccttctcatcattcctatctcagctcacatgtcattttttcagactcttttcctcccctccctctccccattccttccctaatgttgccctccttatcccatactctccacagtactcttttgcttctcttactgcttcttggtgtctgaaatctgaaattattttatctgtttacttgtgaatgtctcctccccctctggacttgatagctctgtggtgatgggaattttgtttgtcctattcatttttatttcacctagtcctagttcctaggactgtgcttggcatgtggcagtgttctataaacacgatttgtacatattcagcactgactagtttcaactcacatatattatgagtttcttttattagtgccgtttagttcaaatttcttaatatttcaggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaatgtaagtatatatattttaaatgaagcttattatgcccaaaagcctgtcttatttagcattttcagtatatttatattgtttttaatttttcagtatattgtttttaatttttcagtgtgtagatatgtggaaacggagtccctgtaatttggccataccttctgaagtagatgtaagtcagttcatgaattactttttttcatataaagtttctcagttttactattcggttgcttataccttgagaaaacaaaaaaaaaacttactttaaaaacaaagtgatttagatcatactctaaacaagttttttaaaaacaatatgatttatttcaaaaaacatcgaaaaatgatttttagaagctgtgtattgttcttttttcacattaagttgaaagaacataaccccttaatatagttttttggagcaggaatagtaaaacaattttaaaattggaaaaatacagtgtatattacataatcacgtgaaatctctctttttttgataatatttcatcaaaatttcctaatagtgcttgtttactcaaactggttaaatttgaagattaataatattatttgacataaaataaaataaagattaataatactagagaagtaaccaagattaggaacattgggttgtattctttattgatccataatatacatgaactataaatggttgaagacaaaaaagggatattttgatgagtgatcctatgtttttctttctcctctgttgttttttatattcactcaactctttattttcagatttgttcttctgttgcaccctttccatgctagcacatgcattattcttactatttctgatttaaaaaaaagaaattacgcaaagcacaaagccagaagcagcagtagactgtatatacagctcaaggaagtaagccatattatcttttggtagcttatgtgcagttcttcaaggaacatggcctgataatagaatttcagtgtaaatactgaagggtggaatttagctttggaggacaagctggagtacttcccaaactttaatgtccttacgaatcagctggagagcttgttaaattgtaggttgctactcagcaagtctgaggtgctaagatgcatttctcacaagctcctaggttatgtgatgctggggtccatggaccacacattgagtagcagttgccctcaaagcttctcagtctagctcaatcagaagaatcacctaggatatcagttaaacatagagatttcaagccctactcaaaatctacttacttaggatttctaagggacagacatgaaaatctgtatttttaataggtgctccaggtaagtctaaattactcttaagatcgtggttgcctgtaagataataacatttgactcacacagatgcctaggacatgtacagaatatatggtcaagtctgactagaaagtggaaaacgttcaaaaaatttgatcagctttaatattttaccttccctagtctccctcagttttgtccccactgttacatgaccgcttttatttcaagaaaagcctgccaaaaggaaaagatctttatccttatctctctgacattccaattttcctgaaggaaaagctctaaaggaaaaacatatcagcttatggacaaaaaaatgaagaggcactgtctagaaaagcagctgtgtttattaacacttatttatttggtttggttttattaaagttgttttatacacatcagaagacttttaaactgcttaagcataagtagttgataccggtaatttaagaattcttgcgctaacaagtatattgtattgtcgagttacttagtttcttctctttgatcagaatactgattccattttatctgatatggattctattttatgtggtatttcttgatttgattgtttaggtggagaaatatgctaaagtggaaaagtctatcaaatctgatgactcacagccaacagtctggccagcccatgtaagaaatcattgcctgtctctgtttctaattatgccatttctaatctggcctctgaatttattaaacataaagtgcaattgccattagtttgggaccttttttcttttttaaattagtttctgcgagttcagtttattacaagaagaaacaactattttgtttatcagagtatgctttgcattttaaacagcaattttttatttttattttttatttttattttattttaattttttgagatggagtttggctcttatcgcccaggctggaggtgggatcttggctcactgcaacctcttccacttcccaggtccaagcaattctcctgcctcagcctcctgagtagctaggattacaggcacctgccaccacacctggctaatttttgtatttttagtagagacagggtttcgccatgttggccaggctggtctcgaactcccgatctcaggtgatccgcccaccttggcctcccaaagtactgggattacaggcatgagccactgcgcccagccttaaagagcaattttaatgaagaacttcatttttacttttggtttgcgtattggtagttctgatttgttttgtttctaattaataaattcttctaaggctggcttttaacagaagtgttctttataagttttcctaattgcaataataacgtcttaaaaagagaggaataggtgtaatatttaaattaggtgaactctgggagtgaaatgatgacagatgttttttgtgtgtgatagcaaaagcagacaaatgataaatagatctgcttttgaaagttttatccttttaatattatttaatatttgcaattcatatatctagtatgaaattctgccatattaagcttgattaaacatgccatttaaactctcattcccagagtaccatgtaaaaaagaatcctgtactgccctcctgagcataaacaggcacggcagcatgaggatcaggggtgcaagcttagggacagactgctaactccctgtgtgaccctaggcaattcatttaacctctctttgcttaattccctgacttctaatacggaggtaataacagtgccaaccatgaaaatatggtggagctttcagtccctgtagagtgctgagaacagtgtttgattaatgttcattgttattatatgtatatcaatatgtctaataatgtatttaatgatgtattaatattgttacatatgtgttcatacttcatagtatatgttaatgctttactaaatgcatgctgagtgcccatatagtttttaggaaaagaaccgtgctgtgctttattctcataggcagacttaaatatctttgtagcctaagtgctgtgtgtcttcctatcgtcagatacatgttactgtatcatttattcctgatttttactaattcttattgcctgcctacttgtgaaggtatttatttgaggtgctatgcatttttcaggatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacagtgagttctgttaaatacaagtaactggaaaaaaaaaaataaggcaccaagaatttatctagtaactactgatgaaccattaatgaataaaaatttctctttgggaactcacttattagttaaatataacaattagatttggcggtagacctaagtaaacttaagtcgtagttaccatgttgctcaagagttattaaaaataaaaaaacctatggtataattatttttatgcttgttttgaaggctattcctgtgatatccttctttatatgtttatggcacttaggactttaacctttgaacatgaagtgtttgggcaatagtgtgtttaaataggaagcaagtttactataaatgtgaaaagatgcttggtattttggcactgcatgtaaggacacagactcaatgcttattgtagttattggccctacatattaatacataaaaatatagatgatcttccaaaatgtatgaactacatatatttggtactgtcagtatttagttttattttgttttactatttatttggtttttttaatcaaattgatttgaaaaataagttttctgttttgaaaacaaaaaagaagctcagcagaaaaggatgggggcgaggtctatgttaattgtaaagcctttacttacacaaaatactaattgaaactacagtagaaaggtggattttaaagagcaaccccaccaatatttaggtaaaagtcaatgaaaggaaataacagggaatcctcagcttgttttttcacatgaccagtttttattattgtaaaaggatcagatattttgataacatacattttcttcttttttttttaagttatagacatcacaacagtttatttctgaatcctcagcatgcatttctaaggaagccattttttttctttatttttattttagatataggggtatgtgtgcaggtttgttacaggggtatatttatgatgctaaggtgtgggtgtctgctgatcccatcacccaggtagtgaatatagtacccaatattgattacttatatttaaaaaaatcttttcacttaaagacaacatacattggccatttttaatttattaacttatttttgtagaacacaagggtgatacatgttcttttgtgaaaaaattggtctatagagccaaatgactaatttgtttgacaggaagagaattgaattttttacctttgcatcagagtagctgcatgatttattatcttccagtcattcttccatattcataaaatactttatttaataaactatgaagttaaagtttgagctgcattaactaagcttttttttacattttatatttcagctcgtccacagatgatcattcaaattggtaattaaaaaataaactattttaatctgttaagaaattacataaatatcaaactctttaaaaagacttgctaaatatactttatttgaatcagtgataaatatgtatactttgtttgaaatatattctaaggatctgttatgtagacattaatagtaacttctaaaattgcaggttaaagtgagaggaaggccaaagacctttgcacatgttagttcagtgattttgctttaggatcaatagttgtaagggtatatagcacttggtaactttcagcccagattatgttttaataaataaattttgtgccaaaagaaatatcacttaattaaatcaaccaaattattcacattgtttcataatgcatgcaaaacttagtcattgtttcatatgtttaaatgcattaaaaaaatttttttcatatcttggtagatttaataccagtttatattactgtgactaaaacatggaagattcaaaagtaatcccaagccttcttaagacaactcttacctaatacttttctctccttttttttccttaaacattttaggttcattattggatcaaagaccgatgctgagaggtaaaaatatttgcatctcttattttggtcaggatggatatgaaaaatttttcacccttataggatagagaatactaggagttaaaaactttgattttggttatgctgttaaccatatttacactgtttaatatttatgggtctctgttgtaaaattagggcattggacaataaaacctctaaggtcctttccaactttaaaatcttactgattctagaaaaatatctgtaagcttgtgatacaccaaactactaagaatggttcttttcatgggatgagatttttgggggacttaaatgcatttttccaaagtttataatacctaggttttttttcatagaattaagaaaacaaaagaaatgtttaaaatatagttttgttttaaataagaaaacttagacatatctactgtagctaaggaagatgatttctagatagtactttaatcagaatctaagaaaggaattgagtattttctttggctgcttattacttaagtaatccctgtaatttctgtattagaaataagatattgaaagtatatctttagattgttatttagcacaatgttttggacaatttgtcattgaacagtttaaaaatatgtacttttaacacaaagataaattgcctaatttttaatatttatgttaattttgatagaactttctttttgccattaatagtcattattctttcctataaaataaatttgtgtttaaaacaggttttctaatctttacctgttttctcctgatattttagggtagtcaatcagtaccaagaattagtccagaatgaagccaaatgtccggtcaagatgtcacacagctccagtggctcagccagtctgagtcaggtttctccagggaaagaaacagatgtgtgtttcattaatgttacttctttgtgcccagttgtttcacaagtaatctgagaaatgttaagaatcatttttggaggctaggcacagtggctcatgcctgtaatcccaacactttgggaggccaaggtgggtggatcacctgaggtcgggagttcgagaccagcctgaccaatagtgtgaaaccccatctctactaaaaacacaaaaattagctgggcatggtggcacacacctgtaatcccagccactcgggaggctgagacaggagaatctcttgaaccccggaggtggaggtttcagtgagccgagatagcgccactgcactccagcctgggcaacagagcaagactccatctcaaaaaaaaaaaagaatcattttttgaggagcgggggtacagtttagttttgtttctacttttacctttttttaaaattatttaactctttataacatgatttttaaatgtacacaaagataaaaggaaaattacaatgaacacctgtgttctagtcatttggcttcaacagctgttattttcctttaatagataagtatggaagagtggaagcttgctttcatcttactcctctgcctttctccctaaaactctctcttcccaccctattactcagaaatcttttcctcattctttatgtgtactgtaatatatttcatgaatctcatgtgaaattttctctgtaatacatatagtattcaatctgtaaccactaagagcactttgcagagttaaaaatctgggatttatagcagtattaattttatttaataaactatgaagttaaatataaatatcatctggggtttatagcagtattaattttaacaagtaagcttaatgtcattgtcttttagcaaactgaaaccgtgtcagttcagtcttcggtattggggaagggtgtaaaacatcgacccccaccaatcaaacttccctcaagctcaggaaatagttcctcaggtattacatttcttagttttttgcagtctagaataacaaatattatataatcataatctctttttaaaactttgccccattttgatttctacagttcacagaagtttgaattataaatttaggaaataacttttatgttcttctaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctcaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaatttttatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttggtaagtttgcattgatgttcggattttttttttataaagatagtttcaccaatctaaataaattcttaatgtgtgaaattaagaacaaaccgcatattactcagactgaaaaggaatagtttagatatggacagaagctgcctgaccatgtatgttttaattttaaataatacatctgttaactgcactaagatgatatctcatcttatcgtttttgttttttgatacttcatcttgacagcagcttagaatttcctatttatcttctgcattactttctttgatatttaagacagataaataactagttgtgtttgcttagtagttttgttttttaatctgaggaattgtgtggctgattttttccttttacagtgaagtttaatgctttgtcttattctcctgcagtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtcagaatgttggaaataataacctctaaaaaaaattaaagtatatgctaaagtaaaaatgtaattttaagagtaatgctaaaggcatttaatgtcattatttcatgaagtgttgtatcacatatatttcacttaaaaagcctttaaaagttctggcatttgaattaaaagtcttctagcagtcaacttctgtggaaaacttggtaagcctgtgagtctgtgcaaatctttcttctgctttccaaataacaaaattaattttggtagccttattgtcatcgtagttatattccagggaaaataagtgtattttgaaaatatacattgtgtacaagaggcaactgcatcgcagttaagagcctggattctggagccagactacctcagcttgaatcccagttgtacagcttaaccatttgtgtcatcttgagaaagttacctttgtgtttaattttcctcataaataaaatgggaatagcaataaaaacttacctcatagtcgtgaggattaaatgaaatataatacaaattatgtgtttaaactgtgcctgagacatgataagcattcttttatttaggagtagttattacctatacaggaaaacagttataataacttgtgcttatttttttgatgctctttaaaataatgtattataatatcttgaaacgattcagtttcacttgaagaaaaatgtaataggaaaaacaatctagaaaaatttattaaaaactttcttagttatgagaaagagaacctagagaatataattaaacatgctaacatgttgctgtaatttcctaattctagctagtgttcttattttaataagcataagtgtgccttagtgcgagaagtcctggaaatggacttcacatcttgaacttaggatatttacatgtaactactagttgtaccagttacatgtggcttcagttgctaaactggggttctacagaagtcactaaatttttcccccttatcctcagttcagtttgctctaaagtgggaataaaaatatctccagttggtacttaagagaactaaatgaagtatgaaagtgcctttggtaagctagaaagcattatacagatgtcatccacttttaaaagggggttaagccattttcttaaatgagaatttttccagaaagggatatttttgccaaatttcagtttcttatacaaggcttcgctagtgttacatgtgcatttcttcccttaaatctttaaaaaaaaaaaatgatatgatagagaactagatacatttttaaatagtgttcaaattagtatattttgttagcaaaatatatacataccttgagaccaggatcaacaaactacagcacacagcctaagctagaaatggttactacatttttataggattatgaaaagaaaatgcagcagaggccatttgtgctcacaaagcccacatgatggccctttattgaaaacgtttgtcacccccagctttaagatatgctctgtgttaatgtaacagattttttaggaataagtttaaattaacagagcactgtttcctgactctgttttgatctttatacacaaattgcaacattctttagcattctgattaacatttttagttaaaaaaaaatagcataaagcacaccggttcttagagatatgattattatagtatactatgtagcattgagaaatgtaaatagatgccaatacctggaatgtatttgcacagcagtgatagttttgttatattcatggtgttcacataattcttgattactctttgttcagccaacagtcagaagaatgaaaaagaagtcccagtttctgaaatatagaatataatgtgcatctggtgcttcacaactttgaataaaatctcagtattgataaatattgaagacaatcttttgtttttaagatatttttgaagtatggaaaataagcacatctatgcagagaatacataaaattattgtacttatatatactaaagtataaattattttcatgtgtaataaactttcaattctgttataaccatgagttttatttaacaggtgttccatttggtttaaaaaatacttcaagtctcaggcccttaaatctactccaggtaaacctgaaatactgcttttgattaaattttttgtacattgactttttttctaaacaatgtatatctatatgtatcagcacttgaaattctgaggtctgtttagattcttctaagggtgtggttattattgctacctttgtatgatcaagcggataaagagaaagaatcagtatcctatataccacactttggctccagtagccctgcctaattaagaactagctgtgctagtggggagaatttgcacctaccaaggaggatacttccctacaataataatagtggatgtatttagaaaataattgctttcccaacagatgttttatgtatacatatatgtaatactggtttttttttgtgcttgaaggagatttaaaaaataggtatgtgggccgtacatggttgctcacacctagaatcccaccactttgggagacccaggtgggtggattgcttgagctcaggagttcgagaccagcctgagcaatatggtaaaaccccatcactacaaaaagttagccaagcgtggtagcatgcacctgtaatccctgctactcaagaggctgaggtcggaggatcacttgagcccaggaagtcgaggctgcagtgagctgacattgtgccactgcattccagcctaggcaacagagtaagatcctgcctcaaaagaaaaacaaggggggtgaatttacaacattcctcgtgttatgctaggtcctctaatttaaagaaggagtaagctttaagctagtagtttggaaaatggatagacgtgactataaagatctggatatgtaacatagtagagctatggattgatgggaaataacaataacagatcagccaccctggtattcaggattaacaaatcaggaaattctcattagagctaaaatttaaaacttgtttcctatatacgatgcagtatgtttacagactaattgcagaacaatatacttataatatgggcaagcccacaaattgcatttgtttatttagcctaccttccggcatattgcttttgaaattttcttagggatcagtctcagtgttaacaggaatggaaatcctttagtttgttatatttttctacatttactgtatactgattgaggaaggaacatttgatctgtgctgtgtctagatttacctaatgatgagctgtgatggatatagatagatactttgacccaaggattttttattttttttttattattatttttttgactatacagacctaagagttctgtatttggtattgtcttggacattctcctaaggacctcaaagtggtccgtatataaacccctatagcttaaaatggaaaaactgtttgttttttggtgcatttgaaaagcattgttttcccttttaacctggagttttctgagtgcttctttaaaaattgttttttaatttggattaaattcaaattagatttgaatgaaagagaaagtagtggtctacagaataaatatggacatctaaatgcactttcttttcagctttgaaattcctcactgtgttatacaaaagatcttgtataatatttgtgtttttggcaaaactagaacaaatttatgaggggtggcttttcgtagtatacatttctgattcataagctgcttgtttgtactttctaatgtatttagtgctcttttgtattgatgtataaaaagagtgaaatgaaaaatagcatgtgaattggaatagctaactactagcttgaagcagaaaaatttatgtttaagagtattagcatacttgggagcccaaagtaataggacttaaaaacagtttctaaataggtcttttttttaagggcagccaacttgttttttctttacctgtttcttcaataactagaagagtgacacatagcaaatgatccaaaaatatttgtagaataaatttaaatatttgatataaaatcatgtgaaattggttaatttttgtttaaattcttaatagcttccaggtggttcacttatttttaacactctgcagcagcagcaacagcagctctcccagtttacaccacaacaacctcagcagcccacaacttgtagtcctcaacagccaggggagcaggtatggattttctagccttccatatgcttttacatcgaatttataacattttttggtatattccaagcatacttcatttgctttgttagtgtaaacatttcctgtactgtttttattaacaatagtagcaatcagctattgggtgtgtattcctaataaaacagtcataccatactgaatagatggtatcacctgcatcttgcatagatgattgagatccagataaatggcttgctcttagccatacagtgagtggcagagccagagattcaaacctaggtctttgtgcccctatcactcatgtattttctaccccatcattatctttctgtttttaggattttgttgctattggaataaagatatccctattatcataaaatgtagggcagtgggaacacagacaaaaacaaacgtgtacactgccaaagggaaagaaattgaataagaattgcaataaatgacagtagaagaaggaagtacaagtgtttctaaactttgggtacactggagtcatctgggaaattaaaaaaatattgattcctgagtcccaaatccagagtttctctatctcacaaattatatgaaatattcaccattagtccttttgcccagtttcccccagtcaggtcttggttggataaagctcatcctctaatagagtcctcaggaagggcacattaaaaacttactgttttttcattctaaacacattaaagattgcttggctagatataaaatctttgattttcttttaaaaaaattaattttaaggtacacataaaatttaccattttaacttttttttttttttgagacagagtctcgcgctgttgcccaggctggagtgcaatggcacaatcttggctcactgcaacctccacctcctgggttgaagcgattctcctgcctcagcctcccgagtagctgtcgctacagacatgtgccaccacgcccgactaattttttttttgtatttttagtagagacggagtttcaccatgttaggatagtcttgatctcctgacctcgtgatccgcccacctcagcctcccagactgctgggattacaggcatgagccaccgtgcctggccaaaacttaccattttaacttcttaagtgtgcaattcagcagtgttaagtgtattcacattgttatgcaacagatttctattatagaactttttcatcttgcaaaactgaaactatatctggtaaataacaactcctcccctcggccactattctactttatgttagtatgagtttgactattcaagatacctcatataagtgcagttatatagttatttgtccttttgtgtttgacttatgtcacttggcataaagtcttcaagggtcattcattttatagcatgtgtcagaatcaccttcctttttcatggtgaataatacttgtatataccatattttgtttatccattcatccactgatggatacttgggtatcttccacctttcggctattgtaaataatgctagtgtgagtgtgagtgtacaattatctctttgagaccctgtcttcaactcttctggatatatacccagaagttggattgctggttcatgtggtaatttttaattttttaagaagcatcatactgttttccatagtggctgtaccattttacctaattcccatcaacaacatacagagatctcgatttgtccaaatcctcgccaactcttgttattttctggtggtggttgggtctttagggaattttttttttttttttttaagcagccttcctaatgggtgtgaggtgataatcccattgtggttttgattggcatttccttaatgactagtggtgtggagcatcttttcatatgcatgttggccatttgtgtaccatctttggagaaaagtctgtttgggtcccttgcccattttttttttttcagattaatttttgttgttgaattgtaggagttcttcattcttcatatacacatatatcagatgtttgatttccagatattttctcccatttgttgtcttttcactcttgattgcatccattgcacagaagttttttttttttttattttaatgtagttcattttctctttttacttttcttgcctgtgcttttggtatcatattgaagatcattgccaaatccaatgtcctgaagcattttcacttgttttcttataaatgttctctagttttaggtctcctttaaatttattaagaactcttcctactgttgacttgctttatatgtttttgagaaatctgatgccagtctaattatcttgctcttgtaagtttatttaagcagtttgcctagaggccctgaatgcttgtctaatattttcactggtgtgtgtgtcagaattgatttttccatgtttttcctgtggatccttttaatgtgtagagtcacttctttatttctggaatgttttcttggatgatagtttgtagtttcgtaagtggaagcttagattattgtgttgaggtcattcttttctaaaataaacaattaatgttacacatttccttctcagtactgcttaagccactttccacaaattttgatatgctgtgccttcattttgttccacagaattttcttatggattcctcttaaatcagttatttagatatgtttgatttccaaatacttgggaattttccaaatatctttctgcagttgatttctagtttaaatccactgtgatctgaaaacatatttttggttcttttaagtttgttgaggtttgtttaatgcttgagaacgtgatctgtcttgatgaatactccatatatggctgaaaaaatgtatattctgctgttaggagtgttccatattagatcaaggtatttgatggcatcattcaggtcttctatatccttttctttctgtatgttttatcagttactgagagaagtgttgaagtcttcaaccaaaactgaaaatttctatttttccttttgctaaaggttgttttttgagcccatattgttaggtgcatatacatttaggattgttatttccttgattaatttaccccttatcattaataaatgaccttctttatctctggtaatatttcttgtttctttcttttgattaacgttagcttagtacgtcttttttcatccttttagttttagcctgagtccttttatttcttagtatttgttttcttcttcaagatgtttgtttaatcattattcctccttgtttgaatattccatttgtggtggtggcttatagtctacattaggtttgtggagtgctttggggggaaattgatatcacctgtagtttttttgcattttgagtttttttgtttgttttatcatagctccgttatggtggtgatgtggtctgccttattctgttgttcatttcatgaactgggttccaaattcaataatgtgtcctcctttcagctctgtgctcttttgtccaatcttttatatccagggagatcccctcaagataaatgtaacttttgaaatgtttggcttgcaattatatactgaaatgttacttcagacactattttaggtggtaccaaaggatgtcttttgcagagcaaaagtttttaattttgctgaagtccaagttaacagtatcttttctttatggaatatcctctagttttcatgtctcggaactctttacctagctctaggtcccaaagattttctcctgtgttttttttctaacagttttatagtttcttattttgaatccatgatccattttcagttaatttttgtacaagatgtgcaacttaggtccgtgttttgtttttgtttgtttttgttttcctatcagtatccaattgtttcaataccatttgttgaaaaaaaagaaaacaacaacaaagaaaaaaaacagctattctttctgaattgaattacttctgcacatttgttaaaagtcagttgggtctatttgagtgggtctatttctaggttccctgttctgtttcattaatctatgtgtctctccttcagccaataccacactgtcttgttcattgtagtgtcttaaaattgggcagtgttttctcccataccatttttcaaaattgttgtagctaatgtaggttctctacctttccatatacattttaaagtcatcttgtctatatctacaaaaaccttgccagcatttctaaaagaattgagttaaacttgttgatcagtttgggggaagaactgccatctttatgatgtgagtcttccagtacatgaacatagtatatgtccttatctagaccaaagtcaatgttttgtagtttttggtatacaagccctgtatatgttttcttagacttaagattaatacctaagcttttctctttttttttgagtaattgtgaatggtattttttttatttcagttttcacatgttcattactagtatatatagtgttgatttttgtatattggtcttgttttgtgccctcttactggacttactacttctaggagctgttttggagattgcttagggttttctaccatatagacagttgtgccatttgaaaataaggacaattttattttttcctataaaatctatataccttttatttccttttcttgacttagtctgctgactaaaagttccagcactatgtttatgttacaaagggtgttttaagctttaaaaaattgtttcagtgaagctttataaaagccttaggcgttatctaggtagcattaaacaataaatacagatgcactgaaaaatgaagttttctttgttcaaataccataaatttattcttgcttattctaaatacctttgaagtattttccttgttattctttttacaagactagtctaatactgctttctttcatataggaaaaaatactgatttcttttcaccagctcaaatttgtttttctttcttgtacaagtcatttattatttttttattcagggttctgagcaaggttcaaccagtcaagaacaggccttatctgctcagcaagctgctgttattaaccttactggagtaggaagttttatgcagtcacaggcagctggtaggtatcttcataactttatatgctgaatttactaaacatatctaatctatttgggatctcaccgcttaaattattttcttttccttcccttgcaaccagtaaacaggaaaaagtaaagctataatgtgtaaactattaaattgattgatggctgagattttttttcattgatagtggattaagagctttgacttaacataattaccacagttgtgtttccttgttacagtttactggcaaaataattatccactttactaggttaccagagctgttttcagtgtttgccaatagttatcttaattaataacttttttgttttcctgggttaagactgaatttttctagattgcataatcttttgtctcgttctggtaacttgtagttgcataaatgacttaagtcttaatggtcaatagcataacttctgtaagtcacttttatcatttaaaaaaaaagattaaattacttctcaacacttccagcagtaaatggtgaactaaagattactcttaatgattatcctgtcagttgaagacgataattctaacttcctgtcagttgaagacgataattctaacttcctgtcagttgaagacgataattctaacttcacacttaattaaaagagtaagccatatgtataagaaaactatgataggagtttgaggattgaatgagtgactgtgttgtcagcatcttatcactgtgggcttactatgatgcctttagaagtcttttagaatgataatctttattttggaagtcagttatccttacatataaagttccaatttagaggtagtgaatttccaaatagaagtttatataatcatatacctttatcagaccaattgtgaatttccgaaaatagctgtagtataatttagtggaaacaactctagtctgaaaaaaatcatgagaatgttcttagccacagactgccatacttaactttgagtctgagtcacttaaatcatgttggccttcaaacttccccatatgtaaaatgagtgttgaactgattactgtggtcccattcagctaaaaaaataacaaacaatgcttagtctcagttcaccacctttattgttagtagagtagtctgatattcattgcagcatcttttgtttaaagcaattgtctgtctaccagctttgttgttacaatagtttggatttcttccatctcccttctcctactttgttggttttatttcaaaaataatatactcttctaaacaaaatagcatcaatatcaaattttatacagatgcaagagaagagaggttcagtgctttgatacataatgcactcccttctctttttgtgtccagaaagttccattatcagtggtacccccaactaacaggagaccatatactaaatttattctgaaatgtctatgatttgatacttaagattaatcatactgctaacttttctattatttcattttctatgttgtccttttctaaccctggtagccttcaaactttttgactggcctgctttccccttctcctctctgtagtgttgtctcagcttggctctgccgagaacagacctgagcaaagccttcctcagcagagattccagctctcctctgcctttcaacagcagcagcaacagatacaagtaatccagcaacttcactctgattacatttttaaagatactcagctccaaaagtacctcaaaataacttgctttagttttattttactgtcttttaagactgtacagtaattggtaaataatttagcaaattttaaagtctgacattttagccagtcaacttggagcactgaatatattttgtatatttaagccatactctataaaatttttcatgaagtgctggtggcacattaacatacatttttctagtatgcagtatattttgaaagacagttgtaagtgccaattgttaactttctaatattttactgcagaaaagtgttcctattagtaaatgtcatacctgtttatttagaaaaatgttataccataattttaggaaggaaagtcagcatattatagttgactatcttgatattcagggttgttttatattgctataaaccatcattatacaacaaaatggtaactgaagttgctgagttactacaatatagactggcagggcaaagtaacaaataattttgaagtttgccaagaatcatttttaaagcccttagcaggcttctgtgccactggtgctgtttgactgtgcattgtctcaatgtggtatagtccctttttgttatcttggtgctttctccctttttcagttgtgttgtttcgtcactcaggaaaagcacctttctacacctgcctgcatttaacataactcgatttttttccctcccttttgcagcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaatgtggtggctgtttatttgggtttcatactcttaattacttcatccatcagttttttaacttctttgtgtcttgtaactgctcggctcatacagtcctgaagtttagctccagttagcccacttccacctgaaaaattattttgccaatacttttaatctcagttatcattccttttcaaaaaacattaatgtcatgtcaaattataaaacaaaaaaattggataatgtaaatcagggtacagtctcaagatctacaagttagtttcacaagacctccaagtgattctaatgtatgtcttaagtttaagaaccactgacatataccattaagatggaagaacattttaggtagctaagaaactatactaaaattaggtaaataaaatatcccatattctatttggccctccctaatttaaggctcacactgagttttcatctacatatgtttaggactgaagtggcgggaacatgcctggtttgtgaagacaacagagtttgccttcctcatccattactattgttaaggttcctgttgccagatgttcctcctctccagtagggtcaactataagcaaagtgctataaaaagaaaaaaatataagttatcaatccatggaacaaattttactttaaaatactaaacatactatcagcctcccaagtagctggaattaacaggcacacgccatcacacccagctaatttttgtgtttttagtagagacagggtttcaacatgttggccaggctggtcttgaattcttgacctcaggtgatcccctgcctcagcctcccaaagtgctgggattacaggcatgagccaccatgcccggccctgctcttctatttctgaacgtgctaaaatccttggaaaatattgaagatagcttcagataaatcttatagtgaaagaattggaaattaacattacacaggtataagtaaaccaaggaacaggtaataattgtgcagtgactagaaataattgtgcagggacaagtagaaactcaagtgtccagggaaaactaggatgtagggtcaccatagcacttcctaaagagttagaatgctgaacatcaattaccctaatcttaaatatagaaaattttaaagtaagtttgattaacttactcatcaaacacagcaaaggaagttgcaactggatgagttctaatattcaaataacttttcttctttaaattaacttctgctaaagcagtttcttcatttatagtaacttcaggcaactgtactaagaaaaggcaaatttgtaaagtaagtaagtctctaagaaacaaatgatttctaagcttttttttttttaattcacctttccctctatttaacttgcccagaacatttctttttaaaaagcaccttacagccactaaggtaaatatagaggatatacattgcttttcacaacatctgacattcctacctagtgcttattgcataatttttttttaagtttaagaagtcaatgatttttttttaaatttatatctgccaggtactgttttaagcattttcatattttcattgtattcacctaatcaatactcttacaaagtaagtactattatccctattttattatagataaggaaacttcagcacagagtgagagagccaggaatctactttaaccagtctattataatattttgctgacttcattttctacctccaattcacttaaccactctactataatattgctgtgctaactttatattccacctccaattatttgttcctaccaattcatcattcatcaatgatagggaatatgcacaagttattgaaatctgtaactaatcagtcaacctagactccttgctaagaaacttccctattactatggcctcacagtaaaaacaacagaatccattctacttcttttggcaatatcacataaagaactatgaggatactggcagatcttcaccaatcacctagccagaagttacaactcttgtctccttctcccaccaatattaacactattttggaaaggactgaagtcctaacttaagtagatgggtacagtcaaagcagcactctaaagagcattcagttagagaatatacaactatcaactatatttggaaagtcatgtcagcattacattcattaatttggaagcatacgaaagcaaatgtacattaaaagtttcacaaaacaacattctaacccatgagtgggaatattgccttttttgtaaggctgcttaccattttttaaagccgctagcaaagcaaatgtgcaggcatccaaaatgtttccatcgtagtcgaggcaaatgagatcacagtatagaacccagacaagctaaaatagaattaaacacaaaaggaaattaaagtcttctaatgggtagaacatgctattcgcttagacttaagaaccacagaacccttggttaaacaagcaagataactttcaaggctcaaaaaccttaagaaaatgcttcacctttttaaagttctatagaaaaccagaagaaagtggacaggttttgtgaaagctggcttttgattgccaggctgacaaatgacaaacatgtccatttcccttaatggagctacagatgtagaaggaatttccattctcattgggaggttacagataagggagatggttttgaaagccctagctaaaattcaaaatgcactttctcataatacatgaaatgtttaagttttacagtgctaatgtatcagtttatatgatctagtaggaaagcctctctaggttctaatcaacctagttttacattttcaaatagactttggaatctactgtgtggattcaccataaacatatgttaacatgattaatgttataatctgctataaggaataaaaaatgattgaactttaaaagttaagggggaaaaaaattacttcagtttaaaaggtagctcccagacaggcagtaagttagtcaaacttgtttttttataaacaatatggttcatttagagaattatagagtaagaaattactgaatctctaaaatctgtaagacatccatatttaaagctactttgattggtggttttaatttccttgttcactttcccccacaaaaaaaaaatcccttcagaattaataagaacttatagcttctctattcctcttacctttcctggagaaatgcataagtcctctttctgaattatctgtgaacttgatttaatgacaaagagcaaagtaaatgaaaagcccaaaactatctgaaaatgaattgtaataaaattttatcatggtgctcttacttttcaatgacatctgcaatgaactggctagccacttgggcctcttctccaggaggtccagaccggaatctcgatgaacacaggggtggtagatccacattaggaactgaaagaaacactctgcagctatgaactaaacctttttttttttttttttttttttgagatggagtcttgctctgttgccaggctggagtgcattggtgcgatctcagcttactgcaacctctacctcccaggttcaagagatttccttgcctcagcctcccaagtagctgagattacaggcacacgccaccacgcccggctaattttttgtattttagtagacagggttttaccatattggccaagatggtctcgatcgcctgacctcgtgatccgcccgcctcagcctcgcaaagtgctgaggttacaggtgtgagccaccatgcccggcctaaacttttcaatttatggattactgaagtgttaaaggtattatcaatccacagtaaaggcaactgtggccatggacaggctcttctgagtagaatacattgtaacattatagttatattctgtttggtctctctaagactcccagccatgaaatttctatttttctgacatttttcccccatatgcctttttaaaaaatctattttagacctcaattctaaatcctttacgagttttcctggtatctttcaaaatacctcaatctgtaactgaagtatatatagcccctctgctaacatccaactgtttttctcatttaaaaaaaatgttggttcctaccataaagaacagatggttccaaggcaagaaaaaaatagcagttgtataaagcaaagaatctttatggaaacaaaaggtgtgcaatgacagttctttgactaaaaaaaattccattctattttttttttcttttgaaacagggtttcactctgtcactcaggcttgaatgcagtgacacaattatagttcattgtagcctcaacctcccaggctcaagcaatcctcctgcttcagcctcccaagtagctgggacacaggtgtgcactggcacacccagctaacttgattttttttgtagatacggggtctcctttgtttcccaggctggtcttgaactgctgggctgaagcgatcctgctgtcttggcctcccaaaatcctggtattataggtgtgagtcaccacacccagccaaaattctattttcttggttagtaacttatgaatgtataaacaaaaattgagcaaacaagtttgataaaggttaaatttatgaaattctatatcctgctattatgctatcttttactaacacacggaaaacttttgaggaatttgttttattcataaatatttccgaatattaggaataattttctttacatcaacttaactaggacttaactaaaaattattaaatgtgttaaaagtatttgtattaaaattacaaaaccatttaacttaccaacgtatcctttatcaggggcatctgttgatggtgctgcaaattcctatagtagcaaagaaatgtttcctattgaaagaagctactgaaaaattatgaagacaatttagcaatcagttatggaaggctctatcaaatatcagcttagggaattgtgtcagggcctctacggacattggtgctgatcctcacaatagctctacaagataagaaggcactacagtacagtggactacactacagtgctgctcggcaagattacctggagatcttttaaaaaatagtaactgggtttgtgcccccaactactagccaagaatcttaatttgttctccagatgatagagcaagatttaggaactgctgctttagtggtaaagagcaaaagctcagctgggcgcggtggctcacaccggtaatcccagcactttgggacacagaggcgggcggatcacctgaggtcaggagtttgagaccagcctggccaagatggcaaaaccccgtctctactaaaaatacaaaaattagccaggcatggtggcgggcgcctgtaatcccagctacttgggaggccgaggcaggagaatcacttcaacccaggagacggaagttgcagtgagctgacatcgtgccactgcactccagcctgggcgacagagcaagactccgtctcaaaaaaaaaaaaaaaagcaaatgctctgcaattactaagccagttcaaatgtcagagccatacttactggctgagagacttcaggcaagttatttaacctcttaccttaaactcctcatcttgtcaaatgggaagaaaatagtgtctactcctagggactgttaataagggccaaatgagatagacctgttaaatcccaggcataaaacctgacaaggagcaagttctcaaatcttactgttatacatcactccaggtttacgaaagaagaatctcaactgaggttaaataacacagggtagactgtagtcaaagaagcacaggctttggagtcagatttatgtctaagttttacttatgagtcttatgtacctggacaggttactgaaagtcatctgtaaaacaggaggtgaagacaagtaacaaatgattgttataggcattaaagtggataattctgtaaagcacctaaaaaggtgtctggaacatagcaagtactcagtaaatggtagccagtattccctcaaatttttcttttcaacaatttcaattttctacacatttacacagattacatgtcatcactggctaaaaggatgtcaccaaaaatctgttaatgtctcaaatgatataacaatttttttaaaatggtgactcagattttaaaagttgtttcattttgctacatttgacaattgttcacttagtcattaaacttgggtcatattatctaacactcatagtgaaagctcttgggaaattaaacattaaaaattgacacccaactaccaaatcaagagtagaattacaggtgtatattacaatctaataaataaagctaactttgtaactcaaatctcaataggacatatttagacttactgctttaactccacagattactgtagtatttcccaacttcactaaagcagaaccatctgcggtactaattgaacctgaaaagataagcaaaatgaaaggttcataaaaggaaaacagctacaaaattatccacataataattaaaattaagtgttttagtttgctgtgtacgattatcttgctacccctctcagttgcttatgaatatttcaagttagaataattgatttttacataactattttaaattagtgtttaaataattattcacctgtccttgaatttgtgttaatcatttttcatttagttacagggcttttgtacggataaaaatctcttgacaaaaaaaatcatcaaatcctttagacaaagaatttgggtgaaaaactgtttggctggttcatagactaaaacttgggaatatcatacagttgaaagtggaaaatacatccttaccgatgttgacagttgtggttctgaattcaccaagttctcttccatcaggacggcagttctctttctaaataaatatgtttatataaaaatagattatacctattacatattttacacatctatcacaagttttacacacacattaaatgttacttcaaatggattaatttaaattacttgaaattcatctttaaaagcagctcgttatcaaaacgcataacatgtacataacctttactcaccagaaatctcctgtaatactccagaggttccacggttctgaaacacgtgttaaaaatatatctgagataaactgatgaatcttaacataaatccagaaattggcaaagatcttaagtgtggtgatgcagcataaatctccacaactttttaactaaaagtaattctagaaagtaaaaatccttgtagtagcaatcacattcaattgctgtccttaactctgccataaacgattagaagattggcgtctaaaagccctttgagtgagctctttaaaagctcaatctgtgtcaaaagaatcatgtcgttcttgctctgaaacaaggattcagagtgatctagtgatcatgaaaaaagattattttaataatctagtgatcatgaatagttaacctcttactagataactcaggaaacaaaaaggtacatctttattttcactgtaagtgaaatttagcatattcttcaattatgactgtaagcaataagccatagtaacattagcagtacctgcaactttaacaaccacggagaccacagatgttttcgtttgcaccctttagctgtgtaaggtatgttcaggctcaccgttactttgaaatcccaggagttactactagtctcgccactagatcttgtttacgaaggttaattttaaaccaagtatatatactactatatcgtgtcttcggagtttatactcatagataactatttcaacataatggatttcctttggaatcctatttattttatccattttttaaaaactttaagaaagtccactggcttcacacacacaaaaaccttccaaacgaggcatgatccttttagaaataaattacgggagagggagaagcaggcggtatgtggttctgatgcaacaatcttgattgattgattctgacagagtctcactctgtcgcccaggctggagtgcagtggcgcgatctcggctcactacaacctctgcctcccgggttcaagcgattctcctgcctcagcctcctgagtagctgggactacaggcgcccgccaccacgcccggctaatttttatatttttattagagacagtgtttcaccatgtacaccaggctggtctcgaactcctgacgtcaggtgatccgcccgcctcgtcctccaaagtgctgggattacaggcgtgaaccgccgcgcccggccacaatctttaaaagattacaactatgtctcctgggactgcacgttcactacacaccacgctcacgagcgctcgcagcgggtatggaactctacagagtcctttcatctcccgtctcactgaggaagaagccctttcttttcactgtgacaacctccaggtcctcccgcccatcgtctgcctcgacgaggaaggaaatggcaccccaacggggtcggcctccaggtgagagaatcccagctaagagttaaaggaagctgccgtccgccagggtacagaactctacccgccacccgccaacactcacttgaacccagccgccatcttcccgcccgcgcgtctgcgcctgcgccgctcctctcctgcgcgcctgttccgccgccgcactttcgacacggatgccggggccgctcacgccacgggaaatgccaaggtggggacgcgacgaaaggtccctggcccgccctcgcatcgactttcccctgcccagacgcctttctaggtttccttgccttggacgtattttgacgaatctgctgttaaagaaggagcgggtctccctctttataaaagagctggtgctgtgactcagaataacaccaacagttcggagataacagggtttctagcgcagaatcaagcagtgcgtgtggagcgttattccaatgtttctgcgtcttttttctgcctgtgacttaggctcagccctggccttgcctcttcactggtcaagggctccgtgctccaacacatgagaaacctgaactttttttttttttttttttgagacagagtctcgctctgtcgtccaggctggagtgcagtggcgcgatctcggctcactgcaagctccgcctcccgggttcacgccattctcctgcctcagcctcccgagtagctggaactacagacgcccgccaccgcgccccgctaattttttgtatttttagtacagacggggtttcaccgtgttagccaggatggtctcgatctcctgaccttgtgatccgcccgcctcgtcctcccaaagtgctgggattacaggcgtgagccacggcgctcggccgagaaacctgaactttctgtgcgctcattgtccgcaccacgttctgctctgcaggtcccggagctgagggctcctaagcatcaccttgtgttgtagactgtgtcgtgctcaaggctgccatctccctcctaggtggggttaccagataaaatacaggataccacgttaaatttgaatgtctgataaacacagcgtggtttttttgttttttgtttttgtttttttgtgggtttttttttttttaaagcatgagtatgccccaaatagagcatgcaattagttgttgccagaacctggagggagctgggaaggctttacagatagatagtggtgatggttgcacagtatgtatgtaattaatgccactcactattgtaaacttaaaatgattaaaatggcaactttttattttaccacagtttataaaaactaatgtaataaaccagaaacctgtaactggatgagtcgtatggtatgtggctatcttaataaggctgttaaaaacatgattagttttttaatctgaaattcaaattaagtagacgtcttgcatacttgataaacctggcgccccg

SEQ ID NO: 611 - DNA, 2606 bp, Homo sapiens
gtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagg

SEQ ID NO: 612 - protein, 733 aa, Homo sapiens
MQQALELALDRAEYVIESARQRPPKRKYLSSGRKSVFQKLYDLYIEECEKEPEVKQKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPVKK

SEQ ID NO: 613 - DNA, 41434 bp, Mus musculus
  misc_feature (1)...(41434): n = A,T,C or G
gaggtgtcaaaagcccctgccaggctcaacctctgtctctgccccacccctcattggcctgtggatcaggatgtacctctcagctactgatccagcgcagtgtgccaacgtactccctgccacaatgataaaggactaaatctctgaagctataagcaagccccaattaaatacaaaactttcttttataagagttgctgtggtcatggtgcctcctcacagcaatagaacaatgattaagataacttctgttgacatgtgtgatgtaaatataatatcttaatgcatggatggctcttgtcatggataggaagatagtttctggtctctcatcttagacatctttcttttcttgtatataggtatacacaaaagactttggggtaacaggaaagcgacaagtacagatgtggggtccaactaacactggcaaggagagacatggggacagtgtgtttgccatgaggtgagaccgaagctgagtcttgcagaagtgggaaaacagacccaggctggattctgggggtagaggtcactggtctaaagcagctgtgtttctgagttgtcttgttggcaacactaacagtgataagagataagtaacattttatgcagcagaaatgaggaggctcttgtaaaagcactacctatgggatgctggctagtcttcaggcaggcctgtgaggtgggtgctgctgtgaagatgaggcagtgtgctcacacagctcgtgcctggcatctgggagtccaacacacttaatctggctcataactaataattcatactacttaaagagacagatgaaaataaaaactgtctgcaagaggggctaggaggctaagggatgcacacctgtaatcatagcccttaggagacggtagctggagaaccttgagttccaagccagccaagagtgagaccctgtctttaaaacaaaacaaaacaaaacaaaacaaaacaaaacaaaaccagagatggtgggaggagaagtagagtgtgagaggaggagggtggggaaagagaggaggaagaggaagtagaagaagaaaagaagaagaggaaaaagaggaggggagtgagaagtaggaggagaaaaaggagaaggaggaagaagaggaggaggaggaagaagagaagggggaggaagagaaggagttcacagaatctgagatgcacagtgtacatggaagtcaagtactgaataaagccacggtttttaggacaaagaccaaacttcctcttctttttgagatgaagtcttgatacacagcacaaaactcactatgaaactcaggctgccattaaactctctaccctcttgccttgacctctgtattgctgggataataaacatgcactgccatgccttgcttgaagacttaacttctagcccccatgcccttcctggtcaggatccaaaatgcacatctacctctattttaaccccttctaatctccatctctgtctagtgtttcctactgcttctggagctacatcatgtactcctgaacacccctccaccatgctgagatctgaaaaaaaacaaaaaaacaaaacaaaccagccctgtctatcctcagccaagccaatccaaaacaatagaggaccttaagagccatccagtgtccccaaggggctgcctggccacagggatggactcactgaccatttcctcatgagagactattacccaccagcagaggatccagataagcagttcccagaagtgcccagacccacccatcctttgcagcatccaaagaggagagttctgtttagaatggggaatgttccagaatcagctacgcttctctgatcccaaaggtattggatttcttccacctttcaggcactataattctaaacctcctgactctcaggaagatgccacagtagttaaagggacaagcctgggtctgtggctgtaagtatgtcattcaacttctctgagtgtcaggttcaataatgaagatagtcatagtttagtggtggaactgcatggcacaatgcagtaaaatactcagcacacagtacttagcaaagtacttagcaaacagagccctctataaaagtttattattagtagttataaagaaagaaaagaagaatctgtggggaaagctagaaaatgcttagaaatgtatagaaaaagaaacaaattaaggttacaggctcaaattattctggggtataaagaaaattttatgtttctggttggtctggaactcatgcaatcctcctgcctcggcctctggagtgctgggtttataagcataagctactatgccttgcctgctctttgcagatatataacaacaaatacttttctctttatcttcaaagacgtagctaacaattaatagttctatgtgacacagaaatgagaaaggtgaagactccagactgccaggttcagtggcctaagatcataatgagagagctatatttagttaagagctgactgtgaaaaatgggttctatgaaggccacaaggtgaccagggctgtgctggagtctggacatataatgctttgagtgtgaggggagggggattttatttattttttccttgtatatttgattggtctgtgtcaaacctttctatttaagataagataatccaccccataactaggtaaccaccaaagaggaagaaaagaatatgaaagtttacaagagatgtaccattattagagttctttggttttgttttgttgaattttcaagatagggtttctctgtgtatccccaactatactcaaacttgctctggagaccaagctggccttgaactcacagagattcgactgcctctgcctcccaaatgctgagatcgaaggcgtgcaccagcagtgcccagctagttattttattttaaagaagcgactttgtgaagtctgtcctctgggaagaagcagagttttgggggcaggttcaggaacaactgcctctggctttcttcccctgactaatggttgctcagctgcccgtttagtcagagtccgctagagcctgtgtcctctgcacactacgccatccccagagttggcagttccttcagccacacacagctaagatctcacatggagcccacatttgagaaccggtgaccactccgaaccacgcctggaaatgaggaagcttgccagtctcctccgtgctgtgagtttgctccttttgaggctcagcaaatgccatgtgtccctgggccagaattcaagtctgattcatcttggtgcgctcagagcttggcgtgggatctggtgcccagaggtagctaagtaaataagccagctaacctcaggccaacttaagacagcgccttatcacgcaccccttcctaagagccccgagtgtgcatctcttctctctcctttttgggattgttttttgtttttctccctagcagcttctctttctctttgggtttgttcggaaagagaaaccttagaaaaggacttcttttagggcaagagggtgttttgtaaaaccttctatttaaattcgtataaaagataataaaatggcgaatataaccatttattttgttaaaaggtggaagaagcatttttaaagggtaacctacaaggaaaaacagcttctcaggaaacaggtgcggaaatgtgtacgtgtatgtgcgccagaatgttcacctataaccttacttagcacagggaacttcttaaccagcatcgaaaaggccttcagagatgtttaagaccccaggctaaggagcaaagctaaagcgaccgtgtccggcaacttctaggggaaaaaaaatgtcagggggcctcgtttccagagtcacctcacaggggaagatgcgccaccaggagactcgcatccgcctgagcggaagctcagttctatgtacagtatagacagacattagccggagaggccacttaaacacagccctgggtccacaccctgtcactccaggctttgctaggcagccccaggacaaggttacaacaccaccacattttttcttatttttaaaacacccactgtgctacaaacatctgacaggcgaatatcttcagcacggggacgtgggagggggtagttctcattgtcccaagttctcagcgttttcctcacctcttccctcccagggtccctgctcaagcctctagagcaaaaagagaaagaaaggggacctcagagagctgtggcctcgccctgagaacaagtttccactgggtgggccacttcccgagacccttccctgaggcaggcgctccgtgtggacctagtcttgcatttcgcgatcttgtcctcgtggtccctacgtcctgaccctggacaggtgctccaggcagaagaccccacttacccaacaaccgaaatcatcatggcagccaccaccaggtagttggtctggtaatagagcagattgctcactacacggttgttccatttggaaatgtccctgaagtccggccgggcgaaacgatcagagcccgggaagaaatcgtcccaggcacggagcggggcgaggttcacgtccatgttcctctgcttcgcgagcttcgccttcggaatctggaggcggcggcagcgacaaccagctggatgaaagatgacagcgggtccttcggattggttctgcggttaaagcacggcagggctcagaaaattggctgcgggcgggtgtgttggtctgtctgtgattggctggaagtggttagtgactcagagcagtgggctttatccaatgttaggacaaaaagtaactagcggaaatcccctacctaaactaaaggtggtgtcagttctctctggcagtttaaatacaaaccatctctttttaaacacatcgcttgtgtgtgttctttgccctgaagggagaaaaaaaaaaaaaaaaaaaaaaaaaaaaaaaaaaaaagcagctgttcagctgtcaatataagtggaatggaatggaagccggcctcagtgtcactgaagtccggtattgctaatctccccacatatgcgtgcaattttcatgagtcactttgtgtgaaatcacactagaaaaaaaaaaatgggagcaagggtttgactgaagtgaactgaaataaagtgattgccagctcgcctttttcttcgcccttcatttctgctgtcctgtggcaaaattactgaaccgttgtgccatcgttatagatagaagatagatagaagcggatgacttcacttcttcctgagcgagctcttagcagcttcaaagcagacagctgctggaggtgctctgtgttcctgggcagaaacatggcttcccaggctagaaaggtttcttagttttattccaatattaaacaaataacatttacctaagaaaacaacttctacaagaccaccaagctacacaaccataacacatacacagagaacctagcacagacacacgtaggccctgtgctagccgcttcagtttctgtgagcgcctatgagccctgcttagttgatgctgtgggttgttttcttgtggtgtccaggatccccctgactcctaggcttctaagatggcagtgcctaaggtaacagtgtttctaaatttgcaactgttaatttttaaccaaactcaaagtgctctactaagaccaccaacttaccctaaaacaaagagtagtaaaatatacttgaggcgaagtcagacttagttgtttagctgattagaaaggcagttgaggaaatcattgggggctttatgaaaatgtcttctgccactggtgtttaggatagcctggcaatggactccagcaatttactttggagaaaagtagttcctaaaaaatcaaaacaaaactaatttattgtgaatgaatgtcttgcctgcattgtgtatgtgctgtacccgcatgctttgtgcctgctgaggtcagaagagggtgccagagctcttggaactggagttacagatgattctaagctgccacgtgggaactgggacttgaatctgggtcctctgaaaggacagcaaatgctcttaacctctgagtcatctctccaggccagtggaggaatgtcttaacttcccccagccttccttgattcttaggtaaaccggggttagtagaaaatctgccacagaggctaaatgagggatgtttgggaagtgtttagtatatgcagcatttacagattttactgttatcagtaataatacaaactggcatggtgaggcagacctattccggagaccaagacaggagaattttaagttcagggcttgtagggattacaaagtgagttcaaggccagccggagcaagttggtaagattgtggctcaacataaaaagcgagaagagtgctagaaatagagttcagtgatcaaacttgcctagcatggagcagcattggtcctgtgtgcagaccccattattacaaaaacaaacaaacaaacaaacaaacaaacaaaccaaatagctagcagagtccttaatttttctggttgatgtttacagtgttttaacctgttttctatacttttaaaataaacacctgctgctgttgatctcaggtcctgttgtcattgatcattgtggttgcctctgaatagataaaatgggagaaaaatgttgagactgcttagtaccctgctagcaggtattctaaggccttcctaatgctggtaaggcacagtggggagtcacaaaggggaaatgcttgccttgctctgtcttctaagggcctacagtgcaggaaatactcaactctgagaccttgaggtgagtgctaaatagagccttgccaggcctctattcagttacaggaaatcagagggcgtggaggaattcccgaagcttaaggcatcagtgtgggtaaataagccttggtggggagagaacacagagcccagcgcctgttagagaaatctgtgagcattgacaacttcagtgaactttctccttccaacttctcagaactgcaggaataaaggctgtcagaatgaaatagtagcgtgcttattcctccatcacaggcaatccatactcaacacacattagctggctatatatttttatttatttgattaaacctccaaagacagcgcaacacagcggtgcaagcaagtttctatcccccagctccttggcagatagaggcaggaggattgcaaattcagaactgtttggataacttagtgagactctgtttcaaaacaaaaagaaaatgggtatggatatagctccagggtaggtttttttctagtatgcaccgagctgtaggttcatccctcattactacaaataaaaagggagaagaatccaaagaggactgtgtttgtcattgttttgttttgttttctcttcataggttgagccccttccctctctctgaaaatggtgagtgtgctctgtctctggttggactatggtaggtttctgtttgatcagttttatttgttgttgttttttttttttttttccctctacattcctctaccttttcctccaactattttaaatgggaatgagcacagattgagtcaactttaccccaggctccgtttaagagctattactagtagctatgtcactatttttaggtgggggagggggagtaggagtaaagatgttcactgcatcagtctctcacaccagatggctcagtggctcagagtgcttgctgctcttccagaggaccagaggtcaattcccagcacccacatcacatggctcagaactacctgtaactccagctccaagaggactgacacttttttttttctggcttctgtgggaacacacacacacacacacacacacacacacacacataaataaacttttttttttttaaatcagtctcttgaggcttttccacaggaacttaagctttagcaagcaccatcctgataactcctcggcctggccatagactatggaggatgtctgtctaatacttgatgtctaatacttgatgatgtgattcactgtaaagaaaataaatctactgaggatttcggccacttgccactactactgtcattattaacaaaaggaggtggctctttctaatcagttaggcagatctcacgatgtctgctgtcagctgtcaaagtggtgagtcatggtgacacacagatgcaggactgacatctttgtgaacttcttttgggtgtgttgtctgcatgtacatttgcaccacttgtgtgctgggtgccagcgagttgaaggccactgtgtgggtgctgggaattaaacctgggttccctgcaggctttcttcctcttcttcttcttcttcttcttcttcttcttcttcttcttcttcttcttcttcttcttcttcttcttctccttcttctgctatttttgttctatttctaaggctcagtttcctcttctcactgtctggttatgactgaatttttagctcaatgtgtgctattgatgaaagtagctgggggatcgtaacagatgagccttccttaaggttcaatgagagcaggacaaagtagattgcatgcctcaagtgagtagtagcagccccccccgtccccctttaatgagcaccctagaagctatatcagggcacttcactggttttcaaacagtgtgtccacaaaccacctcttgtgataaaactcaaacctggcatttgtaaccttcaagtaattccaatcaaaaaccatatttgagagccacttaaaaattcacttaattttcaatcttaaaatcgtgaatgttgttattctcattttacaaatgaggatctggaaatacccaagggctcacagttaatagctgagtagtaagggtttaaattcagttcagacttacatattaaatttttttatctcactttactaaaagtgatatgtttaacacaattattctttcctttcttgtctaccagaatcagtcatttacatacaatatatgactgtgaagaatagagtcaaaaattcattcatttattaacactttcaagtgacaggttataaataaatctctatacttttcatacctaatcatctatcttatctatcattcatttatttatctaatatatatcttgatgtatatatgtataacagattagttttctgacagactggtgtgacactgaagtgtcacaaagaaaataagactcttcaccctatgtctatttaatgctttaaacttcatgcccataaaagcaagggttttgaatcttcctgatatatggaaaacggaaatttctttcaccaattttcccggagaaaagcactggcatattggggtggctattttagtttttaaatagaatatatgaacattttatgcaattatgtgtcaacgtataagtgtataaataagtaacatatctaagttcatgtggcatagcaacattatagatggtataatattaagtaggcacaattaatcaaagattttaaatacactgggaaatgcttgcaaagcctaaggggacctaagcagcctatttagccactgcttcccgctgttcaactagctttcccagacgctcccgcccctccctctcgtcccctgaagccgcgcctctagtactggctccgccttcgctcctccttctaatagcccagtctcaaagcactggaccccgcccctccgcgcctgctcagtttttccctcctaaagcctcggtccccaaaccccagctccgcctctccgtttgaagccccgccccgccgcgccccctcactttcttacctgaagctcctcccctcctccctggctcggctctccctccttccattcacctgcagtcccgcccctcccgggcggacccgctcggcgcgagggcctctgggaagaggcggggaacaatatggcggatggcgaggagccgtaagtatcgggattttgccggagcgccgagttgggctgggttgtgagagagcgcggcggtgggcagtcaccgctgccagccgggggtcccccaaccccttccccgtcccctcgccccccatacccttgcggcgccctctttggagcttgatgctgacccttcttttattctctctttcttttagggagaagaaaagaaggagaatagaggagctgctggctgagaagttagtgctgctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggggaccagccgcagcgggcccgagggtgctgggagggggtcacctggagcaggccgcgcgtcctcacccctgaccccgtccccagctcgagccaccggccggctgctccctggctatgctcctgcaaaagccacccggtactcccctcttcctccaacccaaattgtcagagctgtgaccttgtggcaagtgaatccaatctaaatctaaatggacacgaggcctgttttgggtccttgatgaacactgagacaatagtacacataaactttttatgaacactccgtgaatcaggaattgtgttaaaacttgtcatttttgcaaggtaattgggtcttaaaggacacggcaactcacttgctctctcatttaccacacaacctgtattaaatacttagttttttttgatgccgcagactttaaaattcttttcatatggccaatcctacgtgattcctctccccgccctccgtgggaagggggaaaaaatactcgtgtattgggtgtggtgattcataatttctgtgtcagctctcagtagtactttggtcttttccatgcccctccctatgggtgaatttcaaatgcaagggctcaccctttctcaccgcttaattcccaactcagcacgaaataacaaagtttgagcgcttgctgtctgccaagagcagcccctaagttcaatacctgatgatctctttacctcatgaccatcagaagtagttgcagtctacagctgaagtttctgacagttaaggaatcttctcaaagctagagtgtgcttggttatggcgtgagacccagcattgcatcagaacatcagctatgcaatgtatgttagtcccttttgtaaacaattgaaatcactaatatatttgaaggtagaaactttggggttacaggaaagttatcacaaccaaacatgaatgaatctgtggttataaagtgcatttgagtgttttgttttgttttttagagaagtcccactttattagttgcatgttctcaaagatttcttgatggtaaataaatgcctatctgtggcataattgtaatctaaacatttttcttgtgtgtgtgttttgtgacaacaaatggaccttagtattaggagaggtttgtttgttttttatttttagtttttaaaggaaaaaaaaatactgggatccttctgaggaaagaaatgtatgatcattgctttcatccaaagtgttcagtggctctcatctttccaacttgggaggagccataactagtgttagactgaagcaccatagttctcagagacccccctcaacctatgcacttgttacttctactgaaggaacaaacggttgatggaaactcagagtgactgtaaataccaaacagagggaagtcctttctcacttagtgtttagtgttgcgactttgatctgtgggtgccgaggaagctaggaacacagaggcagaattattttatcaagtaggtgaagagtgcttccccataccagacaagccaaaactgggaaaatagaaccacaactcagttttcctttttatttgagcaggtctgatgtgtggttaccatttggggagacctaatagttcgggcgtggctttttcgtactgatctttgcagctgaatttactgtgttctgtgcagaatggctgttgatggtgggtgtggggacactggagactgggaaggtcgctggaaccatgtaaagaagttcctcgagcggtctggacccttcacacaccccgatttcgaaccaagcactgaagtgagaaacatttgtttttaaacaactgctctaatagtcttacatttaaaaaataagacgatgcttcctattaaacttgctattataatatagataattaatgaagttgttttgtgaaattaatctaattgagttggatctttacaactgattttatgtaaatgcctagaaatgcatttttatatttttcatataagtttaaacattttcaagtgtaggataagttgatgacatcatattctggtatgtttaaaattctagtttagaatgattcctaagacatatttccctgtttgtagccctgaagtggtaaatcatttctaataagactataagatacgcttactcaggtattcaaatttagttgaaatcttcacttagtattgactataattaattgaatgttaaaaatatgcttgcaatagaatagatacatattttgaactgcgtctgacttgaagcaaatatttgattagatagaattttttattacaaagtaatcactgtaatgtgttttatggccttttgtgcccatgaagaggttttgaaagagaaacgctactcatagagttgtgtaaacgctcgagtttggtttagtagcttgtgcgaataaatcgttttccttctttagtggtcagcacaatgcatagtagtaattcttcctttggataatatagttatgcatattattttcttgtactttgatagtgtttctgcacagtagcatagggctgtcacttctgttcggcagtgtgtccaggttttatctctgctcatctggaacttgctgatttttcaagtcttgtaaacactcattgttcaaagaaaggaacatgtgattgctcttatctagtttttgttagactttcaaacacttttaaattttcacaaagaaaaagcataaagaatgggaggaggaaaatagagaatactatagtaaagttgctatattacctataaaatagtataccaacacttgaaaaaagatataactagggatcgtttttaagaagtttttaatttatttttattttacgagtgttttgccttcatgtctgcatgtataccgcacgtgccaaatgcccacaaaggtcagaagagggtgtccttttctctggagcttggggtgtggatggttgtgagccaccatgtgtatgctgggaatcaaacctgggtcctctacaggagcaacaagtgccttatctgctgactcatcctaatggtggttttcctgttaaaaacaggctcttaatttcatatagtaaaagtaaatttaaagtgtcaaagttgaaactctgaaattataaggatttcaatatttgtaattacatctctttcataacatgccaggtgtgtttcttatcgttaattgacctcttttgtgcctacaccaacaactattgtgtggtttgttgccttattcatggttcttgtggtgatcacctggattttaatatgtctttctatttgttacagtcactccagttcttgttagatacatgtaaagttctagtcattggagctggtggcttaggatgtgagcttctgaaaaatctggtaatatatatgtataatactattctcttagagataagtaagttcttttgctttctgtcgtataaagaatgtcttcatttcatgatttttttctcttgaacatttattaggtaaatttagctggtaaaattctagacaataaagtatgtaatattatttgggaactctaaaagttttaagtcatatttttctttgctttttttttgcttccttttgcctagtgctaatattctattgaactaaatagcagaatagagagtttatcttttaatgtgtaattttaaataattatttttttcttttgcttctctaaataacccagctaggtgggttttagatcattttatccaaaatgacacattgaggtgcagcaaaaatcaaagcctccctcgtttttcctgacgtatagtgaggttcctgactctgatccaagtcctcacttattatatacagtgctcttttttacagaagctctgcatgaactaagatggtggtttttgatgaccaaatgataataaatgcctatgttttgggacacctgagcctttagtaaaactatttctgtatactatttagaaacacatagttgtgatgtaattgctttcattgggtccttataaccatgaaatagctttgcataagtttctgtcaatttaacagagttaggaaggggcgagttagtgcagagcttctgtgtccctggttactcactgggtagaaagcagaaaataacaagcagatcatagccatgtggaagacacctgtggcctgccacgagttaaatgtatttacatcaaggtttagttttactttatgtgtatgagtgttttgcctgcctatatgtgtaccgcatgggtgcctgcttctcggggaggctagaagaggctgtcagactgaaactggccttacagagacttgtgagctgccacatcacatgggttctgagaactaaacccaggtcctctgtaggagcagtaaatgttctttactgctgagccatctcttcaatctggcaattaagatttaggtatcaacacagtcatactgatttgctaggaaacagtagggttgctcctactgaggttttaaagtgaaatacactgactctgtttagtgctatgttaattctatgggaattgtaaatcactgtggtctctgtctgcagtgaattttaagtttggggagacaagtctttttgtctttttttttttcccaaagacttattatatctaagtacactgtagctgtcttagacacaccagaagagggcgtcagacctcattacagatggttgtgagccaccatgtggctgctggaagagcagtcagtgctcttaactgctgagccgtctctccagcccctggggagacaagtcttaatgaaatcaatagtagtatgtatggaacgtggtgttccaaaatgacagccccctctcagactcactctagtgtgaaaaattaaaatttgccaaagggaaaggtttgtggcgtttgaacattgttttttgttgttagtttttttccattaggcatgtacaggtccctcaaagcttaactttttcattttgaagccatgatttactatcgcagtgtgccctacaatataagtacactcagattagatctgagaattatttattacaccagtggttctcaaccttctaatgctgcagccccgtaatacagttcctcatattgtgatgaccccaagaataaaaatattttcatgactactttataactgtaaaattgctgtgcctaagaatggcagtgtaaatatctgatttgtaaggtggtcttggggacctctgtgaaagagtcatgacccacatgttgagaattagtgtactacattctgatcctttaggcacatacacagaatgtaggcctttcactttctcatttattattttgcttgttttagatgtaaccatagaagacatgcttttttccccacttcccattcactgtctgtaagccccttaaaggctcactcttaaaaaaagaagaaactatcactttagtatcatcagttaaccaaatgtttattgagtttcttcttgtaaatgacatgcacaattttggtgataaagactcaaaatggaacaatattaacaggtgtttatttatggaactcagattttctttgggggggggggcgggggggaggagagaagggaggtatatggaacgtcggtggtaataaatggatgaggaaaggaaggcctgagggcagcagcctggtggtaaggacagtgttttcataaggggtgaacagtgtcctagaagaacattgggaaggaaaggctctaggcagaggggtcagcagatacaaagcagtagagattgtgagtcttctcttggttggttagagaggacttaaacctgagtgcttgtgcatttttgttctttaacaaaattcttgaatttttttatgccttgcatatacttttttttttaagccaaagattacaattatgtagaatttattactgaaaatatatggatttaggacatagattttcaaaatctatgttatgttttaaaggaaaggaaactgttgcctaattagattgcttttcttttcacaggcattatctggttttagacagattcatgttatagacatggacactatagatgtttccaatttaaatagacagtttttatttaggtaagtttgatattttaaaaattctgataaagatttgaatttgtgttctttgcaatttattaattacagagggtctaacatggactttacaaaaacaagctgctttttttttttttttaatgttcattggtgttttgtctgcatttatttatgtctctgtgagagtgctagaaaccctgttacagacaggtgtaagttgaagagcagtcatttcttttaactgctgagccatctctccagccccatgaagtgatacttatactttagaaattggaatacatatttgggtgttctggcgatggctgttttataagcacatatatccattttgtgtgccttatcctttctgacaagtttttaatgtgttatagctttgaaatagactgatgattggttattgataacaagcttcaccttttaatttataactaacatggttataataatgtaagtataatgatacttacaggggtaacaaacacgggcatgttgccagaagggtgacttgccattttatttatgacagtgtcttagttgcagcagtcgggtctcctgatcctgtaaattcacctaacagtcttcacttaaaccatgctgggagttcttttgtgtgagactcataaaagcacaaaactacatttagacgaatgttggtacttcactgtttcctcttccatatgtgaagcgctgtcagtgcagagtgcttgaaagtgggaatcaaatcaaggtttctatttcatagtacttttccatgcaagtaaggatgaaggatgaaagtcttagccactttaagtagagaaagaattagttctttataggtgaagagaaaaattgacttgatgaaatgtttcctttgaagttctaattttaagtaaaaattttatatgttatgtttttacttaaaaaaatatatactgtcctgtctgaaggatacaaagaataagggtacactgtctagagtatgtgtgtcccaggaagttacagtgaagcacttactcttttttttttgtagccctggctgtcctggaactcactctatagaccaggctggcctcaaactcagaaatctgcctgcctctgcttcccgagtgctgggattaaaggcgtgcaccaccacacccggcagcacttacccttatatgtgaaaggtgactcatatccatgagaattgtgaggagatagtagaaaatattcacatgcttgaagagacactttgtgtccttctgtacttattgtctggttattatcaaagagagatgtttcctgatgttacttttagattcttgaaaatattgctgtctttaaaatttattctctcttttaaaatattggtaaggaagctgtgggctaatctcagcgtgaaggaagctgagacaggaggatcggatgagcttgggctatgacctatctcaaaacaaacaaagcatgacaaatcctaccatggtttagggacctctgattcctactcaaatgacacacaaggatggaggtaacacttagaaggtctttcttctccagagtgaatttctgtatgtatattttactaggacaagcatataaacacagtgaagcaggcatggtggttcccaactataacaccaggatttgagaggctgaagcaggaggattgcttaaaattctagaggccgtgctgggctgtataataagctcaagaccaggctgatctgtagagtaagatcctgtctcaaacagcagattgatgttctgggattcaagctgtgtagttggaaggctctttgtataggatatttttatattaggaagtgtcctggttggaaataaccactaaacatgctgtcgttatgcttaacccaggaggatggagaccctcctgtttagagttcatattttcagttaagaaatacagttagacttgtcatatttatttagactgtcagcaagggtttagtaactatgtatttaatttattactgatataaaaatactgaggggctgatggagagttggctcttgagttaagagcacggattgttcttgcagaggattaaggttcaatgccaggtggtttacacctgcccataattctaactgaaaggagtctaatgactctggcctcctcaggcatcttcactcaaatgtacaaaccctgcacacacacacacacacacacacacacacacacacacacacacacaatcttaagagtaataaaaaagttgtagttaatattttttcaaagtatgttatagataaactgtccattctttcatttggaagctaattatgtagaccatttaaatggatattatagatgacaacttaatacaatgttttctctaggcctaaagatgtcggaagacccaaggctgaagttgctgcagaattcctaaatgacagagttcctaactgcaacgtggtaccgtatcctttcaaaagaaactcctccctgattataaaagatgcttagtagagagcacagctgacgaaaaggtctgtccgagggagcccctttctagtgaggaaatgctgatcatttgctttccagcccagccttccctttatggttttgctcatgtttttggcctgacttttaatttgtataggtgatgttgttatctgcatattttccagttttagtattaactaaatatctatgctagatgcatcttcacctacgccttatatcttggacaaaaatttactcacagtggatcacagatgtaatttgtaaagctgtaaaatgagaatagttcagatcatctttgggttctgaggctcgatggagagcacagagagcacattgaaatgaatagctgtggtcgggaaagactgtaacggggctaaaagaacaggctagacactggagagcacacttataaaagcagctgaggagaagccatctagagttcagttatttctgggtatctgtgggggattgtttcccaggccctttcaaggaatccagatctattgatcctcaagtctacatgcaaataggtagcatgccagagatggggctcattggtagttcacttgtctggcatgcccttggttcaacccacagtactgtaaaataaatacttaaaatgtatactgttttcacatttgtgctatccacatgtcttaggtagggttttactgctatgaacagataccatgaccaaggcaactcttacaaggacaacatttaattgggactggcttacaggtttagagttcagtccattatcatcaagacaggaacatgacagcatccaggcaggcatggtacaggagaagctgagagttctacatcttctgaaggctgatagcaaaatactgtctcccaggcagctaggatgagggtcttaaagccctggatgacagtaacacacctgctccaaaaaggccacacgtaatagtgccactccctgggctaagcatattcaaaccatcacaacacatctgtatatttatctatatctgatgtcttaaaatatcttttaattatttataatgcctattgtggttagatgctataaaaaatagttatcatactgtgttatttggggaatagtgaaaagacaaaatctgttaatactcatgactggcagtttttgttttgtcatatatttttgacccagggttggttgaatctatgcatggaacaccttcagatatggaagcttgagtgtttgttaaagaatttctaaaacttagcagaaaaacaacccatccatttaaaaagtggataaagggatagttcactggagacagatgacagaaatcttacaaatggtgtttgtcatccaggaagacagcagtgacccccactgttgaggaagtttaaggccagcctggacaacttgtggatccagtatcaaaataaaattaaaagcaccgggatgtagctcagttgtagagtacttgcctaacctgtatgggccctaattcaatccaatagcaagagaaaaagaaacttcaataagatgttacaaaccttttaaattaaaggagtagaagtagtatttagggtgagcagaaataacaggaaaatgtggctacttattagtgatagaaagtaaaataacgtaactatctggaaaatagtttgatcaatttaaaaaatctaagtatatatttaactttatcacctagttgattcactctgggacagtttagtgacattaaaacatgtgttctcagaaaatcagtacacagttgctcacagctccaaactggaaataaccaggacctgctttaggaggtggctgtgttcactcacctgtgccacagagtgctcccaagcagtaacagggacaacgtaacacgtgccgcctgccacgggctcatgggcatttgagaacatctccagcctcaagaggtcatatacacaggattccatctagatcctgtccttaaaacgaaatactttggaagttggaggacagattagaagtcaccaaagtataggtgtaagttgggagttggaatagttatagatgtacattgagagattttagccgcatgctgtggcacatggtttgagaattgctctaagttgaagatcagcctggtctccatattaggttccaggctactcaagttatatagtgagactctcaaaagaactggggcttgtaagatagtagttaaaggctcttcctgtcaagcatggtggcctgattccccagacctccatggtagaaggagagaatgattccccaaagttgtcttctgacttccaaagtataccatggcatatcccctccatagagaaatacaaaaaacaacggagggtggtgtgggaagtagtgtattgtgccagtgttggcagagggtgttgtgggtagttgtgtattatgccagtgttgactctgatgagttgatctagtgcacttctgtaaatggggagcgttcagagtacagcatctccgtaccgatttcacggcttttggtgaataatgttgatttgaagtaaatgtgcttaaaaatagaaatgcaggcctctttgtaaggacccagaattaaaagggaggatactcatgttccatccggccctgttgttgagacctggggaggttgttttacagatacccacccaagagagaatatcttgagctgcctcctagtctccctgttggggctcctccactgcttcctttgtttcattttcaacctagttctcagtgtgccttaggttgctggttgctgcattcaaagggaagagagttctaaatgggtgaggttagctaagagttgggttttttttttaaggccttaatttgtaggtaggagtctagataaacatattgtgtgtctctctttgtgctatagtgcattgttagagcatcatcatttgtattagttttctttactagaaaaattaagcatgttttgtacataacttgagcttttttgttttgtttttcaagacagggtttttctatgtagccctggctgtcctggaactcactatgtagaccaggctggcctcgaactcagaaatctgcctgcctctgcctccccagtgctgggattaaaggcatgcgccaccccgcctggctttttgcttttaagaaagagtctctctatgtagccctaactgttagaccaggctcccaagtgctgagattaaatgtgtgcagtacttacacttgtgactgattcattctcacataacagactggggagccacgtggcctgcaggtgcagggtgatgaccaaaagttgctgactgggtgaaaagggggcctacagctgatttttaccagaggttgaaaaaatgcataattcacattgaggctcagagtcttatgcaatcccaatacatccaattgtactagcaactgaaaaagctgttgaaattctctggattgtttctatataaggctatatatatacatatatatgtatatatatatatgtatatatataaaactctttgacctttttttggtatagtctgtttcttgctgtaaagaattcttttcatacagtatattttgaccatgttttttttcctctctcaactcccagatctttgctacttccctacccacccaattttgtattccttttctttcttcaaaaaagaaaccaaacccccaaaacaaatagaaccccccccccactgaatcacaaattaagcaagcaaaagaccaataatgtaaaaaatttcaaaataaagcaaaatgaaacacagtccacaaaaaaataccgtaacatttatttagtgtgtaggtgttagagacagacagacagacctgcctccatgtgtgcacatatgcatatgcatagaagaagggaagtaacctactttttttgtttttgttagaaaataggaacagctgcattttgtcagatttcctgaatttctcattgattacttacaagtgtggatatgcaaacacagtttgttcgttgtggcgttgttaaaatcacttcagaagtttaaaacttagcatattgggttcctttacttgtattcagacatttcaacaagatacaagattttaacgacactttctaccgacgtaagttcttcacttgatattaagttcttgctaattctttgagtttgttgttttgttttcccccattctggtacttgaaacactatagcactgattgttagtagataccactagctgcttgtttgaattaaaaattattgaaggattaagagggtggggagcttctcataaaattagcttttattttttaataacaagccgggagtggtggcgcacgcctttaatcccagcacttgggagacagaggcagaggcaggcggatttctgagtttgaggccagcctggtctacagagtgagttccaggacagcctgggccatacagagaaaccctgtctcgaaaaaaccaaaacaaaaaaacagaaaaacaaaaaacaaacaacaaaaaaagcaaagtaaactactttgcataactgcctttatttaaattggtaaactgtgttcaaagcagttttagagtcacagcaaaggtgggaggaaagtattgttttctgtcccttcacacagaagcccttgttgctaatctgagttatgtgagatgatggaagaaggagacattcagatacaatgcagccttgagaaagcagggggatcagcctcaatggactgaagcccaagcagccttttaaaagcatgtttatggactgttatccttttagtgtgaggcaggttcctcatacgagagcccctgatctaatgtgtgtgacttatgcacggtttgcagtgctcaatagtgtgagaccttctggtttgctaagaatgtcttgtggcaaagatcatgcagaggctatgaagctccttcagaaaaacagctcacagaaaacaatcactacctatcacagtgatttctttgaagcccaagaacatctaaaaacagttgcttcattctgatgtttataccagatataatgactactaaatttccactgcaaaccttccttacaacagtggtccacaggcagtgatagactgatacagtccgtgagcccctgctagagcactggtatggtatgcttgtaagcactagtgacctagtggcctggcggggccagcactggagaggctgaacaacaggatagagaatctgagacttgcctaggctacatagactatatcaaaaattaaacctgtttctttttttttttcttgtagaatttcatatcattgtatgtggcctggactctatcatagcgagaagatggatcaatggaatgctggtaaaggcttcagtgttgggttctctaaaggcccttgcttttgcttttgacatactttaaatcagaattggttaattttaaattaagtagattcacacatcgttcgtgctttcattgattttcaatgaaatgtgtttattgttaggaaagtaattccttcattctgatattgctactgaatcccaaactgacttctagaattttctggaaatctgctgctttcttttttcccccattttctattccttttttaaagccctttaaaacatttccctagatatctcttctaaattatgaagatggtgtgttggatccaagctccattgtacctttgatagatggggggacagaaggctttaaagggaatgcccgagtgattttgcctggaatgaccgcttgtattgagtgcactctggaactttacccaccacaggtaatcagaaaagttcctgcatttctctcttagtatcttggggtggtaattattattggttattacatctagtcagtgtctagggtttgtaattggggataaacatatttaaatatatgttaagggtagtatttaccatgataagggcatggggtcaaacttgtgtacttcaaccttgaaataaaagcaaaatttaaaacaaaatttgcttagaagaataaagtatgatcgtcttctgtgtttgagagaagatactatatatcaggtctgcttttatgctgttagtactttttttctttctcttaatgtttttcaattatgtgtatatgtttaagtgtgtaggtatatgagtacagctgtcctggacaccagaggtgacaggttcctctgtatctagagtcataaggtggtgtgaactgcccgacatgggtactgggcactggactcagttcttctgaaagagaggtgtatgctcttaaaccactgagccatctctccagctcctttcagagaaattacaaagttaaatgttgggataaattatattctgtttgttttcttcatatactttcccttaatgttaaatttaacagtagtacagagaacacaactactaggaaagaggctggtagggtggcttagtagataagaccttgaattcaatcctaggaccccacatggtggagctaaaagttttcttgtgactgtcatatgtacactctagcatgtgctcacaggcacatacatgcaaaataaatgtaataatttaaaaataggattgaaaaggatcttttcaaagatggagctctttagcctatatacttattttgatttataaatgttagcaattctataaatataaacttacaattgatttaattctgtgtttttgtgttggtttgcattacacctttacactaaatataggcaaaactaaatcactcacatttcagaatttatttagtacttttttcattgccaatagaacttgagtgtatatgctttaaaaatgtcggacaaatgtgtctttataggcaaatgtgtctttataggcagctcagccctgagagactctgatgcctcctattagtatacaagtcttaatgctttataagttttgcttatataagtctagagctgagatgaatgctatgaactaaaccagaactagaagttgcattttaaaatagctcatcatttaaattttactaagaaagacaaattttgtggtttcaggtcaatttccccatgtgtaccattgcatctatgcccaggctcccagaacactgtatcgagtatgtgaggatgttgcaatggcctaaagagcagccttttggaggtaatttaacaatctagacttaaaaagtattttatatattatttattatttattttgaaatttcatttaaaaattatctttggtcatatatatttttctcccctgcaacagatggggttccattagatggagatgaccctgaacatattcagtggattttccaaaagtccatagagagagcatcacaatataatattagaggcgttacctacagactcactcaaggtgagttagtgaactgtcataattgtggaatttttagggaaatactctgtggcagtgattctcaacctttttttaaaaagactatctgtatatcaggtatttacattatgattcataacaacagcaaaattacagttgaagtagcagcaaaataattttatggttgagggtcaccacagcatgaagaactgtataaatggttgcaggattaggaaagttgagaaccacagctctatggcaagaatgcttgctatgtaattaagagatcgacatccatctgacgtctaattaaagaactatggaagcagtgtgtttccagttatttcaaggtagaagtgaactgtgttcagtagaatagatactactcagctagtggagattgaatggtgccactgattcctgtttatatacaattgtacaattgaaagagcccttatcttcaaagtctgactgttgacttcatctttcacggaagaggaatttatcctctcttaggagctgtcaaaagactgtccgatagttactctgtgtcttgtttagtttgagttttggccagtatcttacataatctaattgcttttcttttctttttaaatttttatgtgagtgctttgtctgcatgtttgtatgtgcatttcatgcatacctggtgcctgcagagtgcagaagaaggtattgcatcccctggaactggagttgtagaaagatgtgagctgcatatgtgtgttgggaactgaacgccatggtcttttggcagagtagtgagtgcttttaactatgagccatccctccagctccaaattcccctttaaatagtagtttctaactattgagcatagtggtcacattctctccacattttaatagtttatgactccagatcttcctgattcttcaatcctttggtgggtcacaggcttcaagtcttggtgtgcttctctgaccagagtccagttatccatccttttgggatctcctaggccacaatacagccttctagggttagccatacctctcatactgggaacagtcttaaaggagctgatgtcttatcacttattttttgcatttaatcatttaatactgttcccatttgttgatgttgctgcccattaaattttgcgtatgctttcacagtccagtggctagatcttcctttccctctttctccctccccatgtcccctttctcacagaagaattattctggaggttgtttattgcatttttgaattggtcctggagatcaaacccaggaccttagcagcctttttagatttgtctcagtctgttatcagatcttcttgagtctctcagacttctttattgtcttcacaaagataccatgaaagacctttccagatgctctcccaaggactggttggtctgtttccccatttcctggttgccgggtcagtcagagtcccagtcccagtcactgaatgtgcctcctctagcacagactagcagtgagcagaactgctcagccgtggtgaccagtgttccagtcctgttatagttcatcccttttggagctttgccatagtctctagaaagagttgtctattctttttccaaatttgtcatttctttttgtgactattttctttactcattctggtattatctcttaaattcagtttatgcctgctgcccgtttcctcaccttggtctacccgaccgaggctgctctgtgctcctcgcactggaatgctgggaacacatcttgtagtgctgcctcaccctccaggtccctgtagtttctctagcgggagcaattcaagagcagtttgaagactcgagtctcccttttgtattatgggagatggtttgtttcttgcttacatgaatatggaagtgaaaagttaaaatcagtcaaactagagagctattgttttgttctggtcatgaccttaatgtaaaataaagatacttttaaaaggttgttttagtttttccattgtgatattttgtgaatggaatgacttgaattaactatatcaagaatcatcagaaatctttatttatacttaactcaggcatttcagaatctcgtagtatagataagactatgtgggatgggcgtgtatatacacccatttctatgcttgctaggggaaatgttgtggatatgttctttttagaataagtatggtgtgacaggtatcactatgtcaggaacattaaataatatttattattcatactatacctggaatttgaggaaacactgttgttatcatgtttctgctttgtcatgctgggaaactacaaagacttcatttcagtactgttgcttacgatttcagcactgcagacccttgggagtgaaagatgatatgatagttcattttaaagttctcggggtttgttttgtttgtttgagatggtgtcttgtcagctttccaccaccatgcctggctaggcccaattttatttcttgatttgaatgcctgaaaaatcaagtttcagaaaatggtattttgcaatcaagactttagatacatgatttaattacatgattttaacttaaggtgactttatttttttttagatagagctggaaagatggctttgctgttaagagtccttattattcataactacctctagactctgagggtacctacactcacatgtacacatacctgcatatgcacacatatgcatgctcgcacatgcacgcgcgcgggaacacacacacacacacacacacacacacacacacacacacacacacacacacacacattcctgtatacctaaatgaaaatcttgaaaaaaaatgaccatattttatttggcaatttttttcaggggtggtaaaacgaatcattcctgcagtagcttctacaaatgcagtcattgcaggtaaggaagagactccagctttactttctgctttgattttgacatttctgtagttacttgcctgctaggaatttgatatcttcttgggttcttgtttcattgtctttcaggaccttacgtttctcttagacacagtgctcacagtaaaggagtgttttggagtgtctttttactcataggttagcgttgcattgatccaatgaaggtgaaaggaagttgtattgtttggatcatataaaacaaatataagacttgttccttcctatgcttttaaaattatatattttaaaatctatttttctatagaaattacaactttatctgacttatcactgactttcaaagtatgtaatttttactgaattcaaatgcctttattttctctctagctgtgtgtgccactgaggttttcaagatagctacaaggtaatgagttttatttttaatatgtgtataaatccacattataaccttgctcaattagataaaatgaactctttctttcaccacagtgcgtacattccccttaataactacctggtattcaatgatgtagatgggctgtacacttacacgtttgaagcagagagaaaggttagtagcattaaagtagcaacaatagttttcactatccagtctttgtttttatatattaattattaggaattagaagataattatgctatgagttactaaagctaataatatgtatcttttgttggatagcttaaataaatactataaagcataataatttatagtaaataatctattgcagaaacatgctttaaagcaaaaaatattttcatagaaaatatgtatgattataaaacaacttgatttccatatctttgcttaaaaagagactgagcctggtttgtgtgactctaaattattcttttatgtttgtaggaaaactgtccagcatgtagccaacttcctcaaaacattcagttttccccatcagctaaactacaggaggtcttagactacctaaccaacagtgcttctctgtaagtgttgaggatttatattgtgaacatcattttttaaacttcataataaaaaagccagaactatttctttaaatgagatggtgttcactactttatttaggcaaatgaagtctccggctatcacagccacattagaggggaagaacaggacactttacttacaggtcagtagtattaatttctaatttttttaagataattgtattattttttcttaatgtgctatacattaaaataatgttgttctctagtcagtaacgtctattgaagaacgaaccaggcccaatctttccaaaacattaaaaggtattttaagtaaatgtgtatagttatagttttcttttttagtgaatgtctgctctccatcccttcttcctccttccctccttccctccccctctgtgtgtgtggggaaagggggctgtctgtctgtccgtccctggtacaggtgccttatccctgtgcctgctgtctcctcagccctcagtgtttggagataggatggatgcctttgtgtggctttagctagccttgaacttgcttatagcccaggctggctttgaactcagatttattcataattaaatatgaccaaattgtaattatttatatctctatagtagaattgatggcttcttttaataaaaataatttaaaatccaagaaatcaagttttaagacatgtctgaactataaagctataacttgtgcgttatgtatgtgttattctttttgttgaggtatttattttgcttggtctaatgacacttttctattttagaactgggactagttgatggacaagaactggctgttgctgatgtcactacaccacagactgtactattcaaacttcattttacttaaggaaaataaatctgcacataatagaaaattcatagaaataatatactttataaatgatatgaaattgaagagcctggaagatgaggcagaggggaacatccaagaaaggaaatttaattggtgtcatttttagcattagtgtggctagaatttgacttttatatatatacatatatataaaaaaggactgactcttttttaactttataagtttctcttgaagactgaactttggggttgggctagcaagcattttcattttattactatggaaagctatgccttcaggagagattatgaacaagtgtgttgcttctttaaagcaggacaaacactgtcttgtgtgtgagtttgttgtggtcaaagagcatattcctcagcgtgtatctgaaatccacatgtgtagaaatgtctcctgggatggaaatgaggagctatgtctgaagaatagtaaatattcacagcctgacatctagagtatatcaaacataggcagtgtcttcattgctactcatataattgtgactatccatgtgtgtattaattattgcagaatttaacttgtccatgataatttgtaaacagtattatagattcatacctgtgcatgaaaatacaaaatattttcatgtatttgtttgcaatgccacagagaccagtatgcacaaatttaaaccaagacatggctgttcaaagaaaattaatgtttaaacagttatcattgatgcttttgcactatttattaataaaattgtacattgtctttttattggaaaacttaaagtatatcaataatagtaaataactttatagtgatgtagaaataatttttaaatgtttaccagttattatttccagacttttattgcgcctgagttaaatttttaaaattttattatagtgatttccatagtacagactaggttcactcattctaactagtaaatgaaatggaatgacttaatttttatagtcaagtctctctcttagcatgcctttttttttcttcaaaaatgctaaaatcaaagtggagcacgaatactaaaaaaatgtagttgtaatattttaatgtggggacaaatagtacctgattttaattctttgtttttcatttaattgcaattttttattcagactgttagtgggtggaatctgtctctgtcttctttctttctggtggaggaatgatgcaggggtataactaggacctcccacgttagtcaagtgctccatcacagagctataccccagtttccagctccctattgacaaatttagttcattatcaaaccacgccgggtggtggtagcgcatgcctttaatcccagcacttgggaggcagaggcaggcggatttctgagtttgaggccagcctggtctacaaagtgagttccaggacagccaggactatacagagaaaccctgtcttgaaaaaacaaaacaaaacaaaacaaaacaaaaaactaaccaaccaaccaaacaaacaaaaaaaacccacatagggtacatttatatgctttactcaaaatgctacagaattaacacaattttttctttatggttctttctagtatcagatttagggtcttgtactaggccaatattccttcactaagctgtatttccaataagcctcttttaattttttttttaaaaaacttttattgcatattttatgtatttacatttcatatgttatcccctttccttgtttgctctccggaaccccccatcccaatctcccctccctgcttctatgaggatgctccccctcccacctacccactcccacctcaccgccctggcattcctctactctgggggaatcgagccttcacaggccaagggcctcttctcctattgatgccagacaatgccatcctatgctacctatgagcctggagccataggtccctccatgtgtactctttggttggtggtttagtccctgggagctggagtgggggggaggtctggttggttgattttgttcttcctatgggttgcaaaccccttcagctcctccagtccttgctctaatcctccatttgggtccctgtgctcaatctgatgtttagctgcaaccatctgcattggtcaggttcttgcagagcctctcaggacagctataccaggctcctgtcagcaagctcttcttggtatgagcaatagtgtctgggtttggtttctgcagactggatggaaccctaggtggggcagtctctgggtgacctttccttcagtctctgctccactctttgtccctgcattttgttttgacaggaggaattgtggattaatatttttgaggtaggtgggtggcctcgtccctcaactgggagccatgtctgtctactggagggggtctctacaggttctctctcccctttgttgggcatttcagctaatctcatccccattgcctttattttctctctagctgtgtgtgccactgaggttttcaagatcccccctctcccttccccctccctcttccttcctccctccgtccctccgtccctccgtccctccctccctcccttccttcctttttctttttttaataagataaggtcttattgtgcagtataagctggttttaacttgtgaccctcttcccctgcctctttctgtactggattataatgtgttgcaaaacaacacgcctccatcccccccccccctttattttttcaagaccgggtcttacaatgtagctctggctgtcctggaacatactatgtagacaaggcttgcctgaaactcagatctgcctgcatttgccttctaagagctgagtctttttaaaggtgaagattattaacactgagtgcctccttcttaaagatgctgtaataaaaggcaacaatattttcatcataaaacttggaaaataactttgaaaggtttctgtcattggcccagtgctgtgcatttagaagtattgagacaggaattctaataggcctcaactccttacatactcagctaagctctttgaaaggaattgggctatttagtacaattacacaacttgtatagttaccaggaattagtataatgtgcaaagatagttttcctgtggatctatatactttatgtacatgcacatgagttgaaaccctgtgctgacagagtgatgtttgaagactcggggcttctaataaaggtagtaatatactgataagcaaaattaaagttaaagcacagggcttgcaaaatctaccagagcaggcaaggcctgcgatactctctgcagagaagtcagggtccaaggacaaatgtattaaagttagaggacataagaccctttggaacctccttcaaccttttcactaccatttttgccactcatagcaacacatcctacatgtttctttttatgaaaaccacttcctcctcgctttcctcagcctgtgacattggcatagggcactcttcagcttgctaagattctggggtgccctcgtcttgtggcttttcccactctcaggctcttcttttttgcttcatgatctggcttttcctgtttgcctgatttgcttcaccctcaggctcagctttgtcttctggatttccttctgtgacaacccccactccccacttcgttcttttcaggtacacatagatcttcgaagaactaggacctgggttcaacagaagcatcctctagccacaagtctgtcattaacatgctcaaaattgcaatactgtgggataaagttactggaagataacttgccatggatatgaaatttttgttgttaaggaaaagtcttatagcttagcttcttgcagtgcaaaacagatactcagggagcaggcagataatgtgttgtacagagctcttagaatgagttggcagatacatggaaaattgtgtgaaaataattgtcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacatttcccctttcccttccgtccctctaaactttttcatagacctctattgctctctctcaaattaagtctcttttattaactgttaagtatataagtgtgtatacatatgcgttctcaaatgcattaattagtacaaccctcagtctgtatgatgatttcggggctgctcatttggtagtgtgtaaccttcccaggggaagatttaccccattcctagcttcggcattccttaagtacccgtggttctttgtgtagggtaggagtctcttttcacaaagggctaatgcttgaattaaatttagcctttaaatgctggtagaaaatttttctttagcattattagaaccaaaccaaacagctgctgactggacaaggaaggccatcgactttaaattttctcccatgaccaagtgtgggaaagagagcatacaagctgtatcttttaggcagtgtgcacagtatgtactgatgggttaatattttattgcttgccaagtggcttaacccatccaaaccgctgttacaaactgccataaagtggctggctcataggctacagaaacttgatttttactgttcttgtgactgggaggtccaagacgagcacagctgatgagagccatctatttctagttcatggctggcgtgaccttggtatgttatgcttgagagggcgtaggcacctcttaatagggcattcatctctttcccgtgggtgtcacagtcatctcgtgacccagaaagttccttaaagccccacctcttaacataggagtgtgctgatgaacgccattcagatgacagaattaggttgagagggaggtggtttcatctgttaatgttccaggacctggggaccgtgccctcaagtcaggcatagacagccaggccaggcgnnnnnnnnnnnnnnnnnnnnnnnnnnnnnnnnnnnnnnncacgcggctctggtcgctcccggtagtctgggcctcggcgcagatcgcgtccctcagttgagaacggccatgaagcccagagcggctggtaactaagggctccgctccgctcccggatgtggcttcacgctaccgcctccgtccttccgtctgggcggaactcggctcccggatctggtggttgtgtacgtggaagggcggcgcatgcgcggcggggcccggctcagctgtgcggaaggctcgcagcgccgcgcggccgcgggaggcggtggggccggggccgccgctgaggccgccggagccggccggagccggcgctgaggaggggccatgagctggttcaatgcctcgcagttgtccagcttcgccaagcaggccctgtcccaggcccagaagtccatcgacagggtcctggacatccaggaggaggagccgagcgcctgggccgaggccatcccgtacggcgagccgggtaagcgggtcccggggtgtcgcgcctgcctgcctgcctgctgtcggaccccagtcccgcacgcctcggccccggtgcgggtcctgctgacctcaggtgtcagctcgagctctggtcctggccccaggcccctgactacagagtcaggagcacagccccagatccccaattgctaggcgtcttccgccttggcgccctaggtccgagccttgtaaatccccagtcccggagccccgcgggaagcgtttaaggaacacaaaagactttgtttacaaaaagttcaccgtctcaaaacaacccgagtcagggatggtagaccccgtgttctacagaggagctaaccgaaactcagaatgcataactttctccaggtgaggcacagtctgtacggggcagagtcccaagagaatttgtgctccaagagttcccaactgtagccctttttgcagcaccagatctttcagatgaactgaaattactctttccaggattattcggttgcttgtgtctttacgtctaagggagtctggagcacttttcgtgtgtagcaacagacactggggcaaacctttggatgaaagttaactgtggtttctggttttagatgtacattgttgaaaactcgggacctaagttgaatcattgataacgtagtttatgtatgactgtagatatatcgtgatcttatttcattctctgtggcaccttgctattgggaagctcgcctttttgtggttggaccccagagctggagttactaaacttaagatcagatgtttcaaataaaaagatactcattatcccccgccccgggcgaaatctgagacatggatagtgctgtataatttattttagagggcaggttgtctgaaatggaatatgctttcttgaatgctattttcattgatcatctgttgtgttttagattacaaaacaacatgggtctgaagaataggaatagtttaagtggatgtgtggttactataattttgtaccacatttttcaagaggcaaagttaaaccctggtatccgtgaggatgctaattagctacctcgaagacctaatcttgccttaagctttgttttctggtttcacacactgaacaaataaatgtaaaactctgttcccagttcagtttccccaacactcttcattcctcatagctgtggaatcacgttaagaggcagattttattaaagggcttcttgagttgttttttttttttttttcttcctcaggaagtctgtgtaccctttccataagcttctaattgcagagttttggtaattttgctatcttaaaaaatgtggaaaaaataatttggggtttaagagaggggaacttgcagactggtcattaagtacataaaagtgaattcattcactagaactcactgttctcatcagtttaattatgatttttgaaaaagactgtctctattatctcaggttaagttttgagcattgctgtctgtttagtttataatgttacaagaataaaatgagcgtgtggctggatagtgctgtgactgcatgtgcctgttagtgaagatttgaactgtctttgtgagatgagccatgtgcctgggatttcacactggctgtacagccttgatcactactttaagcatgtattccgaggggctagcatacttgctttggcctggcaaaaccaagtctggtcttgtacttgttcctgagactctcataggttggcccacactggttttattctttaacgcccaaagttaacctggaaactaataaagtgatgctgtaaggaaagagtctaacttttccgagttacagggtgcagttcataaattccctttgctcccacttgatgactgatgatgatttaaatacgaatgctaacattctttacttaatgaactaatttattttgtcaaaggaataagtccccctgtgagtggaggatgggacacttcaacctggggattgaactcaacaagcagcgaacctcagagtcccccaacagcctctcaagcaattacaaagccagttcgaaggactgtagtagatgaatctgaaaatttcttcagtgcctttctctctccgtcggatgcccataccattcagaagagcccagtggtatcaaaacctccatctaaatcccagcggccagaggaagaagtgaaaagcagcttacaagaatcgtcatctcctggccagtccagagtttctgagacagctgaagtgagagactccgtgtgtgtttctggagagacttcagccgtgggcactccctcacctgtacctgaagacaagcatgaagaaacggcaggtgaagagtctgaggtgaaggtgcccactgtgagattgaaggcgtctgaaaacgtagttaatgtaaacacaacagaagatgtatctaccacatccactcagtctctcacggcagaaacgaaggatatggctttggaacctaaagaacaaaaacacgaagacagacagagcaacacaccttctcctcctgttagctccttctcgtcgggcacctccaccactagtgacattgaagttttagatcacgagagtgtaatcagtgagagctcggccagttcgaggcaagagacttcggatgcaaagtcgagtcttcacctcatgcagacgtcatttcagctcctctctgcgtctgcttgtcccgagtatagccgcttagatgacttccagaagctcaatgagagttgctgctcatcggatgcttttgaaagaatagactcatttagcgtgcagtctctagatagccggagcgtaagtgaaatcaactcagacgacgaactgccaggcaaaggctatgctttagtacccataatagtgagtccttcaaccccaaagactaaagtagtagaatctactgaagagaatgctgaagaagaggaaggaaacgagacattagttgcgccgtctgaggaagcagaattagaggaaagtggccgaagtgctactccagtgaactgtgaccagccagatatattggcttctcccacagcaggaagtggcgggcactctgcctctggaccggccactgagcagtgtgaagctgttgaaaaccagccaaaagcaccgccagagaaagaagatgtttgcaaggtaactacagagtagaagagggcattggggtatgtttcagagttacagatgttttcgtggatgtgtggtgatttgaaaaagtagatgtttgatcatttaattgtagcagttacggactttaaaatgagtaattatgttaaattacttgaagttcttgcaaagcaactatggtagacttaagtagatattatataaaagcttagtgtttccattttccatctgtattgctgcgtccttatcactttaacattctttgatgctctgttcatctttctgacagtttgcaaaggactgtttaagtcacaatgtgttctcctgaagatagacatggaatatcaatctgaatgttaccacttttatatcaaagtgttttgcatatgtatcctatttatgggaaattttagattttatcgttttggttttatatgaatactgtagatgctttcctgtgtttactagtctaatgttgatgtttcattgacataacaggtatacttcttacagtgctttggcgtgccttttccttacgttactttgctatctgtttttaatagctatcttatatgaatgagaaaatgaaatggccagggagcaaaagtaaaacctgggaatgaccagtgacttctccctaatacatacaagagagaatggtgtccattcttaatgttagaccacagcgctgctttactcctgagtcttagacattgaataggagctaacatctctaataggcttctgaaatgtatatataatgtggagaaatgtgtgtgtgtgtgtatatatacgtatatatatatatatatatatatatataaataaataaaagtggagaaatgtatataacgtggagagatgtatataacatgtggagagatgcatataacatgtggagagatgtgtatatataacatgtggagagatgtgtatatataacatgtggggagatgtgtatatataacatgtggggagatgtgtatatataacatgtggagagatgtgtatatataacatgtggagagatgtgtatatataacatgtggagagatgtgtatatataacatgtggagagatgtgtatataacatgtggagagatgtgtatatataacatgtggagagatgtatatataacatgtggagagatgtcctgtgaatgctcattttgccttagttaacatttttgaaagtagcaggttccgtgccctgggtttcatactgttcaagaacaaaatgccatgctgtagttttgaatgagcagcagcagcagccatagagtacatgctggtattttgaatcccccaaaggcatcactagttactgttcatgttttcagactccttaggaaggtaagtgatttttagtctgttctgactcaagacaagaccttttttttttttaaagatttatttattttatggatgtgagtacactctgtagctgtacagatggttgtgagccttcatctggttgttgggaattgaatttaggacctctgctcgctctggcccaaagatttatttattattataaataagtacactgtagctgtcttcagacccaccagaggaaggtgccagatctcattacgggtggttgctgggatttgaactcaggaccttcggaagagcagtcagtgctcttccgcaccgagccatctcaccagcccaagacaagacttttttgaagctggaaaagcaccctctctgcctttacagagaagtttatcactgctttagcaagacttagacat

SEQ ID NO: 614 - DNA, 2117 bp, Mus musculus
aagaaaagaaggagaatagaggagctgctggctgagaaaatggctgttgatggtgggtgtggggacactggagactgggaaggtcgctggaaccatgtaaagaagttcctcgagcggtctggacccttcacacaccccgatttcgaaccaagcactgaatcactccagttcttgttagatacatgtaaagttctagtcattggagctggtggcttaggatgtgagcttctgaaaaatctggcattatctggttttagacagattcatgttatagacatggacactatagatgtttccaatttaaatagacagtttttatttaggcctaaagatgtcggaagacccaaggctgaagttgctgcagaattcctaaatgacagagttcctaactgcaacgtggtaccacatttcaacaagatacaagattttaacgacactttctaccgacaatttcatatcattgtatgtggcctggactctatcatagcgagaagatggatcaatggaatgctgatatctcttctaaattatgaagatggtgtgttggatccaagctccattgtacctttgatagatggggggacagaaggctttaaagggaatgcccgagtgattttgcctggaatgaccgcttgtattgagtgcactctggaactttacccaccacaggtcaatttccccatgtgtaccattgcatctatgcccaggctcccagaacactgtatcgagtatgtgaggatgttgcaatggcctaaagagcagccttttggagatggggttccattagatggagatgaccctgaacatattcagtggattttccaaaagtccatagagagagcatcacaatataatattagaggcgttacctacagactcactcaaggggtggtaaaacgaatcattcctgcagtagcttctacaaatgcagtcattgcagctgtgtgtgccactgaggttttcaagatagctacaagtgcgtacattccccttaataactacctggtattcaatgatgtagatgggctgtacacttacacgtttgaagcagagagaaaggaaaactgtccagcatgtagccaacttcctcaaaacattcagttttccccatcagctaaactacaggaggtcttagactacctaaccaacagtgcttctctgcaaatgaagtctccggctatcacagccacattagaggggaagaacaggacactttacttacagtcagtaacgtctattgaagaacgaaccaggcccaatctttccaaaacattaaaagaactgggactagttgatggacaagaactggctgttgctgatgtcactacaccacagactgtactattcaaacttcattttacttaaggaaaataaatctgcacataatagaaaattcatagaaataatatactttataaatgatatgaaattgaagagcctggaagatgaggcagaggggaacatccaagaaaggaaatttaattggtgtcatttttagcattagtgtggctagaatttgacttttatatatatacatatatataaaaaaggactgactcttttttaactttataagtttctcttgaagactgaactttggggttgggctagcaagcattttcattttattactatggaaagctatgccttcaggagagattatgaacaagtgtgttgcttctttaaagcaggacaaacactgtcttgtgtgtgagtttgttgtggtcaaagagcatattcctcagcgtgtatctgaaatccacatgtgtagaaatgtctcctgggatggaaatgaggagctatgtctgaagaatagtaaatattcacagcctgacatctagagtatatcaaacataggcagtgtcttcattgctactcatataattgtgactatccatgtgtgtattaattattgcagaatttaacttgtccatgataatttgtaaacagtattatagattcatacctgtgcatgaaaatacaaaatattttcatgtatttgtttgcaatgccacagagaccagtatgcacaaatttaaaccaagacatggctgttcaaagaaaattaatgtttaaacagttatcattgatgcttttgcactatttattaataaaat

SEQ ID NO: 615 - protein, 454 aa, Mus musculus
KKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDVGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGDGVPLDGDDPEHIQWIFQKSIERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFT

SEQ ID NO: 616 - DNA, 45644 bp, Homo sapiens
ctgagaagttggtaagtgcttcatactctttgttaattgaatgaatgaagcaacacaaataagagtaatgttgtagaactggtgttgaagctgactaatctcaaaaacatttccacttgctttagtataaacagactgcaactcattctatctgcaatcatttcaatagattctgatccagagcctcccagggttgccttacgctttttttcctctaccagctggaaacttggttcttcatctttacagcatttaaaggtacaaacaatacgaacatttcataataccagatgctgggagccacaggcctagaacatattacagagccaccaagccacgttcattttgaaaagattacattaatgctgttttcaaacttataattaccagccttctagaaactccttaccatcttgagtaactgaaagcataaagtggcagctgtcaattccaccctcctgcaacatctccataggccaaatgatcaggccacatggtgaggagttacttcagctgagaaatcatgggctcattccttcagcagctacatggttctatctaaagggggaggcacaaatgtatatacataagaatacatgcagctctcttgctggagaagcagcagaggcatttttatatgttgcaaattctgtgtgtggttggtgattctgaggccataccagaaaatatgagttctaatggcagaaaataattttttttttttttttttttagacagggtttcactatgttgcccaggctagtcttaaactcctggccttgagcaatcctcccatctctgcctcccgaagtgttgggattacaggtgtgagccactatacccatccaggaaagaacttttcagaataagacagcaatagcattgcaaatattgtaagagtcagggatgcagttgaatttggttaatcaagagctttagaaaatttgcaatatggcttaatggaaaaaatatttcacttcctattattagcagctttagttccaattagcctgtgacctcgagcttttacatttcagaagttacggggttcaagaggatcagtatttctcctaggggtgtataatcacaatcacttaggaagttagagaaaaagaaaaaaacaacagatgcctggaccctgccaagaactatacattttgaatcacggaaggtgacacctgggcatataggtatatttatttaaattttcttttgagccagaccaatccagtgcctctcagattttaatgtacctatgaatcatctgagacttttgttaaaatgtagattctaacccagtaggtctgaaatggggcctgagatgcttcacttctgacaagctctcaggcgaaagatgctgctgttccatggctcacacactgaacagagttctccagctcaaatcatttggcattccattaagcacaaagaagttttcatccacaactagaatgtatcacacgcttagtacttaaattgcaagtgtcattaggtgttgcctttgtttttcactttgaagatcaaggtagagacttctattgttgtgtgtgatgtgaaaagaatatcttaatcccaaaacgtctcacatcaaggatgcagaaggtaagctatggcaacttcgatcttagacacttttccttcttgatgtaaaggatccaaaggcatttccagcaaaacgcaagtttcctagcctgttattcatgctattccttttaaataattcaatctcttctgatcagaagtttaaacacagatttatctctatcctaatccctcttaatctccgtcttggtatgggcagttttttccagtgtttctggatctagatagtatttgctatgttcttccctcacccttcctgaaatcttgaagaggaggccctctctatcctcatctaagccagtttccaacattggagagctgaggctagagcactcctacaatgcccttgaggctctcctcaccagcaggggatggaaccattgttgaacactcttttatccaggtcacattttcacatatactctaccaagatattctgagaaactagagagaagtctgtggaggatccagatgaacagctgccagcactgctctgacctacccatctactagcatcaccgaaagaggatagttctctttagaatgagaagtgttctggaatcaaggacgctccctaactctgaagatgtttggtttcttccttgtgactcatagtaagacagaacagtagttaagagcacaagcctaagtttgtgactttgagtaaatcatttaacctctctgagcctcaggtttaatgataaaaaaaaagtaacagttttttaaaattgggttctatgacataatgcaggtaaaatactttgcaaggtacctgacacacagagcactcaataaatatttatattattaaatgataaagaaagaaaagagaacaactggtggaaaaaactactgactgtgcttatagttgcatagaaaacagttaggggttatataccaaacttttactgaagtatgaaggaaatttcacattttatccacataattttcaaatcaacctttactactagcctgtatcttttgtaagtttttaaaaataaggataagttttaaaaacttcatggctacttttcactttttcacttcaaaattttcattgacaaccaacaactcttatttgaaaggaaaatgaggagggccaacacccctaaactacctgagttagtggcctaaggcacaatactgacggagctatatttagtcaaagggctggcccctggccttcacagtgaaaaatggattctatcaaaagcagcaaggctgtctgagcttgtgcctggtctgggcagcacacatgtctgaagaaaatagacttttttttttttttaattattggtctgtgtcaaactttgccccacatctaagttacctcaagaaaatacctccataactagatcaccagataagatgccctcctgcttctttgcaaagagaaagaaaaaaacaaaaattgatgcaaacctatttactacttattttgttttaaagacttttttggccaggcacagtagcccccgcctgcaatctcagtgctttgggagccaaggtggaaggatggcttgagcccagaagtcaagaccagcctgggcaacatagtgagaccccatctctaaaaaaaattagccaggctttgtggcacgcacctggggtcccagtcacttgggagactgaggtaggtggattgcttgagcccaggaggttgaggctgtagtgagctgtgatcacaatactgcactccagcctgggcaacagaacaagaccttgtctcaaaagtaaataaataataaaaatttttaaaaagaaatttttggccaggcacagaggctcacgcctgtaatcccagcactttgggaggctgaggcgggcagatcacctggccaacatggtgaaaccttgtctctactaaaaatacaaaaattagctaggcatggtggtacgtgcctgtaatcccagctactctggaggctgaggcacgagaattacttgaatccgggaggcaaaggttgtagtgagacgagatcacgccactgcactccagcctgggcgacagaacgaggctcagtctcaaaaaaaaaaaaaaaaaagaaattttttagtgttccaggaaagcagcctgaagcacagagctgagggaaggttcagaaggcagctgcctcaggccttgggcctgccccaccctgccctgactaacttgtaccttggctgccacactagttccgagtccactcagagcctgtgccctctatacaccaagccattcccagaatgcaattccttaagaattccttaagcaatgcagaagaaggatctgtgcgattgtgtatagagtcccacatgtgggcttccacctctgcatgggggtgattgctgtgaaccatactcggaaactgtgaagtctccccctctcctctgtgctgtgtgtttgctcctttagcttctcaacaactgccaggagcccctgggccagaattcaagtctgattcatcttggtgtgcttggagcttggcatggggccaggcacagagaggtggctcaatgtataagccaattaactgcgagccaactgaagaagccaccctgttcaccctttcccacacccttcaagtgcaaatttctcccttttctcccaagccagcttgctgcttcttccctctacgtctgccctgaaatagaaatgtcagacatttaagtgcaagtgagtcctttataaagtctgagggtggctttttctttaaagatgtgtaggagataatcagcaagattgagaatatcaccacccatcctgcataagcgagagaagcatttcttaaagggtgaactagaaggaaaggtggtttctaggaaagcaggtgtacatgcagtctcaacacaggatactttgttaagtatcaggtattgaaaaggccttctgatacattgaaacctcaggctaggaagcgaagacagagaaagtgaccacgcctggccactgctggaagaaaatgccagaaggccatcttcccacagtcatggcagcctttaccccacaatgggagatgcgccaccaggagacacccccccttttgatcccaagctcagctttactgtacagtgtggcaggcattaggcagagaaagcagcaaagtgcgtcgccacttggttgccctttttacactagcccgggtccacaccctgccgccccagccagctccagggtagggttacaccactttcctttttcttcttatttttaaaagacgagggcgctacaaatatctttccagcaagagcccgatcctggcacgcgggcgggggcaggggggtgggggaactctcatttttcttccctgcggctggcaaattttccccgtcctctttcccctagggcccccctcaagtctcagcccttggtgcagaaaatggggccccaggttactgcggcctcgccctgcaaacaagtttccactggcttggccgcttgcagaattgccagggcaggcgctgagcgtggtcagagagcgtctctacatcccgggatcttgcaccccgaggcccctccgtgctcgccccggatcggtgtcccgggtagggggaccccacttaccccacaatggaaatcatcatggcagccaccaccaggtagttggtctggtaatagagcaggttgctcactacgcggttgttccatttggaaatgtccctgaagtccggccgggcaaagcgatcggaacccgggaagaaatcgtcccaggcgcggagtggggcgatattaacgtccatgttctcagctttgcgttcttcgcctccagaatctggcggcggcggcggcggcaaccgatcagctgagctgagttggagagttgacagcggctccgtctcggtcggctttgcggttggcagacagcagagcaaaggaaattgggagtgggcgggcgtgtttgctcctctttacttcttcattggctcttggttgggtacaggaaaacaggaacctccagacagaacaagggactgagtgcagaatagagacgaaatgacagaaagcaactagcggaaatcccctgtctgaagggaggtggcaatgccttctctagcagcagagaagctgcctccttcgaaataccttttttgaaggtttacctaggagtgtgttctctgacttagagaaaaattttggcagctgtgcagatgccaatctaagtgaaatgaaatggaaggcgactacagtgttaatggagaatgagctgcttttgaaaactaagtcttactaacctctacacatctgaatgcaattcccatgttttctctgtttcaccatgagtcactatgtgtgaaatcagattggcaaaacgggaaagaaggtcatgtagaacagaagggctggtctgtttttttcacttctcttctttgttctccacctctgttctctctaggctaaattgttggactgctatgccattctgataaagtaggcactctggccacttcagtcctgagctgggcatgttgcttacattttaaagcaaacagttgtctgcagtgaactagttgttctgcatccagcattttctgggcagaaatatgcattccacttcaaaagttttcttagttttattgcaatatttggtgacagctttcactgagggaccacaatatattcatagataacgtgatgttttgtatcccagcccaaagacctggcaaaagaagtattcgttgtcaattctcttctaagcttccaagggtcatcttttttcagttaaggggctgattggtacaatgcatgagaaaaaaagtagtttgtttaattgtataatgtaataggtagaattctaaggtgaagatttctaagataacagagtctctaagcccctaagtggcttagacaaggtgaattcactctactcagatcaccaatttttgaaaacttggaaagtaatgaaatatactaatgcaaagtctagaaaacataatttaattttccttattaattcagaagacagttaaggagcttacagcgactctaagaaattactactactactgttgtttaggaaaatttggtgattgcatggaattagtgctaagatatatcttatgtgctgctttttgaataaagtttaaaatgtgaaaatattcctgagtgctcatgttttcttgattctggaaaaatgggatggtgtgaagtcagagaaagcaaaattagagtcgcagctccttcctctctggcaggtgactttggagaaactacttaatctctcccagcctcggtgtcttcatgtgtaaagtggggataatggaacatctgccatatagacgaggctaagtgaaggaatgtataggaaatgcttagtgtataataaaggttcacagttatatgttactattattgttattagcaataggatagcccacgattcttgtttgctattaatagtgctttaatctgatttgttttctatgctttcattataaacatctactaacttttctctaccttgctccaactttattgttgtggatgtatctgggtagggggaaaaggttgagaatattcagtacaatgccagcaagtatttcgagttcttttgaggctctgtgaaagcactgtgggttttttttcttttcttttctttttttttttaaagaggagaaaaatgtaatcctgctctgccttcaaaacttctgcaatccagtggaaacactagttaaatatgagacagtaagaggagtgctaaatagagatgcactgagcctcagtgctcagttacaggaagtcagagggtgtggaggaattccccagggcttcagaatgtcaagaggcagcactgtgggcaagctgagtaaatcatcttggtcaagatgagagtgggaactccagtggggccccacactgttggtgagatttatgagtattagaagctgtaactaagaactttatcttccaactgctcagaactgcatgaccaaaagctgtcaagagtgtattagtaacaatatgattactccttgatcacaggcaattgatacccaagaaagaattaaacctctttagaggtttaaacataaataaataaattctgaaaagacagagaaagctgtttatagcatgattcccttctgtctccctcccaaaatgttaaccctgtctctctctttggggtatgggagattttttttttctctaaatatttctacctttgttaaattattttaaataaaaatgaacatgtaatgagtcattacttttttccagtaactgtttgaaatgctattagtagcagctctttgttagtgttcattccggggagggaggggtcagattcactgtagaggtctttctggagctttaatttattattatttttagagacagggtctcactatgttgcccaggctggttttaaactcctgggctcaaacagtcctcccacctcagcctcccaagtagccgggactacaggtgtgggaagccgagccctgcttgatggggcttttataatgggactggtgtgtctagataggaccattcagactatctgtctgtttaaaaaccatagcagatagtctaattgtttatgatatgttccatttgaagtaaaataaatctgttgaaggttttgcttgcatgtctctgttgctttcattcctggcaagggcagatggctatttctaatccgtcaatcaatctaagccagtgagagtgcctggtgtcgtttatcaaaataccaccatggtgagtcaggctgttagtctcaaagcaagcagatgcagggccagatacctttgcagacttcttcatcggctagctgtactctatccctaggcctcagtttcctcccctgtgaaatgggtgagactggactaggtggcctttaaggtgactgctgcttttcactatctgagagggttgcaatgctcactaccactaatcaaagggtatccagtattgttgggggttcaggctacaggagcccattttgataagcactgaggttaaatcctcagtgaaaccatctgtggagttgtctgggcaagaaaaagtagtttcatagttgacgctgagacatgtgatgcagaaggaggctggtatctcttgatagggactgtgaactctattcccacgctcactgcctggcattgactttcagctcagtgaatgctattgaactgaacctaattgggggaccataaaggacaagctttccttaaggttcactgaaaactaggacaagaggaggttaaatatcacagtgtagtaacagcagctacatttactgagtacccatcaggctttatgtactccatttcagtggccctcaaactttaccagtggagaatcaccccaggctttgcagaaggctgaagggtggggtggcgggggggcggtggggagcgtggtgggggcggtgaggggtgaaaatttgtgttaaaaaaaacttcccaagtgatgttgatcaggaactgtattttgagagccactctggattttacttaattatcagtcttacaaggtgaatagtgttatgcccactttataaatgaagaaatagaagtgtctaagggtttcgtagctcacaactgagaagaatttaaaatcagttacttttgattccaaatatcattcttgtcccactccatagaaggagatgtgtgtgtacgtgtatatacatacatttttgaacatgatcatttccctctatccagccatccagattcacagtgtatatttgtatttctgactctagaagaaaataattgaaacttttatcacaatttatctttaggtgataggattatgggtgttctcagttattctttgatttttgtgattgttttcctttatacttttttctttgtatctaaatatacacatttatctcaggaaaagttttaatcattttgtttccgctgaacttatctaacagaatgtgacatgaaaatattaatgctgatttgttcaaagaaaataataatctcccaccccaccaatgtaaacggatttagataaatttattattcaagtgagtacttataaaggcaaagactttggaaccatcctgaaaagcagaaagtgaaaatttccttgatctttgcccccagaggaaagctctggcatactgggagggttcttcacgaatttttcatagaatataccaatattttgtataattacgtattaacatatagtttgtgtaaacgcataatgtattgtctacattttcacgctgcagagcaacattatgcacggtataagattcacctaattaagcgtaggtaattaagattataattacagggcaagactttaaagcccatgggagcccagccgcagtcaacctcgcacctccctgccggttgtgtttctggcctcgcccctccccgcttcgccagccccgcccctccccgctttgccagtcccgctcctccccgccctgccgcgcgtgggcacctgggaagaggcggagaacaatatggcggatggcgaggagccgtaagtaccggggctctgcagacgcgccgggctgggctgggttgtgagagagcgcggcggtgggcggttgccgccgccacccggggtccccacaccccccgccccgtcccctcgcccccctcccctcgcggcgcccagtgtgtagcgcgatgctgacccttcttttattctctcttttagggagaagaaaagaaggagaatagaggagctgctggctgagaagttagtgctgccgggaggccggggccctctccggggacccccgcctccccccaccccaggcctaggggaccagccgcagcgggcccggggggctgggagggggacacccggagcgcaggccgcgctgcctcatcccctgatccccgccccgcagccccgggggcctggcgggccgctcccggtatctgcccggtgcgggcgtcggggccaggctgtactgccccagctcctgcaggggccctccggggtgcttgacgtaaaggtcttgaggaaggacccttgtgcactcctcttcctccatcccaaattgtcagagcagtgaccctgtgaaaaggcaatctaccttaaacacacaggaaaaggacacaagaccgttttgtggccttttgcaaacactgagacagtagtactaattgcaaacttttaatgataactctacatgtcaggtattgtactaagcactccagtcattttggcagaataattggctcttaaaagatctggaaagaggttgttgacctcaaacagcctatttatcccttttactacacaccctatttcttatcagatgcttaattctgtgctggtgagacagatttaatcgaagtgttttctaacctggccagcgccacataatttactcccctccctgcctgggcagggaaaaaatactcttgcattggttatggtgagtttgtaaatttccgtgccgattcccagtagcagtgctttgatctttatgtgtgtccctcagttgaatttcagctgcaagaggaccgggatgacaaacttaatttcacattctttcctgccttttatttccctcccacttttacatgaaatcacaattaaacattgcttaccatatcccacgtactgtactgagtcttctgtgtgattatctatatcctcatggctgaaagaagtagctatgaacggcctgcagatgaggtttatgtctattaagtaatctgctcaaggtcacagtgctgttaattgtggaacccaacacaactctgacatcaaaacgtatggtttttattgctaggcaatacttcttggtcccttttgtaaaaattggatattactaatatatttgacggtagaaactgtggagttataggaaattagaaaattaaaaataatcacaaccaaacgtgaatcttaactaagtataaaatagatgaattttgtagaggagtcccaccttattctgttgtatgttctaaaaggtttgtagatgtctatctgtggcgtaattgtaatctgaaactttgtgtttagtggcaagaaaagccgtcccacagcattaagagattctttaaaaaattaagacctctgccaggttcggtggctcatgcctgtaatcccagcactttgggaggccgaggtggacggattacttgagctcaggagtttcagaccagcctgtgcaacatggcgaaacccgtctctactaaaaatacaaaaattggctgggtatggtggcatgtacctgtaggcacagctacttgggaggctgaggcaggagaatcacttgagcccaggagggcaaggctgcagtgagctgcagtcacaccactgcactccagcctgggcaacacagtgagactctgtcacaaaaaaagaaaaagaaaaagaaaaaataaccttatttctgagaaaagtgtgtgaaaattcctctcatcaaagtgatttttagattacacctttggaaaggacacataaatattaaatttgcatcagacatataagcatcagaattctgaaagtgtgactttttttctctgttgtatctcatatttcctaatgcaagtgtgatgaaacaacagattgaggaagcttgcagtgttttttttgtaaataccaaatgtagagaagtcaatttctcacataatagaccaatatcctaagttgaaccttggattgctttaggaaaccaaaaacatgtagactgatttatttcatccattgggtgaaataaaaatagaaacgtgcagttcttaactttaaatgaattgtataataggcaagaaaaaatttcaaagcataaacataatcacattgaatattttcctttttatttgagcaggtctggtgtggttaccttttcatttggggataccataatagttgtaggtgtggtttttttcatactgatctttgcagctgaatttactgtgttctgtgcagaatggctgttgatggtgggtgtggggacactggagactgggaaggtcgctggaaccatgtaaagaagttcctcgagcgatctggacccttcacacaccctgatttcgaaccgagcactgaagtgagaaacgtttatttttaaataactgctctaatagttttatgtttcaaaactaatagaatgcttcttttttaatttgctcttacaatgaaaatactaataaaattgttttgtgaaactaaatttttcttaaaatatgagattgaatattcacaactgattttgtttgaatatttgagtcttaacatttctcatgtaatataagttgaaaatttttgtgagaaaaatctaacttcatgacctcatgtaaaaatttaaaatgctttctgaaacatactccccttttgtagtgctactgtgagaaattaattttgataggagtataggtgtgcttacttaaattttgaaatttagttggaatgaacatcttagctttgagtataattaattgcatgttaagaattatgtaagtactaaataatagaggcgtagaattttggactgatagtgtctgtcttaaggcaagtgttcacttatatgtcacttttttttattacagggtagggaaaagtatagcacatctttatgtgcttttgtatttataaaaagatagtattttgaaatagaaatattgtgttactcccataaattaacgtgcaaactcttggtttggcccagtgtctcatgtgaataactttctcctttaatgctgggcagaactgaaagcattaaaaataaaaaaaaaaaaaagaaaaagaattgaaagtattaattctgtctttctttagataacacaccatattttcttgtgcttctaaatttttttttttgcctgataatttaagattgttacttctgttaaatgattgtatttctgctgataaggaattttctaagagttttatatgttttcgtgttatctcatgttttgtgagtttcgctcactttattcaaaaggagatgttggccaggtaaggtggctcacgcctgtaatcccagcactttgggaggtcaaggcgggaggatcacttgagcccaagagttccagaccaccctgggcaacatagagagaacccatctctaaaaaaaaaaagaaagaaaaaaagaaaagaaaaaaaaattagctgtgcatgatgatacatgtctttggtttcagctactcaggaggttgaggtgggaggattgcttgactgcacctggaggtggaggctgcagggagctctgatcatgccactgcactccagcctgggtgacacagtgagaccctgtctcaaaaaggaaaaaaaaaagcagctgttactctttccccttccatctgccgcagatggagttttgcttttgttgcccaggctggaatgcaatggtgtgatcttggctcatggtaacctctgcctcccaggatcaagtgattctcctgcctcagcctcccaagtagctgggatgacaggcgcccaccaccacacctggctaattttttatatttttagtagagacagggtttcaccatgttggtcaggctggtctttcctgacctcaggtgatccacccacctcagcctcccaaagtgctgggattacaggtgtgagccacagtgcccagccctgttactctttttaccttattgttttactcctttaaacactttgggcagtgcttgatcctctgttttttaaatttttaaacttttatatttttaggaagtcagttaactgaatttgatgttctctatccctttgcaaaaattaaaaaacaaattagagatagttttccttgttaaaaataccctttaactttcatacaataaaaggcaatttaaaaacattaatggccggacgcggcacctcatgcctgtaatccaagaaactttgggaggctgaggcgggcggatcacttgaggtcaggagttcaaggccagtctggcccacatggtgaaaccctgtatctactaaaaataaaaaattagccaggtgtggtagtgcacacctataatcccagctactcgagaagctgaggcaggagaatcacctgaatctgggaggcggaggttgcagtgagccgagatcccatcagtcactccagcctgtgtgacaagagcgagactccgtctcaaaaaaaagaaaaaaaaaaagaaaaattaacattgaaacttcctgaaatcattagagttttagaattcctggttcaatagaattcacaaatttcaaataattgagcaaatacaaagtctcctctttatcctagtggcattttttcctggaaacatcagaaactattttaaagtttgttgctttatttatagtctttgcggttatcacccagcttttaatatgcctttccattctttacagtctctccagttcttgttagatacatgtaaagttctagtcattggagctggcggcttaggatgtgagctcctgaaaaatctggtaatatatatacatatatatataaatatttttttcttctttgtgataagtaaaccttacttatctgtcatactagggaatttctcgtgattcttaaccttttctcttgagcctttgttagataagtttagcatgccaaattccaaacagtaattaaaatggtagaactttggaactttttaaattctaaagctctcagctataaagttattgataaaatttcatacttcagttttcttctctgatctttaacaaacaacttttggtgcttcctctggcaaaacgctcctaacttcaatgaagtaaataacaaaactggcaattcatattttaatgtatagtttcaaataatttattatttcttttgcttccccaaataacccagctaggtgggtaaggcattaccccattttatatagagggagacattgaggtttagagatgttgactgagttgctgaagtttttgtggattatagcgatttgcctggaattgaatccaggtcatcagttcttagttaagtgttctttttcagtgaaccattaggtcattttatgacctaataagacgattgtggacacctaaggtttgggaaagctaaacctttactgaacttatttgcatatatttagaaataaattaagtatataatttgatttaattaattggtttccttgactttttctaatcacaaagtcgctttctataaattttaatgagtttatgtaacaaatgagtagaggcagaattggtttagagttgtatgctaggcttctcactgctgtgtagaaaagtggaaatgctggaatagactctttagaaaataaagcaggtcacagccagatggaggacccaaataattggccaagggggttaaagtttaaatataaacatagccacattaattttgttaagaaacactaatgtcgcttgagtgaagttgtaaaaacttaaatatacttcactgtatttaatgtcttgctgggttctgtggggattatatgtcatcgtggtctctgtcttcaatcaatctgaagtttcattggggagataaatctcacatgaaataaatagcagtatgcatgatatactctgtggtggaatgccaaaatgacagtaccgtatcaaacataaatactctagcagtgtgagaaccaaagacttagagaaggaaagggtttatggaggatgggcattggtttttgttaggtattataaatgtacaagtttcctaaagcttattaaattttgaagccattatttgcaaatgtgacatttactaattttaagtgtaaaataattgaagattagatctgaagattagtcaccaagcaactttaaggagtgacctcttctttattgcattatagtaatcttttacacaaaagaagaaaactaagggttttcaattttactccttgttttgcttatttaattcattgtaagccccctaaaggctcattctaacaaaaaagaatatgatactagactgggcatggtggctcacacctgtaatcccagcactttgggaggccgaggcaggcggatcacaaggtcaggagatcgagactatcctgactaacacagtgaaaccccgtctctactaaaaaatacagaaaacaaaaaattagccgggcgtggtggcaggtgcctgtagtcccagctactcgggaggctgaggcgagagagtggcgtgaacccgggaggcagagcttgcagtgagccgagatcacaccactgcactccagcctgggcaacagagcgagactccgtctcaaaaaaaaaaaaaaaaagatactaatattactgattgagcaaatatttattgagcctccatcccatatgccaagcaccattttagatgctgaagatacagcattgaacaaatacagaaaggtgtttgcattggtgggactcacattttagttgaatgaaaaagtaagtatatagtatgtcaaatggtgtgaagggaaaaggtttacaaaaaggtgctattgagtacaaaggtgagcaaatgagccatacagttatctgtaggaagaatattctagttagagagaataacaggtacaaagctgtgaagtggagcactcctgtttgttcaaggactgcaaggaggctatcatcgctagagcagaagtgggttgggggagcatttttggagaccatatcagacagataatgggagatggaggggcttggagtggatatcacaaaagactttggaggttactgtaagtgctgtcgcttttactctgagtcatgaagtcattggagagatttatgcaatgagagacttgattggcttttcacctaggttactgaggctgatgcattgagaatagactaagggaagagcagagagggggaagaaacagagagactaattagattattatagtcctctagacaagagacaacgtgacttgaaacaggatggtagcattggatgtggtgacaggtggtcagattatggatatattttgaagatggaatcaacaggattagctgatggattggtggtgtgctgtgagagaaaggaatcgaggatgatacaacaaggtttttgctctaggggcgggcacctggaaagatggagttactgcaatgaggaagttactgcaatgaggaagatctggaaaagaacagatttggttgttgtgagcaagggtgatcaagtttggttttggaaactgttaagtctgagatgtctgctagatggtctatatcttacaagatggtctgagatcaccagaacaaagcacaaggctactccgaattctggccagtaaagtaggaagaaaactgaatgaactggaaaccaatttttaaaaagtgtttaaattctcatgagtgtggtgaccaactgaagaacatgttttagggtggaggaagtgacccacccagcctaatacctcagaaaggtaaggtcagatagattgagaattggtcattggagttagcaacacggaggttattggtgaacttgacaagtacagtttctgtggagtttgagaacagtcaggactttgaaagcacaaatatggataagtcttgaagatctcttggtatatagggggacagaaaaatgaggaaattattgtcaagttatttgatcatcgaagtaaactgaccaagaccagaaaagttagttattgagacttatttttttcagttttttgcatctgctgctaaatttgaatgtggttgtactgttcagaatgcatggcattattatggaaacctaacaggttttttgttttttgcctttccctgctttttaaattgcatgctcttgattcaatatcttttaagatactccttttacaaatacagcctacccatgtgtgtgtttttataatatatgtcttataatagttaccatttctgaattgtggcatgcttaatattaagtaaactaaaataaagcttgtagaattgcttttaacaatattttgaaaaaataatagcaagcatagtaaaattaaagtatccatcaatagcagcaaagcaacaaattttacaaatgtgtttatggaattatatatatatgtaaaatagtttcaatccgtagaaattttgagttgttctcttttggttatagattatttgaaactgagtgattgtacacttttgacctgttcaagaactctgaattttatataccttgcaagagtctttcagccattgaatacaaattacacagaatttattactgagaatttgtagacttaagactacattgaaaacaaatgttacgtttttaaatgtgaggaaacttctgcttaattggattgtttttattcccacaggccttgtctggttttagacagattcatgttatagatatggacactatagatgtttccaatctaaataggcagtttttatttaggtaagttttaatatcttagcggttttctttttttaagctctgataatcatttgaacttgtacattgcagtttaataatttttaaaaatgacttgagaggataatactaattttattttaaaaaacaaaaactaccattcccattgtaggtaaagttttgtaagaaaattttgggcatcttggtgatagtagttatgtaaacaaatacatgtttttgttttttcgaagaagtctccttccaaaggtttatgtgatttttgggaatatcctcaggttaactgtgctctgaagaaaggaaagaacggtagctcttcctccagttgatgtcagaagagaatactcgctggagtattaggccctagtgagagattggcagggatttgtgagccaaggtttgaatggtgactggagcaataaagttgggaaagagtttgagcttttcctacaaggggaaagaaaatggaaagtcgaggagagaaaaaccagaaccaattggaatggaacaaagagggatggttaccttaggcatatatggaatatagagaacatcaaggagtgatttgttaaagatgagtttaagaagagaagtagaggccaggcatggtggcttacacctgtaatcccaacactgggaggctgaggtgagaagattgcttgagcccaggagatccagaccagcctgggcaacaaagggagatttcgtctctacaaaaaaattaaaaaattagccgggtgtgcacctgtggtccctgctgcatgggaagctgaggtaggaggatcgtttgagctcaggatctggaggctgcagtgaactgtgttcatgccactgtactccagcctgggcaacagagcgagaccctgtctcaaaaacaaaaacaaaacaacccaaaaaacaaaaactgaagtagaccatgtatccagacatgaagaaatgttcattcatgaatttagtatgtaatattgaggggtttgagtagtttaggtaaaagtgtatatttgttagtcaaagatacacagagataaggactttttttttctctctctatttaggaagtttgcatctgttactgacagtgctcaaattgttctgggtatataggataaagttgagctagcaaaaaaggtaacattaagtttttggataggcataaaacctctacattatctttgtggaagatcttaatgggactgaagtatggattaaaataagttaatgaagtgttgtaattgcagtgtgacccttaatgtttaacttttaagctttattttttgtttattttttaacctttgaaatttcccttctctatagcaaagtttgtgggctctgtccagcttgtcaaattttgagttgtgaattctctgaaaaagataccactgaattgatttgttattgatacaggccataccctttaatttgtggctaaaatggttgaagatggtaataacgatatgtagcaagtacttctaaactatccatattattccatttaatctcagcaacctcagggtaggttcttgtgttcaaggttaaataatttgggcagagtgtcctgcaaggatgatgtgtgtgaaaggccattttattgaggtggagcaatctgattgtttcatcctggaatggtaaattaacaaacagttcccagaaaccatctaggagttcttttgtttgggccgtgccataaaagcacatagaatatattacttaaaataatcttagaagtctactttatcccttttacaaaccaaaagagctttctgtgtgtggagccattgaatgcaatactgaaattaagttctttgatttataacagggccttttttatgtaagttagtacaaagtgaagataaaacatttaccaaaagttttgaatcaaaaaagaacagtgctttattggagagaaaaaaaattggcctggcatggtggctcatgcctgtaatcacagcacattgggaggctaaggtgggcggatcacttgaggtcagaagttcgagaccagcccggccaacacggtgaaaccctgtgtctactaaaaatacaaaaattagccaggcgtagtgactcatgcccgtagtcccagcactctggaggctgagacaggagaattgtttgaatctgggaggcagaggttatagtgagccgagattgtgccactgcactccagcgtgggtgacagagcgagactctgtctcaaacaaacaaaaaaaaagaaaagaaaaattgacatgctaaagtgtttttctttgaaatttcagatttttttctaataagcacacgatttattattttcatttattttaaaagtatttactgtgtgctaggtaggaaggaatatgaagagagtaagaacatggtcactttcatccaaataatagtctagtgggtatgatagacgtgtatgtagcaaatatgttacgaaaaaagtaataatgttcttattatatacatggagtgatttctctgaggagaatatggaaatattaggaaagaaaataccatttgtatagaacttagaggaggaaattcatatcctttcctatctatatgtgtggttattgttttaagagtgaccttttgaggccttatatattcagcttctgtgatgtaatagtaacatttgcaattttagctgacacttttggtattattctttctttaaaaacttggtgccgggcatggtggctcatgcctgtaatcccagcattttgggaggctgaggcgggcagatcacctgaggtcaggagttcgagaccagcctgaccaacatggcaaaactaaaaatacaaaaactagctggttgtggtggcaggcacctgtaatctcacctccctagagactgaggcatgagaattgcttgaacctgggaggcggaggttgcagtgagccgagatcgcaccactgcactccagcctgggtgacagagtgagtgagactccgtctcaaaaagaaaaaagaaaaaaacgtggttacagcctcttttttttttttttttccattttatatacggtccagtgaaattttttttttctttttttttctttttcatgcagcttcttaggggacacaaaatttgctgcttaatcagcacacacaggaagaaggggttaaatgaaggttcttgcatcccaaggatgaatcttattgtgtatatttcagccaagacctgtggagtaacaccataaggttctgagctctaagagtgggataattttttacagtggaaagtggccaggaatcatagcattattatgctttatctgggaggaagaacactgttcagattttctcttaattaaagcaatacttaattagacttatgttaatttggaccattagcaagggttgacatttaaggttaaatgaccgtttaccaaaagttattactgaaatcaaaatacttaggcaaaaatattccttctaaatttcctataagtaaacttactgtgaatttacttttatgtttgaaaataagttatgtagatcatatagatttataatatgaattataatttaaatatttttcctgtaggcctaaagatattggaagacctaaggctgaagttgctgcagaatttctaaatgacagagttcctaattgcaatgtagttccgtatccttttgacaaaaagaaaattacttaatttttaaaagcttttttcctttattataagagatatttaacagagaatacagataagcaagagggaaaaaaagtcagcagtagtaactttattactgagataactgctggtaacattttgctatctattcttccagtcttttctgtatggttatataaatattttttgggccctgatttttaacttaagtttataaagcctgtttcatcatctactttattttgcattattgcccttaatttcagtatcaattacatatctcctttactagagtgtaaattcctaggctggatccaattaatctttgtttctttatagtagcagacagagtagacagtcaatatagtattagccaaatggaaggtacatcacagtaaatttatttttacaagaaatatgtttttaaaaaggagtatttacactgtagtttgaatttagatctggagaacttttggcattttatagaaagtcagaagatgtgatttctatgtagaaagtcccacagaatacaaaatcaacataccggtgaacttgtgaaagttaatgtaaaatacaatgccatttacaactgcttagaaagaaaaataaatacttagatgtaaactacaagataagtaagagatttatatagtgaaaaactacaaaatgctgatgaaagaaaccaaagaaaatctaaataaatggagagatagtccatcttcaaagattggaagattaaatatagtaaagatgtcatttctccctaaatttgtatacatatataccatagtttctattaaaatcccagcaaaattgtcgatatagacgatcttctaaaattttatatagaaaagcaaaggaatacctactacaaatctgaaaaagaaagtgggaggaatcactatccaaattctagacttatatagctatagtaatccagactcagtggcgttaccagagggatatatagatgactagaacagaatagggaagccagaaatagccccatataagtatggccaatttgtttttgataaaggtgcaaaacagttccaatggaagaagcatagtcttcaacaaatcgtactggagcaatttcatatccatagttaaaagatgaattttgacctaaacatacaaaattaactcaaaatggattataggtgtaaatataaaatataaaatgagccaggcgtggtggctcatgcctgtaatcccagcactttgggaggccgaggtgggtggatcacttgaggtcaggagttcgagaccagcctggccaacatggtgaaaccccgtctctactaagaatacaaaaattagccgggcacagtggctcccagctactcaggaggctgaggtgggagaatcgcttgaccctaggaggctgaggttgcagtgagctgaaattgcgctactgcaccccagcctgggcgacagagcaaggctccatctcaaaaaaacaaaaaaaaaacacaaaaaaccataaaacgatagaactttagggtttggtggagagtgcttaggccacgtcaaaagcaagacctgtaaaaggtggggtatggtggtgcagatcactgaggaagcagtgagcttttatcataccactacagagtcctggctgcttgggaggctaaggtgggaggattgcttgagactaggagtttgaagctatagtaggctgtggtcatactgtgaatagccactgcattccagcctgggcaatgtagtgagacatcatctctaaaaaattaaaataattttttgtaaaagcatgagccataaaaggaaaaaattgatacactgaacttcatcaaaattaaaaacttgctgtgtgaaagaccctcttaaacggatgaagaaaagccacagactggagaaaatacttgtaaagcatctgatggaggactcatatctagagtatataatgaactctaaaaactcaacagtaaaacaaaaaaaaattcaattagaaaatagacaaaagataggaagagatattttactaaaaaggatgacgaaaagcacatgaaaagatgtttcacatcaaactaagaccaccatgagcgatactgttacacaactattagactaaaaaaaaaaagccagtctcaaaaggtcatatactgcatgattctgtttatataatactcttgaaattacagaattatagagatggctgggtgtggtggttcaggcctgtaattccagcactttgggaggctgaggcgggaagatcacttgagcctggttgtttgagaacagcctaggcaacaaatgagaccctatttctgtaaaaactagaaaaattacccgggcatggtggcacatgcctgtagtcccagctatgtgggaggctgaggcaggaagatcagttaagcccaggatgtggaggctgcagagagatctttattgtggtcgaatagttatgtgtgttgcctggggtggtggttacacaaatctatgtgtgtttaaatgacagaattataaacacacattgtaccaatgttctgttcatggttttggtactgtactatagtaagatgtaactgggaaaggtgcatggtacctacctatactatctgtgcaacttactgcgaatctatattatttcaaaataaagagcttaaaaatgcaaatacaggcccctgtagggaaaaaggaagagttggtgggggtgggttggttagtggggggcactcagtttgtctatccccattatgtgggtctgggaaactttgggtattttctagaaatccagattagatttcttagtctggctcttggttccctgattgccattcctccactgtttgctttgtttcttttttgacctctttctagctgtagcttcgttctcctgcttgcctagcattcaaagggaatagaggtctgaatgactgagggctagaattgaaattattgttcatagctttatttgtaggcaagaattaaaaatctagaggaagcatgtattgtcccttttttctatgtattgtcccttttttctctgtattgcttttaaaaaatttatagtggactatttatcttaactttagagaagctgcataatttataaattattaaacaattgctccattcattagaaaaattaaaacaagtttttgcacacatgtgctattaaaacattaagtgctatattgactcacccacaatcagttttgaatggagtttcctttttagcctccagggatgggaagactggtaataggatttggtagggtaacttgaaaactgagttaaatgagaaaggtagaaaaaattcgtactttttctcctccccacaaaaaataaaaacagtaaaatctttaccaactgaaaaagctgttgaaattttctgtatgttaaaaaaatgagctttgcagtaactcttaaaatcacctagcaaaataggaactataatgtgcatctttccttcactaaaacatttattgcatctcttcttgatgctgatgattgaggacacacattctgctttcctggggcttatggttttatataaaaaccaaagcaaagtagaaagtatacctcctaccaagggcataaatataatgatataggggttcaggaatgagaaaaagtaagtagttaggggaggaatggcagaaaagttttgtcagaaaggagagttgtgttcatttagtcagattccttgaattccactgatgtgaacattgattacttatttcttgttgtaaatatatgcagagtgtgttccttatggcattgtcaaattcattttagaaattaaaacttagctgcttaagttcctttacttgtattcagacatttcaacaagattcaagattttaacgacactttctatcgacgtaagttttttacttgaaattaatgctcactagattcttagaattttttagttggtagctattcaaatattgctagctatttcaaggctatttcttcacttgctttcctctctcactgttggcttttcagtaatgttgctgatagactgaaaagagaatgctagttttagctgacatgaccagctacaagtttctatgcttacctgaatgagagttcactcaaggaattggagctctgagaacgtatgtgggattacagtaaaaagtgcttgtggtttttttgttggtttcttagaacgtgcaaattgttttctgcaagtgctttttttttttaattagtaaactttattttttagggcagttttatgttcacaacaaaattgaacagaaaatttttgaaaacttgggttctcatagagcttcctgttcccacaaacacactaccttcctaatcaacatcttgcaccagagtggtacatttgttgcagttgatgaatctacattgaaagatcatcatgcaactacatatttaaaaactaaagttgcttttttttttttttgtagaatttcatattattgtatgtggactggactctatcatcgccagaagatggataaatggcatgctggtaaagactttagtattgttatagttctctgaagttcttgctgctgtgcttcacatccccaaaattagaattgatatatttttgaaaaatcagagtttaatttttaattaagtatatttacttcattgtttattgccagtcattggttttcaggtgaagacacaaattgttattataatcccttgatttgatacattggtattcaatagcacaaccgactcataggattacttgaaagcatacttcttcttttgaattcttatccccttctcctttaaagcccttcaaattgttttcctagatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggtaatcaaaaaagcacctgcatttcttttatagtatcttggcatggaattagggattaattattaagtctagttaatatttaggattgttaattagaagtggccgtattttaaaaattacactaagaagaaagataaaatatgaaattctgctctatttgaggaaagatatgaaccgagtacattgttttgatactattctgctttcataatttatttgtattttttatttggggagtaggtatcaagtagaattacaaagttgtatattgatgtcaagctgtaatctatgtggttttcacctgtatttatttcagggaaataaagataccagggataagaatgatctttccaaggatggggctttttggtttacatatccactttaaagaacacttgaaattttgaataataaatgtaaacaattttatgagtattcacttgggattcacttaactctgaacttgcttttgttttggtttgctttatacttaaatattaggtaaaaataacaaggtgttcatatttgagaaaatctgttcagtatttttcttctcatagtctaacaaagcttaaattttataccttgtaaatgtagggcaaacctgtctttacaggcaggtcagcctaagtgaagtgactcagttaatctgtattatagtttgagaggcatttttaatggtatacaatattttgagttgaaacaaattgtatgaaattgttaagaactagatcataactggaagttgcattttaaaataattcgtttaaaattcactgaaaaggacaaactgtggttttaggttaattttcccatgtgcaccattgcatctatgcccaggctaccagaacactgtattgagtatgtaaggatgttgcagtggcctaaggagcagccttttggaggtaataaacctaatttaataatctagaattacataaaatacatattttttctatattattcctttggataatttcattaaaaacattgttttgtgattacgtattcctgtcttctctctctctctctctccctttttttttttaaacagaaggggttccattagatggagatgatcctgaacatatacaatggattttccaaaaatccctagagagagcatcacaatataatattaggggtgttacgtataggctcactcaaggtaagtcagcaaattgtcatgaattatgatgttgggatgacttagggctgggatgctttcaggagaataatcgataagtgagtttagacagtaccatccacttgaagttcagtaaaggtaccatgtaattcatactacttattagctagggggaatttaataaaattattgaatcttacttacttaggctataagtcatccaagtcaaactgtccattttatcttccactgaattcatcatctcttagagacagtctatttcacatttggacaggactgttagacaaatattctatatattgaacagaaattgtcttcaggtcagctgcggtggcttatacctgcaatcctagcacttcgggaggccgaggcaggcggatcacctgaggtcaggagttcgagagcagtctgaccaacatggcaacaccctgtctctactaaaaatacaaaattagctgggtgtggtggcacatgcctgtaatcccagctactcaggaagctgaggcaggagaatcacttgaacccaggaggctgaggttgcagtgagcctgagattgcgccactgctttccagcctgggcaacaagagcaaaacttcgtctcaaaatagaaatcgtcttcagtttggtctgactgttgtcccagtactgtatacagtctaattcccttttaagtaatagcttttaacatattgaggacagtgatcacatcctttgcaaatttttatcagtgccataaacctccctagttagttcctttaaccctgtattagttcattttgctttgctataaaggaatatctgaaactgggtaatttattcaggaaagaggtttatttggctcatggttctgcaggctgtgtgagcatggcaaaagcatctgcttggcttctggtgagacctcaggaagcttttactcgtgaaagctaagggggatggcaaggcatgtcatatgacgagagggagcaagagagagaggagggaataccaggcttcttttaataaccagctcttgcgtgaacttaatatcacagggagggcaccaagccatgcatgtgggatctgccctaacggtccaaacacctcccactaggcctcacctccaacactggggatcacatttcagtatgagatttggaggggacagatatccaaactatatccaaccctttgatatgttgtacagcttcaggttctcatgttgtttttctgtaaccatattccagctatccatattggttaactggaatatagttagagaaaacaacttttcctaattgttcaggccaacatgcagcattatgggactggtcttaactttagataatagacttctgataactgatgcagtcttaaaggagagcaggtatttatgttgttgtttttttgtttacattgatgctatactttggattctttgatgttactagccactgaaagctggatgttttgtccacatatgcaattgctaagccacatctgcctattataaacttggcagtttggggagtgtctttttttttttgtttttcttaatatccaagtataggtccttacaaatgtattcttaaaattcaacctgtttttctctctttatatgtattctgccaacttacctggtgtttctagcttcatttcacctgttttgataattatatcctttatttctttttcaaataattgatgaaaatttttaataagactgaactctctgagaacagacatctgaatcatacttctggccaggcccttttaggtttatctcattctgttcatcagaccttcttggtactttgtatttctttatcttgttcacaaggatgtcatgaaaaacctttccagatcctctactgaagcctaggtatgctatcttttgcattttcctgagttgctaagttagtcatagtagccaaatgaggctactccaacatgatttgtctagtaaccagtcatgctcaatcatagtgatcaatgtttccaatctagttatagtttccttttttagaattttgcccaagatcattaccaggttcaccagaatgagctttgtcttctttttgaaaatctgccatttctctcctgtgattatttccttacatttactgatctagtaatgtcattttaaaattccatttatacttactccttgttgccctctgcattctccctacacggacctgctttgtgttccttgaacacaccaagttcttctgtaccttagagctttaatactcccgagttcctacgccggggatggtgtttccttggatcccctcaggctggctcctcatctcttaggtgtctgcttaaccagttttcctaatcattcaacctaaaatgacttctgagccattcaccattctattttttttggtaattgctcagaactgattaatggtagcctcattctcctatgcaaagaatatttcacacttaaactatcttacatccttgccccaggaccaggaccattgccattgctgtttacaaacagctttttcttcaggtaattgcatggctggatctctctcatggcttaggtttcagctcaagttatcacctctccaaggaggccttccctgaccattctctctaatggactgcatccatcattctcagtctaacacatacctcattttcttcatagaacacttcaatatctgaggtgttccaagtatttacttttgtgttatctcccctatcaaaatgaaatcactatacgagcagatactttttttcattgttactatgcacaacacctagaacagtgtctggagcatgtgttacacatatttgctaattgttagaattaacaaacgaattcagtgtgttctaaccagaaactgtaaactccccattttaatatgtagtctcatccatccttctttaccttttaccagggcttggtgtgtactttctaggctggtgaatgagggcctcaacaaggagtacagaaggagaattggaagtgaagttgcacaagccagtggttctatctattctatgatttttccccttgttctcagtataacagaaagttgcctttctgcccactctagctttttttggtcgaagggcaggggtatgggtggcaggggttggagaaagaggggagtcctcatcattttggcaatgttcttactgggcagtgtctcttacacgcttcactgtttgtgtctaccacttcctcctttcagtacatcctgctacatgtggttcagtggagagcttccagtttaaccatcatgcagtttatctctttttaaatttcctcttctccaaaactatagagaatcatatggtcacagtcaactttttaaaaaagctttccagccttcgtaactgtctttctttcatgtcttcttagctacttgctgtttttccttaagtttttgaaacctgactatacttggagtcttgggaacacatcttacagtgtttcctcacactgtgagataaaatggctactttttcttgaagtttttgtcttctaaaatgaacaattcaaatatagttataaaatggagtatttattttgtacttttaaaaaatggtttaaggtgaggctttgtttattcctaatatgtgaataatactgatgtgaaaaatgtgagtcccagcactttgggaggccagggcgggcggatcacgaggtcaggagatcgagaccatcctggctaacacggtgaaaccccatctctactaaaaatacaaaaaattagccaggcgtggtggcgggcccctgtagtcccagctacttgggaggctgaggcaggagaatggcgtgaacccagaaggcggagcttgcagtgagccgagatcagatcacgacactgcactccagcctgggcgacagagcgagactctgtctcaaaaaaaaaaaaaaaaaaaaagaaaaatgtggggttgaagtagagaactgtatttaatattttgtgtagcctcggttgtagagtaaaagataataaagggcagcttttcttttttttgaatgtttgtgaatcaagtgactgaagctgttacaggaataattagataacacttattcttcatggtgtatcagttaatatctgtgttcatatgccaaccccacctcttgctaagtatatagctgtggataaattactaaatttctctcagtctcacttttcttatgtttaaaatcagagtaattaacatgaagatgttgtgaaaattaaataatatttagtctttacattgtgcctggaacataatactctaaattgttaactattatgatgttattgtttcacctttctatagcacttacttgagagagttttctttgctactgtagcttaagattctgaatttactacaaagtgatggggatgtgaaagattgtttcatggttaaatttattttctggcttgaaagtctgaaaaatcaagttttagaaaatggtatttaataatcatgccttctaatttaagagaactcttttattttaaagaaatgaccatattttaattgatatgttttttcaggggtagtaaaaagaatcattcctgcagtagcttccacaaatgcagtcattgcaggtgaggaagaaaaggccatcacttagtttattttgctttctttagtttttgacgttgctgcagcttttttgtgttgtaggaatttgatatcttcttggatgggttgtgtaactaagctgtcgaaaaagaaccagttattagactttgcatattttttgtcttacattatgtcttaagttacctgcagtaaagagatgttttagttccatatgaagcaggccatttattaatctgataaacaagaaaaacatgtagtgttactctattacatgaatcacacaaaacaatgtaaaatttgttactgtctcagtttttaaaaattggaatatgtattttttaatgaagagccaatgtaaatttatctgttctgatttataactgacttttaacatgcctaatttccattgagttaaagcacctgtattttctcctcccttcagctgtgtgtgccactgaggtttttaaaatagccacaaggtaataggtttcatttttaatatgcatgtaaatttatgttttgacttggtttaattatataaagatgaacattttttcattacagtgcatacattcccttgaataattacttggtgtttaatgatgtagatgggctgtatacatacacatttgaagcagaaagaaaggttagtagtattaagaacacatttttgatcatgcatattttgatttttaaatattattggttagaaatttgaacaaagtcacccatacattttctaacttccagaactctacttattatatatcttttgctttatagcctgaaataactctatagcgaagtaatttacaagaaatggtctattatgaaaagcaggctttaaagcataaaaatttttttataggaaatatgcatgattataaaacaacctgatttttattttattgttcataaaagagactaatattggtgcatgtgctgctgtaatttgttgtgtattatgtgtgtaggaaaactgcccagcttgtagccagcttcctcaaaatattcagttttctccatcagctaaactacaggaggttttggattatctaaccaatagtgcttctctgtaagtattgtagatttttgttatgttgtaaaaatcatttttgtgatttttgaaaccttaaaaaaattatcttttgataaaaattatgtttgatacttctctctcatcataatctttaggcaaatgaaatctccagccatcacagccaccctagagggaaaaaatagaacactttacttacaggttatcaatgtgtattttaaatttttttcagaaaattatatcaagttttattttactttaatgtgtcttacattaaagtaattttgttttctagtcggtaacctctattgaagaacgaacaaggccaaatctctccaaaacattgaaaggtattttacataagggtatttactaatcattttctttcttttctctctttttggtgaaagtaatcagtgcttgttctagatttcctcttaatgccttgtatatggtcaggtaataattacttacaactttagacatattaatagaattaattgctcttttagtagaatattttaaaatctctaagaaatcaaatattactttgattaaagaggattggattttgatgtttttctagaccgtaatactctatagtttgtttacatgtgtattatcctttctgttgagttttttttgcttgtattaattatattttttctgttttagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgtacttctttcactgaagtttttaaaagtacattaagggtaatcagtagttccatggtaatataggaataatttttaaatgtgtagcagagttatatcaaatttttattgcacttaatacttttgctacagcaatttctatagtaaaaatttactggtttaatttaactttctgtatcaatataattttttttttttttttttttgcgacagagtttcgctcttgttgcccaggctggagtgcgatgatgcaacctcagctcactgcaacctctgcctccccggttcaggcaattctcctgcctcagcctccggagtaactgggattacaggcgcctgccaccatgcacggctaattttttgtatttttagtagggacggggtttcaccacgttggccaggctggtctcaaactcctgacctcaggtgatccacccccccccgcccccctcggcttcccaaagtgctgggattacaggcatgagccaccatgcctgaccatgtttttgtttcttttaagtgaataaaacttcaaacaaaattaagtacaaatactaaaaaagtaggtgctagtattttaatatgagaacatgtatgtgttctcattctttgtttttgacttagatatggcagttttctgttcaaatgttttttggttacttatgtgtcactgagttaagttttcagtaatctttctagctacatattgacaaataagttttattataaaaccatacggaataaatttataagctctacctgaaaagttacaggtgtagcttacaattttgaaagtgaaggaactaaaatttagcaccatataggtgctataataattctcaaagtagcattgtaagaaggtgactctatctgagagctgaataaatagttttagatggtttaggtaggtcatttcaccaaagctgtacaattagaagtcttggaactgtaactgtacagctaatttcaacccgaatctgccccaaatctcctctgcagactacttagctgtttgaaagtacttgagttacttggtactacttgtgtacatgactaaattgttagttttaacatgcaagtttttactgtagttagataaaattattggaagatgattataacttcttaaggggttcaatctgattttttaaaagaaaaataattcttttttgcagagttccttgcagtggggtaaaatattcaaatatgggaggcaggcatataaggtaaataatcacagcagggagggtgtaataggatgagtgataggggtctgtggcaaactggagtgagtgaaaattatttggtgaccactctggctgactattcccatgcttggtattcatatttttcaaaagcagctggaaatctagatttttgaatgaaatctggcttttagttaggattttgtctttaacttgggcccaaaccaaatatagctgcagactggattaggaaggccaccaatttaaggtattttcccatgtccaaatgttcgaagagaatgcacacagaaaaggttatgttttaagtaatatgcacagtgcacattgttaggataacagctttagtgcttcctaggtgtcttagtccatttggactgctgtaacaaattgccataaactgggtggcttataagcagtagcaatttgtttcttaacagttctagaggctgagaagtccaagataaggagccggcagatttggtgtctggtgagggctgctattctggcttagagttggtgccttcttgccgtgagctcccttgggcctctcttataagggcactaaccccatttatgagggctccatcatcatctaatcatctcctaaaggctccccttaatactgtcccattggagattaggtttcaacataggaatttgtgcaggggacaccgacagaccacagtattaggggtattttgactgcagcaatgagtttactactattttgagagagaggttgtgctttatgcaccatgtgttccacgagttggacacagtgttcatacgtgatcctgtcttttaggcaagcccaaacaagtgtttctccttacaataccaagttaatacagagcttattaaatatttgagacaaagggctaagagaagtgtgaggcccaatttccctttgcaattattgctggcaaggtgcaagcttttagcacgtgaactattttcctggaaagcacacacacgaaaacttgaatattccttccggggaaatcgacctctatcggtagccatagcttccccttcgctaagaactgctgtaagcacgaaatcgacatcaatagaaacccttccgcgttcctcggtaactaacggcaaccctgcgctcccggatgtgacgtcaacgttcttctgttcttccgtctgtcgaccgaactctgggctcgtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggtaagagagagaggagcggggttcctggctcccggaggctgctgttctcttgatgcaggcaggttaagtggtgtagagaggggtccttccttgctgagagagttttcaggaagtaatttctccccggcccgttccctaatgctgcttcagcctccaagtcggtctttgctgttttcctgagggaaaacccagatccaggttcccccttgtctttctttggtcctgggtgcgaggcttgtggacttggatgacaggggacttggttggttggtcttgccctcaagctctccctcgacgcagcttccaagcacaaccttcccgaacctgaacctcgaattgcttcgcgtctcgggcactgttgggatccaaggtctgaagtacgtaaatcatcagggaagggaagaacaatcgctaacagtcagtgaacatttcgcgcttggtagcgcgtaatgtggttttatgttgttgttgagacggagtctcactccgtcgcccaggctggagtgcagtggcgcgatctcggctcactgcaacctccgcctcccaggttctagcgattctccttccccagcctccctagtagctgggattacaggcgcccaccaccacgcccggcaactttttgtatttttagtagggacggggtttcactatgttggccaggctggtggaactcctgacttaaggcgatccacccacctcggcctcctaaagtgctgggattacaggcacgagcctgtaatgtgcttttttatggccttctcatcttcagaacaactcccagagagagcttggtttatatccgtgttttacataagaggaaaatgaggcccagaatggccaagtaacttgctctaggtcacacggcggaggaggattagaatgtgccggaggtattagccggaaaatgtgtgacccaagatttctggatggtatcacattttatttctgaatagccaagtctctctttgcagtttcattgagctttatctttcagggatcttcattcagttgcttttgactcttaagtctaaggaacagttcagcatttgatgtgtggggtaaagatttgctggtgttgggggatgtgaacctttgtgtgaaaaaggataagagatgtacttgactactcctttctggtttctgttcttaattttacatcattgaaaagtcaggacctaaatttgaggtacctcagtttaagatattttggtccatgtgtgtatgtgatgatcctctttactttttacaagatgtcatataaccttgctggagtaactctgttttttcatatgtgccccagttaattagaattactaaactttagataagatagaatataggttttatatataaggatatttgttttcggaaaatgcccatagtcttcagaatggtataatttagatggataccaaataaccctgggattatataaagtattctccaagaggcaaaattaattcctgtcatcttttgaatgtatttaaattaatcagacataatcttggttgttcatttgcatatttaattttgattttctctggtttggatattgtgcaaatgaatgtgtagaactatgcctccaaactgaagttttctacatacttttcatcctaactgcctttgaagtcatacatatatttacatatatatatatttgtttttttgttttttttttttttgagacacagtctcactctgtcatccaggctggagtgcagtggtgccatctctgttcactgcagattctgtctcctgagctcaagtgattctcgtgcctcaacctcccgagtagctgggattgcaggtttgcgtcaccacacctgcctaatttttgtaattttagtagagacagggttttaccatgttggccaggctggtcttgaactcctgacctcaggtggtccgcccgcctcggcctcccaaagtgctgagattacaagcgtgagccactgcgcctggcctgaagtcatattaaaggatagattctactataaggcttgatagtttttagaagcttttagttacttgtgctctctccaccaacttctaattgtgaatattttgtgaatattttgttcagccacattttaatttgaaaaagaaaacatttttaaagaaatgctttaaatactttaacgaatataccatttttaagatcctgattatgccatttttaaaaatcaggattttagtagtagctatttgtatgactgatatgataattaactttttccccaagaaaacagtcattttctttgtagcgcttttttaaaaaccctagtgtcaaccacctctatgtcaaagagcaatagttcttaaaaaaacacacatttctgaaatttataatgaccttgtaatttctgacataatttagaatttgagaacaaaacttcctcttagagtgggcttggagagtgggatttagagaatcagcctgtgattaagtggatgaaaatgaatttgttctctagaacttaccattcccatcagtttaatatgatcttcgggaaagaacatttgtcaccattatcttggtttgaggcttttgttgttttgtttgttttcgagacaggttctcgatctgtcacccaggctgaagtgcagtggtttgatcatggctcactgcagcttccacctcctgggctcagatgatcttcccacctcagcctcctgagtagctgggaccacatatgtgggccaccaggcccagctaattaaaaaaatttttttgtagggacaggggtctcactatgttgcccaggcttgtcttgaactcctggactcaaatgactcttctagtgttgggattataggtgtgaacctccatacccactgagttcagtttttgagtgttgccctttgtctagctcataactatattactgatattacaagtaaaaattaatatgaaactgactgaataggtagggtcatttttctgtgactgcacatggcccaacctattcagttagttccatattagtttatttcatattgataagtaaagcgtgttattatgagatgaatcataggtatcttggacttactgtgggttataaaacatatactgttacttccttaatttgttgtggggaggaataacatactcgcatctggtagtccaggccaggcccagtcttttgtctgtgctcctccttcctctcaggtggacccacaccagttttcttccgtaagtccctgtattaacttggaaactacttaatgatgtagtaagcaaggagtttagcaggtgcaaattacaggtatttcatagggtattttttctaaatttatatttatactgatttataatgatgattgaaatattaatgtaacatatatgtgttcttttttaatatttacttttttgttaaaggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaaggtaactctagtaagtggaagggatttttagatgtgctttttggagattaaatcatttgttttaaaaaatactttcattgatgcataataatttatacagatttaaaaacatacgcattttgccatttctgtgtagcattaagtaccttgaagttgaacaattattaatataatttggaatttctccaaggcaattatggtagaataagttgatacttcaatacagttaagcatgaaagttttcatcttacatctttatttttgagtccttatcacttcaaaattctgttatgcttattagtatgtcaatttgaaaggaatattttcttacattaacatgtatcttcacctcctttgcagatagatgtgccaaaaaaactaaatgttatggtttttcttgtatcagaatttgtttttacatgtttacattatttgtagcaaatattaaatgataatttaagattttaattattggtgcttttctgttattagtattttcattcatatataaggagtatatatccttatattgcttcagtttgttttctgcttatgttatttttgagatctcctattgatagctatatttcacatgaacgagaaagagaaatgtctaaggaacaaaagcattgcttaggagggacagattgcttctacctaatacatgtgaaaggaaagtgatataaattctttgacattaagtcctagttttggtttttactgtgacttttagatatacaaatttagttggatctggtatctttaatagacttctgagatgtaggatgtcttgaagaaatgtcctgtaagtgccatgtattgaattacttaattttttaaaaaagtgccagattctgttaatcaggttaaatattcacaaacaaaatgctgtgcaataatatttcaattagtaatagctatatactgtaagatatataataggagtttgaattcttagaaaccagcactaattactatcagatatttttgaatttcagtgtatttaagaaggtaagtgatttctaagttcatctaaaccaaactcaggtaagactttatttttttgagtccaaaaaggaacccttcctactccttttatactcaagtttatcaccatttgagtaggacctaaggaattagacattccaagcattactttttgtttagctttatactgatacattatggagatttaaaaattcttatgggttttctaaaattacttttagtgtggatggatgtatgtatgaatgagacagggtctctctctattgtccaggctagcgtgcagtggtgcgatcgcggctcacagggtctctctttgttgctcaggctggtgtgcagtggtgcgatcatggctcacggcagccttgacctcctgggctcaagcagtcctcccacctaatccgctctagtagctgggaccataggctcgcaccacgcctggctatttttttgatttttagtagagatgaggtctcactatgctgccaggctggtcttgaactcctgggctcaagcggtcttcccatcttggcctcccacagtgctgggattataagcatgaacccgtgtccagccctacttttattttattttatttatttattttttgaggcggagtcttgccctgttgcccaggctagtctgcctcccaggttcaagtgattcttctgcctcagcctcccaagtagctgggactacagacgtatgctaccatgcctggctaatttttgtattttttgtagagatggggtttcaccgtgttggtcaggctggtcttgaactcctgacctcaagtgatctgccctcctcagcctaccaaagtgctgggattacaggcatgagccaccatgcccggcctctacttttatttatttatttatttttactttttgagatggagtttcactcttgtcacccaggctggagtgcaagatcattgcagaatcttggctcactgcaacctccacctcctgggttcaagcgattctccagcctcagcctcctgagtagctgggattacaggtgcctgccaccatgcccagctaatttttgtattttcagtagagactggttttcaccgtgttggccaggctgctctcaaattcctgacctcaggtgatccccccacctcagcctcccaaagtgctgggattacaggcatgagccactgcgcctggcctacttttattttttaaatgcaatatgtcatattttaaaaagggtatgtgtttcgggtaaagaataatacagaaaatagacacttgtgtatccaccacctagctaaaatatagaggctttaaatttcctctttgacctcttttgattgcatccatctcccttcttcttttggtgtgtatgcagattattccagatttttgctattaccaggaagctacataaagtattcttatacatgtcgcctagtgcatttatgcaagaattttctcctctaaggtatacctaaaagtgaaattttctatatcaaagagtatgtagatccccaactagatattgcctaattgttttctcaaggggtttctcaacttacactcccactagctatttggttgtatttacttttactctcctctcagctgcctaagagttcttcttgttctggatc

SEQ ID NO: 617 - DNA, 2115 bp, Homo sapiens
agaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaatctctccagttcttgttagatacatgtaaagttctagtcattggagctggcggcttaggatgtgagctcctgaaaaatctggccttgtctggttttagacagattcatgttatagatatggacactatagatgtttccaatctaaataggcagtttttatttaggcctaaagatattggaagacctaaggctgaagttgctgcagaatttctaaatgacagagttcctaattgcaatgtagttccacatttcaacaagattcaagattttaacgacactttctatcgacaatttcatattattgtatgtggactggactctatcatcgccagaagatggataaatggcatgctgatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggttaattttcccatgtgcaccattgcatctatgcccaggctaccagaacactgtattgagtatgtaaggatgttgcagtggcctaaggagcagccttttggagaaggggttccattagatggagatgatcctgaacatatacaatggattttccaaaaatccctagagagagcatcacaatataatattaggggtgttacgtataggctcactcaaggggtagtaaaaagaatcattcctgcagtagcttccacaaatgcagtcattgcagctgtgtgtgccactgaggtttttaaaatagccacaagtgcatacattcccttgaataattacttggtgtttaatgatgtagatgggctgtatacatacacatttgaagcagaaagaaaggaaaactgcccagcttgtagccagcttcctcaaaatattcagttttctccatcagctaaactacaggaggttttggattatctaaccaatagtgcttctctgcaaatgaaatctccagccatcacagccaccctagagggaaaaaatagaacactttacttacagtcggtaacctctattgaagaacgaacaaggccaaatctctccaaaacattgaaagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgta

SEQ ID NO: 618 - protein, 442 aa, Homo sapiens
MAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 619 - DNA, 26650 bp, Mus musculus
  misc_feature (1)...(26650): n = A,T,C or G
cacaggtggccttgggatggtgacagatgctgggaggccgacagtaccaccaaatgacaggttaaaaaaaggaataaataaatgagtaattaagaaaggcatatatgaataataacagaccaggaatcgtgagtgatgatcttgtgatctcaggattgggaggggaggcaagaggatcgggagttcaaggtcatccttggctacactgtgagcctgaggacagcccacatgagacgtagtgtcgagaagaaagagggaagggggatggctaatacgggctagagaagcggctcagcacttaagatccatcactgctcttcccggagattccagtatggttctcagcaccatgtcacacagtatacaactacctgcaacactctctctaacctccacaggcgccaggcacatacggtctgcatcccttgcagcaaaacactcaacgcattaaaaaacttcctgacccagccgggcgtggtggtgcatgcctttaatcccagcactcgggaggcagaggcaggcagatttctgannnnnnnnnnnnnnnnnnnnnnnnnnnnnnnnnnnnnnnnnnnnnnctgtcttgaaaaaacaaaaacaaaaaaaacttcttgaccctatttatttattttaatagtttttgtttttttgacacagggtttctctgtgtagccctgactgtcctggaactcagtctgtagaccaggctggcctcgaactcagagatccacctgtctccacctccccaatgctgggataatagctgtgtgccatcatgcccggctccatcctaatccttgacctggatttccttctccttgcagctatggccctgtcagtgtgaaaactgaacccatggaagattctggtaggtacacttgatgctttgacaatcaaatgtttagcaggctatcctctgatggatgcgcttataaaaatgaccactaagtatttaaccataagtaggatcatatttgtagaattctaggtaagtactgctcatctgaaatgcttggtcccaccattgagatagctcagcaggtaagaactctgttccactgggagctgggatcacaagtatgtggggacatctggcccactttgtgggtgctgggtcacaaacttagccctcatggcagcataataatcctcttagccacctgacccgtgtcaccagcccccataaagctctggggtgcttgggtcttaaatcctctgaccatctaagacacaagccaaagacagcagagactggagaagcactcatccccggcgttaaccaggaaagcatagagggtggaaagccaccatgttgggactgagacgcacactccacagctcagttctgctccaccatgatgcctgcctcagttcttcctctccacttcgcctctccagagctgtcgctccccacagggccattgctaacagtgtttcccggggatgcactgggaggcagtgggacctttgagaggtggagggaaatcttcaggtcactgaggcatgcccctgcagcctggcctccagttgactgttagtgagccaaagaggactttactcttaagactcagtcctaaagagcaggcccttgctagcctggaacgtgccagacagatgaggctggccttgaactcacagagatccacttgcctcagtctctgacaggctgggagtagaggcgtgcgccatcacatcctgcttccaaagaggatctggaagagttggttcttctgtgtcagcctctgcctcctgcgtgctgcggtgactggcttatgccaccattcccaccagggagatgttcagtcagctggctgtgctgaccggacccctaactgtggtctctgttgccctcataggcacttcaccaagggcagcagccatgctaatcaagacggagtcggaagatcctaattacaacgtgtgtaacgtgcaaggtaatgcggtgccaggtccttcacaggcagtatggtagtcactcatccgaaagatgagcgggaggagcgaggggacaggagggcagctcagtgaggaagagcaagcatgaggacctgagttcaggtcccagcacccacagaaaacgcttggcatggccacaggttcggtactggcagaaccagagacaggaggatgtctggggcttgctgacctagctcctgtctccagcatctggatccagtgtcaagtgatggaacacgacaccggacatcctcctccagcctgcgcacgtgcacacagacactgcacccacacacacatgtatgaatataccacacactccacacaaaaccagagctacagatccatgtgcgctgacctagattacacaatgagtggaactcatcttcagtacagtggggcatttgtggggcacacctgtaaccccagtgcttagaaagtaaaggcagaaggagcttagcttcagggtcatccctgccttctgtcttggtcagtgttctattgctgtgaagagacactatgaccatggcaagtcttataaaggaaagcattccactggggctggcttccatttgagagacctattattaaccacccgttattgtcatggcaggaagcatggtgtttgttacacaggtaaataggatactggagaggcacacacagattcacaggcagcacaaatcaagggtaacactggggctcctttgagcttctgaaacctcaaagcccattccctccccactccacccccacgttctccaacaaggccacacctccagtaatgactcccaatgaatcatgattgggagccattttaaaatttttatttatttattatatgtaagtacactgtcactgtcttcagacacacaccagaagagggcattggatcccattacagatggttgtgagccaccatgtggttgctgggatttgaactcaggacctctggaagaggaagctttcagtgctcttaaccactgagccaccttaccagacctgggagccattttcattcaaactaccataactatctaggaagttcaagcctgggctacatgtgactctatctcaaaaattaagaaacccaagctgggacgtgagggccatctggctgcgacatctgtcacccattgaccaccagggttgattcggctgatctggctggctaggcggtgttcccttcctccctcaccactccatgtgcgtccctcccggacgacctcccccgaatagaggaggaccggtctttggtcaagggtatacgagtagctgtgctcccctgcctgaacctccaaacaagctctcaagaaacccaagctgaagagatggctcagtggttaagcagattagatgctcttcctgagacctgagtccaattcatagcatacacatgagggcttacaattagttgtaactccagtttcaggggctccaacatcctcacacagacatacacgtaggtaaaacaccaactgcacatgaaataaaaatgatgattttttttttttaattaagaaaagcttctcaaagcgacatcctgcatacagtcatggatctatcaggtaatgcagcttattgaggcaagtcagcagtctgtaaaggaccaaagtcggctgattaaagatgcaccaaacctcatcgaaaagacttccagggctggaaagatgggtcagtggttaagagcactgtctactcttccaaaggtcctgggttcgattcccagcactgacatagcatctcacaaccatctataactgcatccctgtgggatctgagtccctcttctagtgtgtagctacacctgcagacaaaactcccatatacattgtcttagggtttctattgctgtgtcaaaacaccacgaccagaaagcaagttggggaggaaagggttcatttggctttcatttctacattgctgttcatcgctgaaggaaatcaggacaggaactcaagtagggcaggagcctagaggcaggagctcatgcagaggccatgggagggtgctgcttcctggcttgctcctcatgctttgcccagccagctttcttatagaacgcagggccaccaggccacagatggcactacccaccatgggctgggccctcgcttattgatcactaattgagaaaaatgccttacagttggatctcatggaggcatttcttaaactgaggactgtttcctctttgatgactcttgctttcatcagggttgatataaaactagccagtacatacatttaaaaataaataaataaataaatctagctgattgctatggccacagcaattaggatgactgtaacaggatccactgccttccttgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgacctcaaactcgcagcctcctctctgcctccacatgtagggcaggagggtgtggcactatacatctggcctttcttcccttttgtttatttatttttgttgttgtttatttgtttggttgttttattggtttgttttgttttttttaagacaggatctcactctgtagcccttgccagcctggaactcactctttagaccaggctgccatcaaactccacaggtctgcctgcctcttcctcccaagtgctgggattaaaggctacacaatcacacccagccctctctttttagaagacaggctttgaacatagttcaggctggcatcaaagttgaaaccctctgccccagcttccttagagcagagattggaaccgggggccaccgtaccctacatctctcttttttaatcctagtaattcattttttaaaattcatttcactttttaattgtgtgtgtgcatatctgtgcacctgagttcgggtacagacatagggtaggaaaagtatcagatgccctggagttggaattactgccagttgtgagcctctcaggacgggtgttaggaaatgagctctggtcttatccaaaaacaaaaaagcgcctgcttgcttgcttgcttgcttgcttgcttgcttatttatttatttatttatttatttatttatttatttatttatttgatgtatatgagtgctctatctgcatatacacctccatgccagaaggcatcagatccctttatgggggaattgaactctggacctctggaagagcagccagtgctcttaaccgctgagccatctctccagtccactcatccccaccccccacccccccaagtagttcttaacaactgaatcctctcagccaggcagttggtggcctgtgcctttaatcccaacactcaggaggcatgggtaggcagatcgacatgagttcaagaccaacctggtctatagaaggcattccaggatagccaggctacacggagaaaccctgtcttgaaaaaccaaaacaagtgagtcacctctccagcagcccctccccaccccatagcagtcgattacaaagttaggaagcaccatcaccacgtgaaacaccactgcccaagtagaggacccagtgtccacgactgggaacagatctagattgcttggtcatatgtagaagtttctatctcctctaatcccttagaggagaagcccatgtgaaattatgatgtttacttctgtggagacaaggtctgactggccacagacttccttgtgtagacgacaggacgacctccgtcttctaatctctatgcaccgctaaggttgggatacagtgtttgtacatgctaagcaggtgctctacaaaccaagccacgccccccaggctgacatcataagttagtgcctgatgattatctcttacaaaagtaaactcactgtgtgtttagtatgtacaaacggggctggagagatggctcagcggttatgatcactagctgatgatcttccagaggtcctgagttcagttcccagcacccacatagcagcttacaattgtaactccagttctaggagatctaacatcgtttcgtgatctctgcggatgtgagcaaacactcttatacatagaataaaataaaccttctgaaaaattctaaaaccaaggccatcctgggctaccaagtgagcccttgcctccaaacaaaacaaaactccagcatgaggataaatgtgggtaggggtggagctgggggcagtaaactgtgggagcctgagattgctcaatcatgaatgtcattttagatgttttctttttaagagtctactcggatggtcgctttagagaccaatgaggaccccgagactgaggtaaaaatggaaggtgagtcaccaaaacgcttgttattgtcacatggtcagggtgactttccacgcagccctcactacttctgaaatgattattgtacggtggtgattggaaccggtgtgtgtatgttcacattcatgcatgtgttggatgagaatgagccataggctcccatgtgtgaatgcttggtccccagttgatggaactgtttgggaaggattaggaggtgtggccttggtgatggagctgtgtccctagaggtgagcctggaggtttcaaaaggccccaccatttccagttagccctctctgccttgtgctcatggatcacgatgtgagctcttagttactgctttagcactgtgcccgcttgccttctgccacaagggtcatggactctaaccctctggaaccataagcctagtaaactccgccttctataaggtgccttggcaatggtttcttatcatagcaacacaaaagtaactaagacagatgaccatgtctcgatgcatggaggagtcagaggacatctttgtggagtcacttctctccttccttccaccttgagatgggtcctggggaccgaactcaggccaccagctttgcagaaaacgtaccttttcccactgagccacctcactggccctcaaatagaaatagaattagccctctctttagccacagttagaattaatttgagggtttggttggtgggggacacagtatggtgtccacatcctctatttatgaaaagccagcaaggccacttggagccctgggtcctgatagtttcacctttgcaacgagagtaaaaggtttaatgatggcagctgtctccttattgggtgggccgcaacaatcaattgtttttgaagatgtcaccatgtactttattaagcagaaatgggctagcctaacactcactcagaaggccttgtacgatacggcggaggaccttgcacaagtgtcttgtctggggctttctccaaaccaattctcattgccaagctagagcacaagctagagcaaccctcattgcaagctagaggcggagttctcccagtcaaaggaagcctttggcagtgggggttagaaagcaggcttcacggggcacctctaagaactgagcaaatacacccaatgagccaaaagcacagcgcgtgcagtgaaagtaaacatccctccaaatcagccgagcagacaggaagagagattaactcctgacctgtctatcccagcttgccgaggaaggcgagtcaagagccaagttgagtgatgtccagtgcactgtctctttttctgtagtcacgtggacttcctcagaagcagtgcttttcagttcactacagctcttcagctggatgtaaggaatctcaggcctccctctccctgatgatcatcctgttcagccgcagagtacagggtcagaggatgccatccatctggcacattaacagctgtcacaatgttgcaacaaagtactgaattaatgagactgcagggcggtggtggcgcacacctgtaaccccagcacttaggagtcagaggcaggaagatgtctgagctcaaggccagcctggcctataggacagccaggacttcacagagaaaccatatcttgaaaaaaacaaaaaacacaaacacaaaccaaagagactgaagaaatggcttagccattgagaacaatgttgttgatcttctggaggacccaaatttagttcccagccagctcccatctcgtgtggctcccaactgcctctaactccagcttcttctggcctctgtgtgcttacatgcttgcatcccaacatagacacacactcatacacataaatgaaaagacatttttttctaagaacatcagcaacttaaaagaggaggggagacagtctttcccagcgtagcagacactgcacggtagccagagctggaggcagctgatcacattgtatccacagtcaggaagcagacagattgatgctggtgctcaactttctttcttctttttgttcagtctgggcccccagagcatggggtggagccccaacatcaggttgagacttctctcctcagtgtacactctggaagcaccctcacagacatgtccagccagattgaccttgaaggtcaaccatctttcaacaccgcacacaggggtggggatagggaggcagtatccaggctgcacttctccttatataacacttgggtatattttagagacttgcagattttctggtcactctgactctttctgtttgctctcaaggaaatgcaaatccatccaaccttgtaaactctgcagcaggtgttgaagaccttaggatcatacaggtgacagtcgcaggtgggacatccgcttaatgtcttcatcatttgaatcacagttttcttttttgtaaagtttcttttcccttatttaggtgtgtatgtgtgttcaagcgtctgccacgtgagtgctgtgagtgtggtacccagaagagggcacaagatcccttgaagctgccctgaaactggctctgcagaccaggctggccttgaactcagagattggcctgcctctgcctcccgagtgctgggattcgagacatgcaccaccactcagctgtatttatttttaatttgtcgtgatttactttgtttcctgggtatgagttttgtctgtgtgtgtgtgtgtgcactatgcagtgcctagtgcccatcaagttcagattggaagggtaagatgcatgcgctggaaaggaaacaggacctttgcaagagcagcaagtgctcttagctactgagccagctcttcaggaggccccctgagccactctttaaagattacttatttaagttttaagacagggtcccactctgtatccctggctggcctggaactcactgtgtagacaggctggcctctaatacagagatctgcctgcttctgcttcctgagtgctgagaggtatggacgggcacaccaagcttttaaaagaatgtttttaattatcagctggatatggcggtgcatgcattaaaccccagcactcgggannnnnnnnnnnnnnnnnnnntgcatgcattaaaccccagcactcggaaggcagaggcaggcagatctcaccctggtctacagatcaagttccagcacagccagggctgcacagagaaaccttgtcttgaaaaagcaggaaaccaccaggcgtggtggcgcacgcctttaatcccagcactcgggaggcagaggcaggcaaatttatgagttcgaggccagcctggtctacaaagtgagttccaggacagccagggctacacagagaaactcacaaacaaacaaacaaacaaaccccagccaaacaaaaaaagcaaggaaccaaacaaaacaaaattttaattaaaaaataataattttaaagtattgaaagatatcccctctgagccctagcctcgtttttcttcacttcttgtcctgtgggatgggctgaggtttgcattacagtattgaaggcagcgatggagataccacccttgtcctgctcagcactgaacatgttcctcaagaacagcatgcgcagtggctggagacaggtcagggctgagagggtttactgttcgtgcagagggacccaggttctgttcccatctcacccccgctcataaccacctgaagctccaggggaccccacatctttgtctaatctccatgggcgcttgcatgcgtgtggcacacacataaacacaaataaaaaaaaacacaaattaaagtagggctggagagatggctcagcagttgagagcactgactgctcttccagaggtcctgagttcaattcccagcatctacacagtggctcacaaccatctataatgaaatctgatgccctcttctggagtgtctgaagacagctacagtgtactcatattaaataaatacatttttaaaacattttttaagtattatggggtatgtttctatgggattgtcaaaattatcatctgtaacagcttccgttttgtgtatttcccaaatgctcacttactgtgctcaggtagctaaccaataagacaggtaaacaggcatttctgctaatatctgtcttgaagaggaaaaaagtgtatgaatgagcctggtttgtgtcttcctattatttgtagataatgagaaggagaggctctcaggcctcgaaaaaattaagcaactgcgagaacaagtaaacgacctcttcagccgcaagtttggtaagtttctgttgttggcacacatccattacacttaagtgtgtgttggagggcatgcacacacgaagacactgtccttggagaccagaagaaggcgtcagagcccttagtgctggagttacaggcacctgtgagctgcccaacatgggtgctagtaacaaacgcagtcctttggaagagcagcaagtgatcttaactgctgagccatctctccacctccaacatttatagactttacccaccctaccccttaatggagtactgaacattgaaagtactctagtcctgctataatcactggccgaaatttcttttctagttatttatttttgagataggctgtgactgtatgacataggccagtcttgaattcaatcaagatattcttgaaaagtgccggaattactgccctgtgctgtttttgggtagttcaaaaatctccagggagtaggcagttcttgaacttttgattctcctgattttagccccctgaatagctgggatcctaggcctgtgccaccaggttcagcacagtcattgttgggtttggagacagcaatgtcactgtcttggcccaactgacgtcaaacacttagactccagtaaccttacctcttggctactcaagtacagatgtgcacctccaggtctagctcttgacactaaagacagagcccaggaagcctggcgtgtgagccaagcatttaagaattcaagtccatagactctgactcaaaaacaacaacaacaacagacaaacaaacaaaaaacctaaagctttgaaaactaaggcacagaggcatccagtttaccccgcacctctcatcacaggggaggcgatcggagtggacttccccgtgaaggttccctacaggaaaatcaccttcaaccctggctgtgtggtgattgatggcatgcctccgggggtggtgttcaaagcccccgggtatctggagatcagctccatgaggaggatcctggatgctgcagacttcatcaagttcacggtcattaggtgagtgagtcccagctcccctagagcaagctggagatgggcagccgcctagtgagcaagtctggagcccagccaggagaccagccgggtggggaggggccacccttcatcttggagtcaggatgctccaaggcattccactctcttctgcttctgcagctgtgcctctggtcctgttcctctcattattttttattatacttatgtatgaggggcttgtcatggcacatgtgtgaggacacttatgaaagtcagttctttccttctaccacgtgggccccagagattgaactcgggtctcgggtttggcagcaagcatcctcacccaccgagccatcttgctgaccattgtgggtttccccccctcagcctcacttccgagtttgcctagctagcactgtgtcgacaccaccagaagtgtggagacacagctagctgggccgaatgaaaacagacttccttcccctgttcctcccctgtctccctgcagaccacttcctggacttgaactcagtaatggtgagtattttgagaagcaggaacatggcaggacacaatggtttgtgtagtgtcatggtgggcacttagcacagggccctcccacctgcagcctggagcctgccagtaaagcaggtggcctttcagatgtgctggtttggtttgttaagggcctggggatgacgcccaaggtctctcgagacctaggcaagtgctctacctttgacctacacccaaagccctatttaccttttattttacttctcttttgttccttggtttttattattgttggtctcaaggtgcagctctgcccagcctggaaactccctgagatccacctgcctctgcttcccgtttgctgggtcacaggtacacagcactgcacccagctgtctggtgttttgaagacagtgtctcactccttcagtcccagacacttgcctacaatttattatgtggtccaggctgccttctaagtcacagaaaccgtcttgcttctgcctcccaagtgctaggttacaggctcctggcaccataccgggttttatgtggtgttgggtatcaaagccaggggggcctcttgcatagcatgcaagcactctatcacatctccagccccactacaacttgttaagatacatatatatatatgtatatttatgctgtcaggaattattccacttaactgtatagtggcttcaaacaccaacacaccgagcccagtatgctgccgcaggtctgtaatcccagccctggggattgcatgagttgtaggctagcctggtctacacagtgaggccttgtctcaaaaaaagccaaaacacacaaactcaatccccactaacacgtgcacatataaccacactactcacctgagttaggtgggggctgactctaccctggcacttttgaggtctaaagctttggcaagtcgtgtatttcctttgcttggtcccttttttaatatttcaaagctctcttggaagttaggcaaggtggcccacagctgtaatcccggcactgaggaaactgtggccagaggcccactaggaaggagttcagggccagcctgagctacaaagtaaggcagtctcaaaaacaaacaaaaacaatcaacaaaacagtaaacatgccaggcgtggtagtccatacctttactcccagcactcaggaggcgagacatgtggatctgtgagtttgggtccaccaccctcgtctacatagtaagttccaggacaaccggagctatgtagaaataccctgtctttttttttttttaaaggccagagagaagctggagatggtggcacatgccaaccatctcacattgatgaggtggagttaggatcaaaacgccaaggtcactgttggctccctagtgagtttgaggcatgctggggtatcaggacacccgctctcaaaattaaatagaacagggcaagggttagggagttgccaagtcaccattccatgtctctataaagtggggaaacggaagatagaccaggagggccgcgtgtttcaagaaaagtgggagcgagcctatttcttcgtggaggtgcagaacatccccacgtgtttgatctgcaagcagagcgtgtcggtgtccaaggagtacaacctgcgccgccactaccagaccaaccacagccggcactatgaccagtactcgggtcaggcccgggaagagaagcttagagagctgaaaaggggactgcggaagtatctcctgggggcctcggagatcgtgtgtccagagcaaccattccccaatgcaagtccccccacgaactccgcggtgcagccggcggaagaggtggccgggagcttatgggagaagttaagacagaaaatccgctcctttgtggcgtactccatcgccatcgatgagattacggatatcaatgacaccacccagctggccatcttcatccgcggcgtcgacgacaacttcgacgtgtccgaggaacttttggacactgtgcccatgacaggcgccaaatccgggaatgagatattcctgcgcgttgagaagagtctcaagaagttcagtatcgattggtccaagctggtgagcgtggcctccacgggcacgccggccatgatggatgccaacagcgggctggtgacaaagctcagagccagggcagcctcatgttgcaagggagccgacctcaaatccgtgcgctgtatcattcacccagagtggctgtgcgcccagaagttaagaatgggccacgtcatggacgtggtggtagactcggtgaactggatctgctcccgtggcctgaaccacggcgacttcacgacactgctctacgagctggacagtcagtatggcagcctactgtaccacacggccctcaaatggctgggccgagggctggtcctcaggaggttcttcgaatccttggaggaaatagactcgtttatgtcttcccggggcaaacctgtgccccagctcagttctcgggactggatcctggacctggccttcctagtggacatgacgacgcacctcaatacactggatgcctccctccaaggccattcacagatcgtgacccagatgtatgacttcatccgggccttcctagcgaaactgtgcctctgggagacgcatctggccaggaacaacctggcccacttccccacgctgaaatcggtttcccggagtgaaagcgacgggctcaactacatccctaagatcgtggagctgaaggccgagttccagaggcgcctgtcggatttcaagtcgtgtgagagcgagctcaccctgttcagctccccgttttccaccacgatcgacagcgtgcgcgaggagctccagatggaggtgatcgacctgcagtgcaacacggtgctgaggaccaagtacgacaaggtgggcgtcccggacttctacaagcacctgtggagcagttaccccaaatacaggagccactgtgccaggatgctgtccatgttcagcagcacccacatctgcgagcagctcttctccatcctgaagctgagcaagaaagaggcgcagtggggcgcagcactccaggtggccacgtgacagagcagagggcggagccttcaatcccactactgcggaggccaaggcaggaggatctgagtttgaatttgaggtcagcttgggctacctatcaataccccatttcaataaagagaagttgctggaagaggaaaggaaggaaatctggccattcctctatgtggagacctagaatgttccagacctaatagcctgtgagacgagaatagaccattaaacctctccgtttaatgaaaataatgtcccctctccccccactttgagtcggaatcccagtttacacatcacagctgttcagatgacctgtgacacctgtctgtagtttggtaaagcccataacagttgtaggtccagtggctggctcctcttggcttcactgacccatgccactcatccacgctgtcctgtttcaaataaacccactgtgaaagatgtgtgtgtgtttgtgtgtgtgtgggggggtgcacacatataggtgtctccgcatgttaccagcctatgccctgtgcttccaagtttaaggataatcggccagagacacagtcccgtaatctagaatgcctggagctagacaggtcaggagtgaaatggaagatctagagtaactaacacaggatctaacggacaggtaagctaaggcttaaaggccacttcctccttcctcttccctctttctcccttcctccctcttcctccctcccttttcttcttcctcccatcctccttcctcttccctcctacttcctctttcctctttctcttttcctccctcttccttccgtttcccttctcttctttctccctcctcttttctcttccctcctcctcttcctctctccttcctctcttcttctctgtcctcctttctccctcttaccctctcatccctcctccaagacaggatctcgttatgcaaacgaggctggtctagaaacccagctcttcctgcctcggcctccactgatctgggattacaggaacacttcatgacatccactgcagattccttctctaccctggaatgtgattttggaccccgtgggggctaacaagtactgccaccatagagaagatgggatatggggtgttcttcagtaaccatggcaacaagatgtctgtggagttatgtggccagataaatgggaaagagacgggactgggagctcattcttaattggttgctgtttcttcaggccaggcattgatgtcttccagtcaaaggatggaggcagggaggggaatggcccagacaaatccaactcagagggcaaacccatctaactggagtgcatccagtttacacaccttaaaatatggcccaactagccaggcacgcctttaatcccagcactcaggggcaaaggcaggtagatttttttagttcaaggccagcttggtctgctgagagaattccaggacagcccaggcaacacagaaaaaccctgtctggaggaggaggaggaggaggannnnnnnnnnnnnnnnnnnnnnnnnnnnnnnnnnnnnnnnnnnnnnnnnnnnnnnnnnnnnnnnnnnnnnnaaaaaaggtggtccaaaaaactatgtgcccataggcccgagtcggtgcagtcccaaatggcctcggcctgcttcctgatagatttaccctaagtaaactgcctacatttcctgtctctgatcctcaagcccagagacactggagtaagcccagcactatatgtgcactcagagactgatggtcagcagacagtgatgctggacaagccggcagccatgggtgtggcccttgttccctcctcggcttccctgcacacacaggcctttgggcagcctccctggccagcacatggcaggaaaggctaaggctgatacaaggtaacatcagcaagatcagaaatacagagaagagacgtggagcagggatgtgcacagctgaaattctagtaagcaaggactgagaccagctggtgaggagctccaagtcgtcttccagaacctagggagttagaggccagcctgctggacatgggatcctgaatcagcgcgcacatgcatgcacacacacacacacacacacacacacacacacacacacacctgtccccaaaagggagagacatctaatcaggacttcactttaggaaccaaacaacaaaactaggaatggtaaacactagtaaatccatcattgagaagctggagccaggcgtggtggtgcacgcctttagtcccagcactcgggaggcagaggcaggaggatttctgagttcgaggccagcctggtctacaaagtgagttccaggacagccagggctacacagagaaaccctgtctcgaaaaaccaaaaaataaaaaataaaaaagagaagccggaggcaggatgatcaggtacaacctgggatacatagtgaaacctgtttcccaagaagaaacgtgctgaaagtattttatctctggagcaactggaatggcaggcctgcaatgtcatcatgagttgtcttttgcaagatgtgcggcttcattttgcaccacggcttctgattcagttagggtttctattgctgagataaaacaccatgatccaaagcaagctggggaggcaaagatttattcagcttacacttccatgttgttcatcactgaaaaaaagtcaggacaggaactcaagcagggcaaggactcaagcagggcaggatcctggaggcaggagctgatgcagaggccatggaggggtgctgcttactgccttgctccccatcgcttgctcagcctgccttcttatagaacccagggccaccagcctaggatggcaccaccagcccaggatggcaccaccaactgtgggctggaccctcccccattaatcaccaagatcttatggaggcatatcctctctttttaaatttttttcagtgtgtattttaatttatgtgcattgatcttctgtctgcatatatgcctgtgtgagggtgtcagatgccctaaaaccggagttacaggcaaatgtggatgctggaaatcgaacaccagtcctcagaaaagcagctggtgctcttaaccactgaggtgtttcctcaatcgaggttccctctcttagatgacaccagctcgtgtcaagttgacgtagaccagccagcgcggtttctttgcatttggggatggaaatagagacatgaaagcaaagtctccgcatcactaatgacactaaaatgacactagtcattagttgctaatattaatctataactgcccactaatgacagtcgctttcatccccctgagactccctacgcccgttgtactgtggtatggggtggtttgacccaggatctcacactagctaaatctgatctcaaattccctacatggcccaggccgatcttgagtctaactgcagttctcttgactcttggctctgaaattacagatgtgagcctcggctcgactgccctgatgctgggacactggcacaccctattatgggatgttgggaatggaagccaggcccggttgcatgctagtcaagctctaccaaccgggcaacatcctgaggccctagggcagtgcttctcaacctccctagtgctgtgaccctaatacagctagttcccgatgttgtggggacccccagtcataaaattattttcattgctacttcataactgtcatctcgctacttttatgaatcataatataaacatctatagaaataaatatctgtattttccaatggtcttaggcaacctctgggaaagtcttttgacaccctccccaaaggggtcatggccaacaggttgagaaacactttcctagggcgttcctaaggcacttggctttctgcaaacttggttgagactacagcagcaggtaatcagatcttttttgtccctgcaacccccaccctagcagcgctcactgcctcctctcatgctagcaataccggtggagattaacccagtcctgtcctttgctgtagagtctcagtccatttcaaaccttaaggcatgggaggagtctctaacctgaggctatacacaagtatatacagagatagggataggagccgtctagggccgctgcttctcacacagcggacgtcagcttccgtttggtgctctctgtgcagcggtgcaggatgaggtccgagctgggtcgcggaggcaccgcgggctgtggtttgacgcgcggagtcgatggattgtctgcaaaccaaagccaggaccatcagaagccccagcctcccagttgtaaggtgctcgcagtttctagtcctgatcccgtccctaggtctcgtcccgcccctggaaccctaagaacttacctctgccctccagcccaggccccggcccgccctggcgctcaccctttgtgccatccgtgctcagcggcccgggtcgccccgggcgtctgcgctgctgcaggaatcggacgctgttgcggcgataggtgtcctggctaaggcgcttccgagaacgctggtggatgctctgtgcgttgcggatggtcgacctggcccagcaggatgcaagtgtcagtgccccggagtcgctgttcccggggcacgggtggacacccctgtcatcctaagcctggctagagaaagtagggtacggagaaactcggacaccctgagatcctaaccctggcctcagcaagtgggttaagagggactcgcacccctcaggtcctaagcatatatttacataacaagtggaatgcaggcaagggaaacttcaagagctgcgtgggggtcaagaatcctcccaggcctgtttcccacacccactttgcccatcaacatgacccttgccctgggactgctcaggtctcattgaccatccccccacgcatctttgggcacctcactgggtctgtccgtgaccttcttcccctccatccctgtgtctgccacctccaacaacagcgaaagcacagcactaaacctggtaagtacctacccagccagaaacctcctcagacctctctcaggcctgcaccatcaggacccctctcaccttcgaggtggtgccccgcggcctctgatctgtcgctgggcctgggttatctcctccccagccttctgcagatacatggatgggaaatagccggtgatatcccctttcctgcaagatgggtcacattggaggctcagtcagtcacgggggggggggggggggtgcacagagcaggggaccttcatagagtctcacccttgaggaccaatgcaagctaagagatttcaaacatccacatctgaaaggccaagctgtttcctcatctgtatcaacccaagcctctcatgcccccagccctcctgtcgaagtctgggcaagggaagaaagcagatgtgtacatcattaggtctgtgacaccattaggtctaaatgcctctgggtgatggtgacccacacctttaatcccatcactctggaggcagggacaggcagatagatctctgtgtgtctgagggcagcctggtctacaaagtgacagccaggacttcacagagaaaccttgtctagaaaatcaaaaacaaaacaaaatagaccatcattttccttctcgtctgctcttgtttttattttgtttgtttgattgcagaaggtcctggagatgaaactctgcggctaatgaggacagaagactccagaatcgcacagccaagtcagctcagagcccaagagaggttccccaaacccactcagagaggtgtgtgcagagggaggggctctcctacctgaccacccaccagccatccaggagcttatgaatgacctcaatggcttcaccctcagacagggacatctcgtcctcttcaacagcagcgtacgctttgatggttacatacggttcacctggtccgcggagggagcagccagtgaggcgagagtctcctcaactctcagcttcttccaactgtctagccactaccacaagcacacagcctcagtcccctcagagctattctttctggctttccctttctaagttttttattttatttatttcatatgagtacacagcaactgtcttcagacacaccagaagagggcccctacgtttttttttttaagataacattttatatactgtaaggataggaccaaaggcttgtaatatgaactgaacatgctctaccactgagccacgcccccagcccctccctgggggattctaggtaggggctctaccactgagccacgcccccagctccttcctgggggattctaggcaggggctctaccactgagccacgcccccagcccctcactgggggattctaggcaagggctctaccactgacctacacactcccagtgctagcatgtgtgttcatgtggtgtgtgggtatgtgtgcatgcacgctgggcttagttggttttgcctaagctgtcatctgggaagtgtagcctctattgaggttttaccaaaatacacctccatcagaatgggctgaaagcaagtctgtgggggcattttcttgcttaatagatatgagaggcctcagcccaatgtgggcactgccatcctgggcgggcagtcccggattgtataaaaaagcaggctgagcaagccagtgagcactgttcctccatggcctctacttgagtttctgcccccagttcctgctttgagttgcctcactgatggatctcttacctagaagtgtaacatgaaataaaccctttgctcccccaacctggttctggtcacgggggatttatcaccccaatagaaagtacagtaacacgaatacatccacacccacacacacatgcacacacatgtacacacacatacataccacatgcatacacacacaagtacacacaagtacacacaccaaagacacacaaacacacatgcacgcacacatgcatgaacacacgtgtgcacacacaccacaatattttttaacaggatgtcactacgttgcccagactgggacatgctctgcagtctgcctcagcagccttggactgcagctcctccagtctgagcctcctaaatagctgaggtgacagacatgccccactacatccagtggaatctcccagtctttttcttttcttttttttttttcgagacagggtttttctgtatagtcctggctgtcctgaaactcactctgtagaccaggctggcctcgaactcagaaatccgcctgcctctgcctcccaagtgctaggattagattaaaggcgtgcgccaccacgcccagctggaatctccaagtcttaaaacatagccaaaaaattctgctttcaaactcagtgcagaccatccaagccctggaggtgccaactttacccttgggggtccatgtcaatgccacctccaggaagcccttcttcccagcctttgtcagctcagttttctgttcccctcccccaccctggtaccagactccacattgctcacatggtcctggctgccttctctgtgcccctctgctctgcctctttcctgaccaacgccatcacaatctacccaggcctccaagctgaaaatactgggagagccccctttctctccctcaccccacacccgctattgcctcagagggcaggaagcacctgcgtagttgggatccggatcctccgcctcgtcgggactgtcaaggggctccagataggatgcagggacccaacctcgctttgtcttcatctggcaaaaccaccagcctatgtggtgggggtggggggggaaggcacagagaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgctctcgctcttctccacaacgtccaccacgtctccggttgccacggtcatctctgttcccgaactcttctcgtagtcagcaatggcccgataggtctgaaggatgatggggcctgtgatgtctgcacagagggagggcagggtgaatggacacagcagggagggcagccccccccccccgtgggggcacagcgaggaaaacatgagaagctacccagctccaggctcatgggagttgtcacacactgcaaactggagatcagccaagctcatgatggcggatgaggttagcatgcccccagagtgcctctgtggctttttttttttaagatttatttatttattatacataagtacactgtagctgtcttcagacactccagaagaggggatcagatcgtgttaggatggttgtgagccaccatgtggttgctgggatttgaactcaggacttttggaagagcagtcggtgctcttaactggggagccatctctccagcccagcctctgtggctttcaaatgcattgttctgagacagggtctcacagtgtaggtctggcctggaactgactacgtagatcaagttggactggaattcatgcaggcactagactcaaggcatcattacacctggccctgtttgtctttcgagacagggtctcatgtagcccaggatagcttcaaattcagtgtatggagccaaagataactttgaactcctgattctcctgccttggactatgctggtgatgacagccccaatctccaaggtgacatgaccccatagcccctcctcctcagtgttctgtccccacaaccccacactccaggtctttatgtcctgttcacagtatctgtgttcccccgcccctgggttcccccgcccctgggcacctctagcctcttaccagctacgttattcttgccatctttgggcaccaggtatgtctcaggcttcttcgccctggagaaagaacaggccagaagggagggtttcaggttacaccggcaggaggactttccaagagaaaaaggaaccagggaaaggaaggtcaccacagagagaaggaatccactggcccagccctgggagtggaggcagagtggggacacagagtgtcttacaaatgaggggggtgtctatgcagccatacttaggagggggcacacagagcaagctcagtgtactgcaaacccaagggagatggcaaagccagccttctatgccagcaagatagagatgcttggcctgggaggggctcccataagcttccgggagagggggtcccttctgacccctcttgaatgcctcatggtgacatggacctgtgtagatgcagtgttggccagggcacaggtttagagcactgtctgtctgtggggcagtccctcaccctctctgaacttggggctccctcacgccctgtgcattctgtccccgtctcctccccccgggggaggtggctacgcactggctgtcagtgggcagtttcaggtcatcaggccgcactttgaagaagtccagcaggtgtgggcagcgggagatcttcacgggcagtcccatgaggccgttgaagtattcagtgagagtgccctggcgactctcagcggctcgttgcccatcaaaccacctgggtgctgggtgggggagccagagacccatgagcacactcacacaagtccaaaagtgtgtggaaaggggttttagagagcagaggaggagcaacccttggggcagaggaccctgctgaggggctcaagccgtgctctcacccgggaggtgtgggatgactctgttctctgtgtggatctcgccggcctcaatggggaacatctccttcagcattttctagatagaagaagaaaacctgggctgggctccgtggcacagattgcctagtatgcacgcagtcttgggttccaccctgagcattgcagaaatgggacgtggggtgcacacactcaggaattgaggcaggaggatcaggagttcaaaggcatccttgttgtgtaatgagtttgaagccagtcttagatacatgagaaagaacaaaaggggtgctcgaaaagatctaagttggagcagttcataacactcaccgggaggggga

SEQ ID NO: 620 - DNA, 2070 bp, Mus musculus
gaaatgcaaatccatccaaccttgtaaactctgcagcaggtgttgaagaccttaggatcatacaggtgacagtcgcagataatgagaaggagaggctctcaggcctcgaaaaaattaagcaactgcgagaacaagtaaacgacctcttcagccgcaagtttggggaggcgatcggagtggacttccccgtgaaggttccctacaggaaaatcaccttcaaccctggctgtgtggtgattgatggcatgcctccgggggtggtgttcaaagcccccgggtatctggagatcagctccatgaggaggatcctggatgctgcagacttcatcaagttcacggtcattagaccacttcctggacttgaactcagtaatgtggggaaacggaagatagaccaggagggccgcgtgtttcaagaaaagtgggagcgagcctatttcttcgtggaggtgcagaacatccccacgtgtttgatctgcaagcagagcgtgtcggtgtccaaggagtacaacctgcgccgccactaccagaccaaccacagccggcactatgaccagtactcgggtcaggcccgggaagagaagcttagagagctgaaaaggggactgcggaagtatctcctgggggcctcggagatcgtgtgtccagagcaaccattccccaatgcaagtccccccacgaactccgcggtgcagccggcggaagaggtggccgggagcttatgggagaagttaagacagaaaatccgctcctttgtggcgtactccatcgccatcgatgagattacggatatcaatgacaccacccagctggccatcttcatccgcggcgtcgacgacaacttcgacgtgtccgaggaacttttggacactgtgcccatgacaggcgccaaatccgggaatgagatattcctgcgcgttgagaagagtctcaagaagttcagtatcgattggtccaagctggtgagcgtggcctccacgggcacgccggccatgatggatgccaacagcgggctggtgacaaagctcagagccagggcagcctcatgttgcaagggagccgacctcaaatccgtgcgctgtatcattcacccagagtggctgtgcgcccagaagttaagaatgggccacgtcatggacgtggtggtagactcggtgaactggatctgctcccgtggcctgaaccacggcgacttcacgacactgctctacgagctggacagtcagtatggcagcctactgtaccacacggccctcaaatggctgggccgagggctggtcctcaggaggttcttcgaatccttggaggaaatagactcgtttatgtcttcccggggcaaacctgtgccccagctcagttctcgggactggatcctggacctggccttcctagtggacatgacgacgcacctcaatacactggatgcctccctccaaggccattcacagatcgtgacccagatgtatgacttcatccgggccttcctagcgaaactgtgcctctgggagacgcatctggccaggaacaacctggcccacttccccacgctgaaatcggtttcccggagtgaaagcgacgggctcaactacatccctaagatcgtggagctgaaggccgagttccagaggcgcctgtcggatttcaagtcgtgtgagagcgagctcaccctgttcagctccccgttttccaccacgatcgacagcgtgcgcgaggagctccagatggaggtgatcgacctgcagtgcaacacggtgctgaggaccaagtacgacaaggtgggcgtcccggacttctacaagcacctgtggagcagttaccccaaatacaggagccactgtgccaggatgctgtccatgttcagcagcacccacatctgcgagcagctcttctccatcctgaagctgagcaagaaagaggcgcagtggggcgcagcactccaggtggccacgtgacagagcagagggcggagccttcaatcccactactgcggaggccaaggcaggaggatctgagtttgaatttgaggtcagcttgggctacctatcaataccccatttcaataaagagaag

SEQ ID NO: 621 - protein, 649 aa, Mus musculus
NANPSNLVNSAAGVEDLRIIQVTVADNEKERLSGLEKIKQLREQVNDLFSRKFGEAIGVDFPVKVPYRKITFNPGCVVIDGMPPGVVFKAPGYLEISSMRRILDAADFIKFTVIRPLPGLELSNVGKRKIDQEGRVFQEKWERAYFFVEVQNIPTCLICKQSVSVSKEYNLRRHYQTNHSRHYDQYSGQAREEKLRELKRGLRKYLLGASEIVCPEQPFPNASPPTNSAVQPAEEVAGSLWEKLRQKIRSFVAYSIAIDEITDINDTTQLAIFIRGVDDNFDVSEELLDTVPMTGAKSGNEIFLRVEKSLKKFSIDWSKLVSVASTGTPAMMDANSGLVTKLRARAASCCKGADLKSVRCIIHPEWLCAQKLRMGHVMDVVVDSVNWICSRGLNHGDFTTLLYELDSQYGSLLYHTALKWLGRGLVLRRFFESLEEIDSFMSSRGKPVPQLSSRDWILDLAFLVDMTTHLNTLDASLQGHSQIVTQMYDFIRAFLAKLCLWETHLARNNLAHFPTLKSVSRSESDGLNYIPKIVELKAEFQRRLSDFKSCESELTLFSSPFSTTIDSVREELQMEVIDLQCNTVLRTKYDKVGVPDFYKHLWSSYPKYRSHCARMLSMFSSTHICEQLFSILKLSKKEAQWGAALQVAT

SEQ ID NO: 622 - DNA, 168821 bp, Homo sapiens
taatcctgatcataagcataaattataaacaggatcaagccgcagcgggtaggagcaggcggcggagacacctctgggagggtgtgggagtgagactggcctcccttcccactcagcccctcctggcccctcctgcttctggccaagtattccctcctgaggtccggcccagggatactgaccatgactccaggtgggccttttcctgccagggtcccggggctgtcctgaccacctctcacggagccccgctatgcctcacacaaactattaaggtgcaattattgcggagacggtcgttccaaattgatctttcagttactccacagctgcaaccatggagacggccccagctcaattacatgcctctctctgttctttaaagattgcagcggaggagaatcggagaagaatgaggcagtggtaccgggcgcagggatgccgagaggcagaggcgacggagccacagacgcgggatgggggcagatagaaagcagggaatatggagacccccagagacagagagacagagacggcagaactaaccgaaatggagagacaagctcagagataccccaggagagacacagaccagagacagagagagacaacagatctgaggtagctgggagagatacagggtcagagatggaggtcagggaatgacagagagctgatgtagacagacagacaaaggcagagagattggaagcaagagggctgcacaggaaggatcagaggccaaggcagaaacaagggactggaaacagaagcccctctatatcccctacatctttttaaattgtttttctttggagacaaggtccggatttattgtccaggctggagtgccatgttgtgatctttgctcactgcagcctccacctcccaggctcaagccatcctccctcagccccccaagtagctgagattacaagtacgtaccaccatgcccagctaattcttgtatttttagtagagatggggtttcaccatgttgcccaggctggtctcaaactcctgggctcaagtgatcctcctgcctcggcctcccaaagtgctgggattggaggcatgagccactgtacccggccaccctgctacatcttacatcatgagaggactacataaaagacagcaacaaacaggtggagagaaacagagaaaaacagaccaacgagtcacccgacagcagactgatgaagaccgttttcagtcattcattcatgcatttgttcacgcagcaaacgtttgcagagtttaccatagttggtgccgggcacgggggacgccaaggtgctcacagactcctcaaatccgcccccacatggagcttagagtttaacaggtgagtcagtcagggatcaaataggcactcaagcaacataaaactttcactggggttgggcgcggtggctcacacctgtaatcccagcactttgggaggccaaggcaggaggatcgcttgaggccaggagtttgagaccagcctgtgcaacatggtgaggccccatctttacagaaaataaaataattagctggatgtggtggtgtgtacttgtagtcccagctattagagaggctgaggcagtaggatcgcttgaccccaggaggtcaaggctgcagtgagccatgatcctgccactgcattccggcctgagcagtagaggagctaaggcttggtggggcggcctggggaggcggtcaggaaggccgaggaggacctgggtagaggcagagtgaaggcaaaaacatcgtgcaaaggccactctcattcactaatagaaagcaaaggtttggatccaaagttctgggatcacaggcataagccaccatgcctggccctcggaaataaatattctagaaggccgggtgcagtggctcacatctgtaatctcagcacttttgcgagactgaggcaggaggatcacttgaggtcagaagtttgagaccagcctggccaacatggtgaaaccctgtctctactaaaaatacaaaaattagccaggcatggtggcaggcacctgtaatccccagctactccggaggctgaggcaggagaatcgcttgaaccagggaggcagaggttgcagcgagctgagatcgtgccactgccctccagcctgggcaacagagtgaaaccctgtctcaaaaaaaaaaaaaaagaaatattctagtacgtgctgcaactcctggcccagtgggtctctggtgtggaggggagggcagcatattgagttggttctttattcccatagggctggagggacgtggcctcggcatcccccactccctccccaagctgaatagggtgccctctctggcccccgtgcccagaaccccttcagcactgcacgcaccccacctgctgatccagagctcccaggggcagggactgggtctacgtgatgcccagcacagagagggtgctttggtggaatcatgtctcagggccagcgtggcccagtcagatgccaggcctggctgctggtctgggcctgggcagccggtgacgaaggagctggtgctgggagcttgatggctcaggggacgtgtccccagtagacatggctgtgggctggtgctgcacaaacgtcagtgtttaaatggccctccaagaacatggaggtccacgtaccccaaactttaatgtgcattggaaaaatctggggactgtgttttattttattttctattttattttatgtattattttattgagacaaggttttgctttgttgcttaggctggagtgcagtggtagcacactgcagcctggaacctctgggctcaagcaatcctcccacctcagccttccaagtggctgggactacaggtatgtgtcatcatgaccagctaattttttcttttttaaaacattttggggctgggcatggtggctcacacctgtaatcccagcaggaggatcacttgaggtcaggagttcgagaccagcctggccaacatggcgaaaccccatctctgctaaaataacaaaaattagccaggcgtggtggtgtatgcctgtagttccagctacttgggaggctgaagcaggagaatcacatgaacctgggaggtggaggttgcagtgagccgagatggcgccacagcactccagcctgggtgacagagtgaaactctgtcttgcaatctgccagcctcggcctcccaaagtgctgggattataggcatgagccacgacacccggcctcatgtaaagtttttagcagcaataaattagagtcagcattgaataattgtcagttgctactttagcattttcttttcttttgttgtcttttcctttctttttgaggtagggtcttactctgttgcccagactagagtgcagtggtgtgatcccagctcactgcagcctcaaatcctgggctcaagcaatcctcctgcctcagcctctcgagtagctgggactacaggcatacgccactatgcctagtgaatttatttatttatttatttattttttagagatgggggtctcactatgctgcccaggttggtcgtgaattcctggcttcaagtgatcctctcatctcggcctcccaaagtgctaagcttacaagcacgagccaccactcccagcctcaagtcttatttttaaagaataaatagcaaccgggcgcggtggctcagccttgtaatcccagcactttgggaggccgaggcgggtggatcacaaggtcaggagatcgagaccactgtgaaaccccgtctctactaaaaatacagaaaatcagctgggcgtgatggcgggcgcctgtagtcccagctactcggagaggctgaggcaggagaatggcgtgaacccgggaggtggagcttgcagtgctgagatcgcgccactgcactccagcctgagagacagagcaagactccgtttcaaaaaaaaaaaaaaaaaaaaagaataaatagcaatgtatcagataaacttgtcatcctgaaaagacagggaaagccagggagacaggaaaaaggaatggcaggtgtccggccaggagccttgagggccacacgctgcctccacacactcctgggctgctgtgggtttggcctgcttttgcggtcctgcagtttgcccccccggagggcactgggttcaccatcctcacctttggtcctctgtgatcacatctggggcagcaaaacccaggtttcctctgacgttgcccccaggtgcagagaacggttatcttgttggagatgacggggtggtccctctacctgctcccaggtccccttggcatgtttccttcaaggaaccaagtgagaggaggggagaagtggtccaggattggggggaaataaagtgacgcttataggaggtcagggatccagccgtgagcccgaatgccaggggagctgaaggctaggttcatatgggcattgctttctggtggccagttctgcaccgggccaggaggaagtggccagcttgtgccttaggagttccttaggatgcccaggtacacactcacttctgcaaatgacctgcatcctgcattcccatctgtgaaatgggatagtcccgcccaccggccagagggtcctcagtaaggttcagtgaacaagagtgtggatggcaaaagctttaccaggcctcagttctgtgactgcgaggcagcggagaggaaggcgtgagaggggcctcagtttccatatctgcctagtagggggaacctggccagagcccacaggagaagagctggggcctgtgaggggcagaggtgattagagtctggcgatgtggggttctttgcggtcagggggcttgacaaaaggaaaaacttctatggatggggacaagccactggcaagaatttcttttttttttttttttttttttttgagacagagtcttgctctgtcacccaggctggagcacagtggtgcaatcacagctcactgtcactgcagccttgacttacccaagctcaagccatcctgtcacttcagcctcctaaatagctgagactacaggcacgcagtactacacctggctaattttaaaattttttgtagagatgaggactcgctatgttgcccaggcctgatgttaagtgattcttctgccttggcctcctaaagtgttgggattacaggtgagagccagtccaaaaccaccttaccttacctttcctttcctctatttctttccttcttttctgtctcccctccctccctccctccctccctccctccctcccttccttcatttctttttttgacaagttctcactatgttgcctaggctgttttcaaactcctgtgctcaaatgatcctcctgtctcggcctcctacagtgctgggattgcaggtatgagccactgcgtctggccagaatctcacctctcttttcttcccctctcatctcttctcttctcttttctcttctcgtctcttcacttctctttcccttacctcccctcctgacccctccctcccctccctcttctttctttctttccttccttccttcctcctctctctctttctttcttccttccttctttctttttctctctttccttccttccttcctccttcccttcctctctttttctttctccctccctcttttttttctctctctctctttctctctctttcttagagacagagtgtcactatgttgcctaagctggtctcaaactcctgggctcaagcgatcctcctgcctcagcctcctaaagtgcttaagccactgtgcccggcagtgtttgctacagtgggttacagtaacagaacatttttccactaaactcctctctcagtgaagggagccgttgttgtccttctcaggagaaggaactgaacttgacaacaacgtgagtgatcttgaccttgtccttaggaagagcaattcaagctaaaactctgaattggacttagttactagatgaaaccaaccaataaaacaatcaagaactatccttgatcgcttactatgcaccagacaccactcaagacatttttcctgcattgtgtgtcatttgaccctcacagcgatcttacgaagccagttctatcttagctgcattttacagatgaggaagctgaagcccagagaggctggttgacttggcctaggatgcacggcacatgtggagccagatgtcattcccagatgtggccgagcgggggctggacgtgccagtgttgtaccacactgccacctgctctctgcctgggtgaggctggggtcatgctggctgtttggctctcagggagcagagaggtctcccagaggctgcagggagcacgccccttgaatcacccctgttccagattctacctgcagagggcagtattgagcatacactgatgcttccctaccaagcctcagttcctccaagccctggggtgtaggacttggggtcagggaaacattcggccttcaaaccaactgggcccacggagggcatgccctagccctgacactgcacgggccggtgcagacatcatgggggtaccacgagtcagtgcgcggcagctctatcctttcgcccagacccagcagctccactcacagggccacatgtttttgtttttgtttttttttttttttttttgatggggtggggagacagagtctcactctgtcacccagactggagtgcagtggcacaatcatagttcattgcagcctccaactcctgggctcaagcaatcctcctgcctcagcctcctaagtagctgggactacaggtgtgcaccaccacacccagctaatttttttgtatttttagtagagacggggttttgccatgttggccaggctggtctcgaactcctgacctcaggtgatccacccacctcggcctcccaaagtgctgggattacaggcatgagccactgcgcccggccagggctgcatgtctttaagtacgtgactttaccccactgtaacatgaggccaatagtacccacctggcaggcttagcgcaaggcttagagaacttaaatgcaaccaacccagcacctaggagatgcttgacaagcaggggccaatcaccagtgttatctaccatgggggccacaccgtggtccaatgagaagctgcaggaggagggaagtggagactcacagaggaaaactgacttgctcaaggtcatgcaggtgattagacaaagaggcaggggccaggtgcggtggctcacacctgtaatcccagcactttgggaggccgaggcgggcggatcacgaggtcaggagtttgagaccagcctggccaacatggtgaaaccctgtctatactaaagattaaaaaataaattagcccagcgtggtggcgcgtgcctgtgatcccagctactcggcaggctgaggcaggagaatcgcttgaaactgggaggcggaggttgcagtgagccgagatcatgccattgcactccagcttgggtgacagggcaaggctccgtctcaaaaaaaaaaaaagaaaagaaaaagagaaagaggcagggtgggagacgacctgggtctcagagggccacacaggagggtgccttgagatgtcccagacctccttacaacaggagggtggtgaaggatggagggagcattggtgacttcattcccaaccctgacatggcccaacatcctctgtgggcatgagggcccctctgcgccctgccttgtgctgggcactgcagatgtggcctgcctgggaggagctctcagtctgatgggtttgtgggtttcctataggagacctggtcagccaaagttaaccctcaccaagttcctggtgtgtgtccagaagagaccccagtgtaattgtctgacgggtgttcctgccgctgcacaggaagaattcactgagaccatggtattacagcgagaaatagttttatgtttcttaatttttaaaattttttagacagtcttactctgtcgcccaggctggagtgcagtggtgcgatcttggctcactgcaacctccgcctcccaggttcaagcgattcttatgcctcagcctcctaagcagctgggatcacaggtgcctgccaccacgcccggctaatttttgtgtttttagtagagacagggtttcaccatgttggccaggctgatcttgaatgcctgacctcaagtgatccacctgcctcggcctcccaaagtgttaggattacaggcatgagccaccgtgcctggcctaatttttgaaacagagtctcactctgtcacccaggctggagtgcagtggctgaatcttggctcactgcagcctccacctcctgggttccagtgattctcatgcgtcagccttctgagtagctgggattacaggcatgcaccaccacacccggctaatttttgtatttttagtgaccaggtttcgctgtgttggccatgctggtcttgaactcctgacctcaagcaatccacccaccttggcctcccaaagtgctgggattacaggcatgagccactgagcccagccaaaagcgtcttattaatgcagagctagccaagcagtaggactggagttattactcaaataaatctccccaagaactcagaggctagggtttttatggataatttggtgggcaagggcccagggaatgggtactgctgattggttggagatgaaatcacaggggtgtggcaaacggtccttatgcactgagtcggtctctgagtgggggccacaggatgggctgagtcatgagtcacacaggtccaggtgagtcagtcggttgcccgaatgcgaaagtctgaaaaacatctccaaagaccaatctcagtttccacaatagagatgctatctataggaggaagtggggaactcacaaatcttgtgatctctcgccacatgactcctgagcagtcagattataaaaacgatgcgtaggttttagcagcgtccaggcccctcccataatcctaatctcacggcctttcgttagttttacaaaggtggttttggtctcttgtataaaaagcaggttaggtttaaggagtaactattatcatccttgtttcaaagttgaactataaactaaattcctcccccggttagcttggcctatgccccggaatgagtgaagacagccagcgcgtgaggctggaagcaagatggagtcagccacgctaaacttctgtcactgtcctaatctttgcaaaggcagtttggccaggaggctgtggggagaccttgtgggttttgccaggacctgggagattctcgatctatgtttggctgtccttctaagccagaagctccctggggttggggcctgcctggggtgagtccctccctccctgccatgcccagtctagccaaggtctagttcagggatcagggcaccacgtgggggaaggactgtgttccttgtgctgaattaggatttatggctttggggccggatgggaggcgtgcgcactgattcagtaggagcgctgctgtggtgtgtgtgtggttggtgggagcggggcgggcggggggcgggggggctggttggggggacaggggtaaaagcctatcagagggaggtcccatcagacaagatgggaccaagagtccagttggctctgctgcgactttcggcctgtcactgccttcctgcacatctcaggggtgggagggggacaaaggctgtaagagtaagaggtacctggcccaagccttaggactagaacccgggccaggcgggagtgaccagccgggacactcagggcctccgcgcgttccagctgggtgaccttgaccctccaacttcagccccctgcgcccggctgctctcccagtggtggtggggagcggtgggggtagacgggggcgcgcccaggcttttctaatccggcgctggtgggggagaaccgagggcgccaccgcccctccccgcaggtccggggccgaggggtgcggcgcgctctccccaccgcggtgcccaggtccccgggacgcaggggcgctgggtagcaaggggggtgcgcaggggcgcggggcgcggggcgggctaatcccgtatgtaaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggtaggagaaacttttgcggggggcgggcaccgaggcccttctccccttctcccccacccccgcccccgatcccctccgcctccgggggggggggtccccgcccctccccctctcaaggtgttacaggagctggggccggcttttgggtgcccggggaggcacgtgactgggattataattcgggcccggggggaggggagggacggccgccccccacctgcccgggaggggccgggagctgggagctgtcaccccctccctccttgccaccggctcttctggaggtggggggcgtcccgggccggcgcccgcaggctgctgcagttggcgaatgaggtcagtcgcgctgcccgcggtggcgggcgccggggtgggagcagagggggctgggaaggccgcggtccccgcctttccccccctccaccttctcccggtctgggccagcccctggcccgcgcccccaactcccaggcggagtccagtccagccaggattgccccagcagggtggttcctgtagtggatcccccgccccggccccggggagggggctggcctgtgtggtggtggccgctgaatcccgggtggaggggactcagaaggtggcagtggggggaccacaaagggttcagaggagtaagttggggatactcggtctgtgggtggtctctgagttcctgcagatgggtggagaggacagaggaggggccacagggtgctgaacacccacccgccccatcctaagtaccctgggcatgatgggcttgacacctctcctgggctcctcacccctggccagcagccagggagtgagaccctgcctcgcctggcgtgggcccagggaagggggccgctgtgccgctgagagttcgttccaccctcctggcagtgctggagggggctggagctctggcgtctggcctagtgaccctacctcccaggaccaaggtcctgcggtgggagtctcctgtgtccccatcccagctgaagcgagggtgctgggacataggggtctcgctgcagggcctgtgaggggagcactgactcttggatggagaatgtgccaaggggtaccccgggatggccctgggcctggcgggtgggagtggagggcaggcccccgcagtttttggagaagtgggcatttgctggggtttctcttagaagaggagaggggtgtctagaagccaccctggcgcgccgctgccatggtcggcctctgtgtgtctggctgccccgtggccaggactgttgactccttggcactggcccggggccttgggacttggaaggtgccccaagcagctcatttatttcagcagtgtcattccagaggggaagggcaccagcatcgattatttattctaagcaggaggaggtggctggaggctggtggctgctggcagggaggggctaggtataaggtagttaggtggccgtcatgaaccgccctatttggggcccaggagggtgtgagatagactctgacctcttctgagcaggcatctgcggaccaagggacaggcttggccccaaggtgacagggtatcggaacccccatcctgcctctggggtgtgggaggctcaagtccacacctcgttcttccacagcctgttctgagggtgacctagaaattggcagttctaactcagagggtcccacaggaccccacagaggaaactaggaaggaagggttgaaactccgcagccactcagagcctgcactcttaaaatgttcgagaacttaaggccgatggttgtaaaactgggtcttgaagacagctttgtagggggcacgctaaacctacttaaaaggactgttctctcgatgttgggagaagggtcatttatttgcagtatgctaatcacaaataatttttatctgttcattgaaggcagcctcccaggagcccggctagccttctgatgaggtggtagtcgtcagcacttggtgtttggcaatagtctgagtggcagctgtaatctagggtcttggaggtagctgtttttgcagcctgcttgactccagaggccaggccatccacggtttggtgacagcttggttgttggacctggggtcttgtggatggtgggtgatggcttgggacattcacgtcctaagcatgaccttggaaccatagactgcagctcccagatgattctcattcagggtctagtctctgaccactcactgcttcctcagccgactcataaatcctgtagtctggccgggcgcagtggctcacgcctgtaatcccagcactttgggaggccgaggtgggtggatcacgaggtcaggagttcaagaccagcctggccaacatggtgaaaccccatctctactaaaaatacaaaaaattagccaggcgtggtggcaggcatctgtaatcccagctgctcgggaggctgaggcaggagaatcgcttgaacccgggaggtggaggttgcagtgagccaagaccgcaccactgtactccagcctgggcaacagagcaagactccatctaaaaaaaaaaaaagaaaaaattctgtagtcttgccgttttcctgaatggcctggcttcctcctacccctggcctctgcacacacagttcctcttctctcgaaggttcttcttggcctttcccctgaggaggctggggggcttcctttattagccctgcctggctagggtagggggtcaggattatagaatttgcctcttttcctctccttcaggacttggcttggctgtggtatctttgggctgaagacttcctcgtcctcagggctggccatggttccacctttatatccccatgatgtcctctcttttttttctttttttctttttttgagacagtcttgctctgtgcccaggctggggtgcagtagtgtgatcacagctcactgcagcctcgaactcctggactcaagccaccctcccaccccagcctcacaagtagctgggaccgcagacaagggccactacacctggttaattttttattgtttgtagagatggggtcttgctatgttgcccaggctggtttcgaactcctgggcatgaggagtcctcccaccttggcctctcaaagtgctgggatgacaggagtgaaccaccgcgcctagccaacatcctttccttcctttgtcccaacattgatcttactcagatgtttacatctctctccccaattgcactagggacaggaagggatggaggcttgctcctcaaatacttgttaaatggctacatgtttgaatgaatgaatgaatgaaatcctgctcttgagccttgacctaaatggctaagcagactctctcctatttttcttaaatgctcatctctggggcaagttccccaccctggtaggagtcccagggtctctccctgaacttcctggggccccctctctccccactaccccagcctgtgtcttctcccaaccttaaccctgggggctttgctccccaatgtcatcctctctgtatctctcagttctctgactctcgccgtttgtaagtatctctctctcagatgcgtggcagccagggtcacagccaggttctttgggacaagccaggggtgtatgcccagctccatggggcctgcagaggcttcaggggacacccatggaagaagacctgcagggccaatttataaacagaggagcagagcaggacccagggcttggaatccatgctgagttacgtttttgtttttttttttttttttttgagagggagtctcactttgtcgcccaggctggcatgcagtggcgccatctcggctcactgcaacctctgcctcctgggttcaagcgattctcctgcctcaagtagccgggattacaggcatgctctaccacgcccggctaatttttgtatttttagtagagatggggtttcatcatgttggccagtctggtctagaactcctgacctcaagtgatctgcccgcctctgcctcccaaagtgctgggattgcaggcatgagacactgcgcccggtcctgagttcagttttgattggggggcttccgggataatatggggccgctaggacagggacccttagtgtgactggaagggaatttcctgaaggaattcatagcagaggtggagtggtgggaaggatggtttctgggggagaaggagatgcgtgaacctggccagaagacagtgtgttgtgacagatgattgctggtgagggggtaacagtctccaaggtgtagatgttgggggctccagatacggcaggaggggcctggcctctcggaatcccctcagccccatctcatagaaacatgtgctttctacccaggctccatactccggaagggaggcaggaccctgtcactttcttggcctactttggaagttctcagtcaggtatctccaggtgtggcagaggggctttggcctgtagggggtgtggtaatgtgggttttggaggcagaaagcttttcaggaaagccccctggtccatcacccccctttctttttttttttttgagatggagtcttgctttgttgcccacgctggagtgcagtggcacgatcccaactcactgcaacttccacctcccgggttcaagtgattctcgtgcctcagcctcccgagtagctgggattacagatgtacaccaccacacctggctaatttttgtatttttagtagagacggggtttcaccatgttcgccaggctggtcttgaacccctgacctcaagtgattggccctccttggcctcccaaagtgctgggattacaggttgtgagcccccaggcccggcctcatcatcacttcttcacccaccctattttggtagctctctctccactcgtcctgtggaactgatccattctcggtcccattcccttctctctgggccaatctgcacctaggtttgtggcttcatgagtatggagggtcgtgcagaaaggggccaggtctgtaggaacctgggttcatgccctggaaatttgcccatttaagataagttagggccgggtgcggtggctcatgcctgtaatccccagcactttgcacttcgggagaccgaggcgggcggatcacctgaggtcaggagtttgactagcctggccaacacggtgaaaccccatctctactaaaaatacaaaaattagccaggcgtagtggcgggcgcctgtaatcccaactgctcgggaggctgaggcaagagaattgcttgaacctaagaggtgaaggttgccgtgagctgagatcgtaccattgcactccagcctgggcgacaagagtgaaactctgtctcaaaaaaaaaaagataagataggtgtcctgaataagataggtgaaatgggtgaggatgtactttatcttacacggtcttagggagtgtctcaggcggtgaacagaactctctcgcccctgagctggggcctggctgacccagagctatttgtgtgcccacctgtcaccctctttcaggaccacctgcttcaggttgccagatttagcaaataaaaataaggatgcccagctaaaattggatttcagacaagcaaggactaatgcaatatttgggatgaacttctagctaaaagttacctgttgttgatctgtagttcagactgaactggaggtcttgcattttatctgccaaccctacaactgctgcctctggggcggtgagatggatggggtttggggaggggccagaggtgtgtgtggctgaccctggagttgggatcagggctcagtggaggccccggggatgatctggagcgagtttgaatcgagtggagctgattcactgaatcttggcttttttttttttaatttgtattgaaatgaggtctcactctgtcacccaggctggagtgcagtggcacaatctcggctcactgcagcttctccctccccggctcaagcgatccttctggctcagtctcccaagtaggtgggaccacaggcacacgccaccgtgcccggctaattttttgtatttttggtggagatggggtttcgccatgttgcccagttcctgagttcaagtgatctcaaagtgctggaattacagaagtgagccactgtacccagccagcagggtcctttttcatttttattttattctattttttgagacagtgtctcactctgtttcccaggctggagtgcagtggcgtgatcctacctcactgcaacctccaactcctgggctcaatgtgatcctcccacctcagcctctgcacctagctaattaaaaaaaaatttttttttttttagagatggggtcttgcgatgttgcccaggctggtctcaagctcctggcctcaagcgatcctcccacctcagcttcccaaagtgctgggattacaggcagtatccttctaatgtccttggtcaggcctcctccagcctgtggctcgagggtctagatctcctactggcctgggtggcatggagggtgtagtctaggtggcctgaggggtgcccagggatccccagtttgggaagtccttgtcttcagggatttctggccaatgtggtccgtatatttagagatgctgggaggagggggtgggaaattgctggaaacaccctattatacaccaagtaagattttcatgtaggattggcaaggcctgagtgctgggaaagtgtctgcaatggctacctttcaaagctgggagaccccgccacgggggcggttgtggacttgaggggctgaccccacagcacggaggctgctgggaattcctgcacctttgccatgctgccacctgaggcaggttcccagcacctgagctgcagcctctggagtgggggaaatggggggaaagtaaggggccggggtcatggggtccacgtccaccttccgcccgcctgggcagttttcttggatgtaaaagggagatggctctccccaacctgcctgggtcccagtgtggtgctgtagtccaagggacttggtgtgaccccgtggggatgccacagcatgggtgtgtgggacccccgggggcaggtctgtggtggagacagggtgggagggcctggcttgagggcttgcggtcctgggcacttgaggatgcagaagaggctgcatggttggggagggtaggtaagcagggggcagcttagccctttcccctcctgttccctgtgacagaggggagaccctccaggctgtttgtgtcttagatggttggccgagggtaggcctctttgctggctggggtctagcagggtctcaaggtgcattttctggctactggcagaaccaccatcaaagcaagtccgtatcttttcgtctatccatctgttgttacgccagccagtgaggaccttgcagaggcgtcaggcctgagggagtctcattaggtcctggtccccagcccccggctggcacatgagaagggcccactttatattatattttatttatttatttaagatggagtctcactctgtcacccaggctggagtgcagtggcgcgatctcggctcgctgcaacctctgcctcccgggttcaagcaattctcttgcctcagcctcctgagtagctgggattatgggtgcatgccacctcgcccagccaatttttgtatttttagtagagatggggttttgccatcttagccaggctggttttgaactcctgatctcaagtgatctgtccaccttgacttcccggagtgctgggattacaggcgtgagccactgtgtccggccccactttatattttattaaaaatatcgttgaggagtgaaggctatgctataccaggaacttgcctggctcacacccttatgtcgtccaacccccgtcaagacatagaacagcgctttgggaggctgaggcgggaggatggcttgaggccaggagtttgagactagcctagacaacatagtgaaacctccatctctacaagaagtacaaaaattagccaggcgaggtggctcatgcctgtagccccagctactcaggaggctgcggcgggaggatcacttgaggccaagaatttgagaccagcctgggcaacatagcaagaccccgtctcttaaaaaaaaaattagccgggtgtggtgatgtgtgcctgtagccccagctacttgggaggctaaggcaggaggattgcttgaccccaggagttagaacaatcctgtaacccctaaaagtttttgaagcccgtttgttcatccttgtctcttgtcctgaccccagcaaccactgatctgtcttctgtatatggttttccatttgtacaatgtcacataaatggaatcctacagtccacagcctctgaatctggcttcacacagcataatgcatttacggcattgctgggtacacgggtagctggtcccttctggtccctgagtagtgttccatggtgtggatatgccacatacctctagccactctcctctctagggaaatctagcaaaccggcttggccggccctgcatcagctcgggaccccccagaagaaggtggttcctctttctcattttcacaaaggcaccatctggctggcggggggcctgtggcctgcaccccatcactacccaccccccacatcaagagctgaccccaagccgggggagctgctcatctccgccctcagagctggaatttcatcttctgtttctggtgactcatactgtgagccccgcgatgaaattacacctgcctgccgctgccctccgggcctctggccccatgcgatcctcccgccgccatccaggtgggctctggagtaattgaggctatggggccaggacagctggaggttgagggcggtgccagggaggggagctgtctgtgccctggggtgtcttgcccatcatcttatgtatccccaccctgtgggagtctggggttcctggtggtgcgtctctggtcttcactcctgcagctgttttgcttggggtagaagtttcatgtttgcctgaaataagagcaggacttctgagggtagggaaggaaggtggtgaagccactgttgcaggcaggagcaggagttaggatcaaacggaacagggctggccgagtgatgtcacatctctgggctttggtttgttcatctgttcttattattattttgagacagggtctcgttctgtcacccaggctggagtgcagtggtgcaatcatagcttgctgcagtcttgaactcctaggctcaagtgattctcccacttcagcctcctaagtagctgggcttggaggcacttgccactacacccagctaatttttttattttgtagagatgggggtctcgccatgtcgcccaggctggtcttgaactcctgtgttcaagtgatcccgcaacctcagcttcccaagtgctgggattagaggggtgagccactgcgtcctgcctgttcatctttaagtgggagaacagaacactaggtttgcagggctgtgagactcagctgagggtaatgtgagtgtgtggattaccacagagccctggagggccccaggggccaccaaggagcgggtggtggggacatgtgaggctcaagcctcctgtgcccctttgggccagagtaggaccactgttgttttttgtttttttttttttgagacagagtctcactctgtcgcccaggctggagtgcagtggcgtgatcacggctcactacaacctccgcctcccgggttcagttgattctcctgcctcagcttctcgagtagctgggatcacaggtgcgtgccaccacacccgactaatttttgtatttttagtagaggcggagtttcaccatgttgtccaggctggtttcgaactcctgacctcaaatgatccacccatcttggcctcccagagtgctggaattacaggtgtgagccaccgcgccctgccctaggaccacttttaccagagttacctgttagagctctaaatacagttctggttgctaaatgtttggaatccactgctgcctgaggtcagccctgtgtgaacagtggctattctggtgaatgtttttgtggctagagcctagattatggtggtttacggactccagcctgtcacttgcctgaggctgagcctcagtttgaccctctagaaaatggaaccacagcaagtacctccacaggtttgccaggtgggcatgaatgaagcaggggagcccagcaagagtttgtcagtttcccattggcaaatccatgagtttcccagggctctcggcttcctaaggagatggagcttcctgggtgatcacatgtcttgcgtgggtgtcttgagagatttggggggtttttactttgtttttgttgttgttatttgtttgtttttgaaacagagtctccttctgtcacccaggctggagtgtagtggtgtgatcacggctcatggcagcccccctcctcctgggttcaggcacttctcccgcctcagcctcccaaatagctgggattacaggcacctgccaccacacccggctaatttttgtgtttttagtagagacggggtttcgccatgttggccaggctggtctcgaacccctgacctcgagtgatccacctgcctcagcctcccaaagtgctgggattacagacatgagcacaagccaccgcgcccagctggtttttactttgttatttaatttgttatttgtgaaatcgttgtggcccctctctaatgaaggttgccccaagtacctttcccctgtaccccacccttgcctcccacccctaccgggttccccaaagtcctcaaaggctggaccctggggccagcactcggtgggtagcctggaaagaggttagccctgtgcaggaaggaaggcccttgggtgctcctgggtggctccttgcagcagacaagacccaccgcccacccacctggctccagggtggtcctggcagctccaaggggtcttgtgactctctcagtctgatgtttctctcatgtttatccaggagctggtttttcaggcatggccgcttcttgcagtgaggccaggtggggagaggcagggctttggggaaggaggtggttacctctgctcccagggcacaccctggctgccagctgtgggtgcagccctctgggcaggtgggcaaaccacatcctccctctttgatcctggtccacctccccacctgccccgggccaccagctccctgagatattctcttctcagcatatccaaaggagagatgctcttggtggccctgggtcagaggccagggctccctcacttcacagcagggtgcagtggaaccatcagggtctttgaagccagacacacctaggttcaaatcccagcctgactgctgagctgctgtgtgaccacaggcaagtgactgtacctctctgagcctcatctgaaaaaacaaggatagttttcttatatagtattgccaggttcttgggaaaatcagtgtattcagttgcggggagctagctgccatctcagtgaagaacactttgtcagcttgtcacgtgatgaccccagaagctggccctgtgggagccccactcccccagacagtgaaccttggaccccatcattccaagatctgttcttattttctgcctgtctgggacacaccccctctgtccgtggggtgtggggtgtggggtgtggcatgcctcaatttatttattttttttgagacagagtcttcctctgttgcccaggctggagtgcagtggcaggatctcggctcactgcaacctctacctcctgggttcaagtgagtctcctgcctcagcctcccgagtagctgggatcacgggcgcccgccaccatgcctggctaattttttgtatttttagtagagacagggtttcaccatgttgcccaggctggtcttgaactcctggcctcaagtgatccacccgccttggcctcccaatgtgttgggattataggcatgagccactgcacccggacagcatgcctcggtttctgcttctgcaaactgggaaaacctcaaaggtagaactggttggtccccttggcctgccgaccccttagcccctcaaggtcacagtcagccatcccgcttgttagaggccaggccctgttctggggcgggggatacctgtggctgcttaggggacgggagacaatgccactcccaggtgtgtttgatggcagcctgcagaagtggctttctgcatggccctggaggacggtgatttggacagaagcgtagggccagagacaggacgtgacggtggggctgctgcattggctccaggtaaagatctgtatctgatggcctcactcccaggcagctcaggggttcccgtggctcctggaaaagctacagactaggcatggccaggccctgcctgtgtctctctgtgccagccacgatgagcctcatcgtttctaaaacgtactgtgctccgtctcgcttcctggaacgctgctgcctctcccctagagcgtgcgtaatgctccccggctgtgtccctgggctgatttctcgttgcaggtcttagctgggttgtcactcctctctgcaaagcttccctgacctcatctccctctccaggtcacgttaggtgcctcttgtctgtgtccccagccacagcccgcatcacaaacaagactataattgccctcgtgcttgtctgtcaccttcacagacagagtgtgacttccagtgggtcacggccccatcatcatgttgtcctccgcatccctgaccttagcaccctgcctgttgcggagtgggcatcctgtgcaaccttgtcaagtgaattagaagcaagctcggggtgggggcccatgaagggtgggggcctcctccaccctttttctttctttttttttttttttggagacagggtctcgctccattgcccaggctggagtgcagtggcatgatctcggctcactgcaacctccgcctcatgggttaaagcaattctgccttagccctccccagtagctgggaccacatgcacctgccaacacacccggctagtttttgtatttttagtagagatggggtttcatcatgttggccaggctggtctcaaactcctgacctcaagtgatccacccgcctcagcctcccaaaatgctgggattacaggggtgagcccccatgcccggcccctctccatccttcaatcccagctctcgttggcgctcctctacccatcccaggagctgcttctgccggcctggctgtggcgttcagaggcatctggagggcagtggcgatggcagtgggggcagcttgtctctctgagccgagtacagcccaatttggagcgtttccctccaggaaaggcagctgatgtgtgcagacagcacaagtgtggagtgccagaacagttaatcctctgggctatttatttatttatttattttgttttgttgttgagatagagtcttgctctgtcgcccaggctggagtgcagtggcgtgatcttggctcactgcaacctccacctcccaggttcaagcgatttgcctgcctcagcttcccgagtagctgggattacaggcatgcactaccacacctagctaatttttgtattttattttgtatttaattttttatttttattttttgagtcagaatctcgctctgtcacccaggctggagtgcagtggtttgatctcgactcactgcaacctctgactcctggtttcaagcgattctcctgcctcagtctcctgagtagctgggattacaggcgcccgccactgctcccggctaatttttgtatttttagtagagacggggtttcaccatgttggaccagactggtcttgaactcctgtcctcaggtgatccgcctctgggctatttagacacacatgcttgtgtgcatgcatgggtgtgtatatgcacatgtatgtgacattcctgaggccaccggcggtgacgaggcctgattacttgacgttctgctgaatcctgactactagcctggagctttactccccagtgtacacagctccccgagtcctggttagtggtaaagaggggactgtcccctgtcatttagggctgcatttggctacaggtaattaaacacccaactgtaaatatagcaaatatctaaatattaagccaggtcaggtgcagcagctcaggcatgtaattttagcacttcggaaggccgagatgggcagattgcttgagcttaggagtttgagaccggcctgggcaacgtagtgagaccctgttctctacaaaacataaaaataattaaaaaaaaaaaaaaaacccagccaggccgcagtggctcactcctgtaatcccagcactttgggaggctgagacgcgcagatcacaaggtcaggagttcaagaccagcctggccaacatggtgaaaccccatctctactaaaaatacaaaaaattagccgggcgtggtggcacgtgcctgtaatcccagctacttgggaggctgagacaggagaatcacttgaacctcggaggcagaggttgcagtgagccaagactgtgctactgcactccagcctggcgacagagcagcgagactccatctccaaaaaaaaaaaaaactgtgtgtgtgtgtgtgtgtgtgtgtgtgtgtgtgtgtgtgtgtgtgtagcctggcagactttagatattaaacctgacagttaaacaaaaaggagtttatttattcctcataagaaaatatggaagggccgggcgcggtggctcacgcctgtaatcccagcactttgggaggccaaggcaggcagatcatgaggtcaggagagcgagaccatcctggctaacatggtgaaaccccgtctctactaaaaatacaaaaaaattagccgggcgtgatggtgggcgcctgtagtcccagctactcgggaggctgaggcaggagaatgacgtgaacccgggaggtggagcttgcagtgaaccgagatcgagccactgcactccagcctggacgacagagcgagactccatctcaaaaaaaaaaaaatatggaaggtatttggaggataggatgggtacttatgagtaggtatttggaggctgggatgggtacctgtgagtaggtatttggaggctggggtaggagcgtggtgatgcttttcagggttcagtgatgtctccagagacttgattctgttcttctctaccatgttggattttctttttttttgtaagtttattttaaaactattcctttaaagtgtataattcagtgttttttttaaaatatattcacagagttgtgcagtattcatcactgtctaatttcagagcatttttatcatcctaagaatctccccccattaagcagtcagccctcattccctcctcccccatcccctggcaaccactaatttactttccatctctgtagatttgcctattctgggcgtttcttgtagatggaatcatgtaatatgtggtctttcgagtctggccttttctcagtgagtataatgtgttcaaggttcatccacattgtagcgtgagtcaatgtgcctttctttttatggccaaataatattccatttaatggatagatcatatttatctgttcatcagttatggacatatggggtgtttctactttttattattttattttattttgagacagggtcttgctctgtcacccaggctggagtgctttggtgggatcatggctcactgcagcctcaaactcctgggttcaagggatcctcctgcctcagcctcccaagtagctgggactgcaggcaccaagccaccacccctgactaatttttaaatatttttttggtagagacggcatatgtattagcaaggccctgtctctaccaaaaaagataaaaattatcatattctttattatgatatcattataccataaaattcaccattttatttatttagtgtttttagagatagggttggccaggctctgttggccaggctggagtgcagcggtgcagtcttggctcactgcaacctccatttcccaggctccagctattctcctgcctcagcctcccgagtagctgggactacaggtgtatgccaccatgcctggctaatttttgtatctcttgtagctgtgttgcccaggctggtcttgaacccctggactcaaacaatccacccacttcagcctctcaaagtgctgagatagataagcataagccaccacacacggccaaattcaccattttaaaatacgctatgcaatatttttagtatcatcatgaagttgtgtgaccatcgccaccatctaagtccgttcattttcgtcactctgaaaagaagcctgttacctcattagcagtctctccattccccagcaccccccactccagcccctggtaattgctaatggttgtctctctgggtttttgatagcttatttataacattcagccttcacctaccatatgactaggtatttacctatgagaaatgaaagctcaaattcacataaaaacctaaagaggaatatgtatagtggctttattcataattgccccaaactggaaacaattcagatgtcagactgcccagtgaataaacaaactggaacatccatactgtggaatattagttagcagtgaaaaaggatgaatgatggataccacaccaccacggggaaacctcacgagcattgtgctaagggaaggaagcagactggaaaggccgcttccaacctagttctgttcatatgtggggttttttttttcgagacggagccttgctctcttgcccaggctggagtgcaatggcgtgatctcggctcactgcaacctccgcctccctggttcaagcaattctcctgcttcagcctcccaagtagctgggacaacaggcgtgccaccacacctggttaattttttttgtatttttagtagagatgggatttcgccatgctggccaggctggtcttaaactcctgacctcaggtgatctgcccgcctcagcctcccaaagtgctgggattacaggcgtgagccaccgtgcccggcctctggttctagtcatatgatgttctggaaaatgcaggattagggacagggtttgcctgggagtgggagagtttttggggagatggaactgaaatgcgttttgattacggtggcagtcacctgactgtttgcatttgtgaaaactcatagaaatatggccagaggctcatgcctgtaatcccagcactttggaagactgaggcaggaggatcgcttgaggtcaggaatctgagaccagcttagacagccaaaaaaattagccgggtgtggtggcacacagctgtagttccagctactcaagaggctgagccgggagaattgcttgaggctgggagttcaagcctgcggtgagctataattgtgccactgcactctagcctgggtgacagagcgagaccccatctctacaaaaagatttaaaaattagccaggcaccgtggcttgcacttgtattcccagctactcaggaggctgaggtgggagggtggtttgagcccagaagtttgagaccaaactatgtttactgggtaacatagcaagacccctgtctctatctttttgaaatatttaaaaaaaaaaaaaaaaacaaaaaaaaaaacaaaaaaaacggccgggtgcggtggctgacgtctgtaatcccaacactttgggaggccaaggcgggcagatcatgaggtcaggagattgagaccatcctggccaatgtggtgaaactctgtctctactaaaattacaaaaattagccaggcatggtggtgggtgcctgtaatcccagctgctcaggaggctgaggcaggagaattgcttgaatccgggaggcggagtctgcagtgagccgagatggcgccactgctctccagcctaggcgacagaatgagactctgtctcaacaacaaacaaacaaacaaacaaaacagaacactcatagaactgtatgtcagaaagaatgaattttattgcatgtatattacactccaggtaaaaaggggcctggcctggaactggcctttccagagtaactccacttggagttcaccatctcatttgttctagttggtgccaccatcccttctaccaatggtgagttttggtctgtcaagttggccaacctgagttgtgcatagggccggggccagatgctgcagtggggcccccctctttccccttccttggacatcctaacccctcttggggtttcccgagcttcttggatggagggagccatagaatgttagaactggagggaacctcagaatatactggcctcttctctttttcagatggggaaactgaggcccagggctgggaagacacttgactaaggttctagagttacgaggatcaagatctaaaaccacatctggccgggcacagtggctcacgcctgtaatcccagcactttgggaggccgaggcaggaggatcacttgaggtcgggagttcgagagcagcctgggcaacgtggtgaaaccccatctctattaaaaatacaaaaaaaaatttagccaggcatggcggggggtgcctgtaatcccagctacttgtgaggctgagacatgagaactgcttcaacccgggaggcggagattgcagtgagccgagatcgcaccactgccctccagcctgggcaacaagagcgaaactctgcctcagtaaataaataaataaataatcaatcaatcaatccacatccatgactcttggtctgggcctccttgccctcctgcagatgcctctggagcctcccttgtctcctgctcctggttcgggaggctggacaggcccaagctggccccacagctggtgggaggctttgctgcagcgtaccctggacagggcagagttgggtagggaagggagagtggtcagagcatctgcaacaccgcagcggaggagaggagagagtgcggtgaaggctggcaagtggttgattatggggagctgtgagaatggttgatggccccccagggacagacaggagaacagagcactggtttctgctctttggagctcctgacatcacctggagtaacccccaagcctcatgatgtgttcaggtagatcccagcaaatgcagaattggggtcagcctggttgggatgacaaccagaagagcttcctaagggaaggaccccaggagaacctggtgggggcaggggagagatcttggccggtgtcccttcccaagggaggaacccagtctcagggacgtagtcccgccccctggtttattctggtattgctgtgtccaccagcctggggctgccaagagctctggaaacttctgtgaggttgggcgtggaggttgcatggtggcagctcagggcttttttttttttttgagagagggtcttcctctgtcgcccaagctggagtacagtggaacagtcatagctcactgcagcctcaaactcttggcttcaagtaatcctctcactttggcctcccaaaatgttgggattacaggcatgagccactgcgcacggctttggggattcttattggctgtgaaccccgtgattcattgctcccattttcttggtttagtgcccactcctgcagatgaggggaggcagactgaacctcctggagtctggggtctgggtggtgagcctgcccacttccaggaactgtccataacccacccaccatcctggacagcccgcaaccttggtagcacaggacacttgcccactgccctatttttggctcagaaaacgatatcttcagctgggtgcagtggctcacgccgagctgggcggatcacctgaggtcaggagttcgagaccagcctgaccaacttgatgaaaccccgtctgtactaaaaatacaaaaattaaggctgggcgcggtggctcacacctgtaatcccagcactttgggaggccgaggcgggtggatcacctgaggtcaggagttcgagaccaggctggccaacgtggcgaaaccccatctctactaaaaatacaaaaaaaaaaaacaaaaaaattaactgggcatgctgatgggcacctgtaatcctatctatttgggaggctgaggcaggagaattgcttgaacccgggaggtgagttcaaccactgagccgaggtcgtgccactgcactccagcctgggcaatgaagtgagactctgtctcaaaagaaaacgatattttcttacctatggggtcccctctggttttcaggactcacaatgcctgcaggaagcccacctcaggtctcactgtagcccccctggtggggaaacccctctgcctctagcagggcaggcagaaaagatgtgtttggaataaataatgagcctatgggagagccactcccatcttggtgcaaatatttgtgtgtgaatcactcatctggacagtgggactggattgtggttgacagtgagccatgcctggggggctgtgcaggggacattgtaggggtgcagggccatgtttactccagatcccagcagacttcactttgaagctggcccctgactctttgtgctgtgtgaccttgggcgagttgctcagcctttctgagcctctacatcctcatctgtaaaatggggagagtactgttgtgtttgtagtgttgctgaggtgggttgcgagatgcccatcagcagcacagctcctgccactgatggctgcaacgcaactgtgatttctcagaaatgtcatcccaggcccagctagccctgaggcccaggtggggttttgagggaaagggatctggctgggagcagtggctcgggcctgtaatcccaacactttgggaggttgaggcgggaagactgcttgagtccaggagtttgagaccagccttggcaacatagcaaaactccatctctacaaaaaaaataaaataaaataaaattagccaggtatggtggtgtgtgcctgtagtcccagatactcaggaaggatttgggacgatcacttgaggctaagagtttgagaccagccagggcaacatagcaagactccatctctacaaaaaataaaataagtagctggacacgatggcacacaccttaagtcccagctacttgggagtctgaggcagaaggatcacttgaacccaggagttggaggctgcagtgagctatgatcacgccattgcgatcataggctgggtgacagagcaagagaccctgtctcttaaaaaaagaaagaaagaaaagaaaaatgatactcaacccttgtccattgggcctgactctcacctcccacctctactttgtgaggaagggacagggtgttattatgtcttcattggagggtactggggcccagagaggggaaggaagttctccagcatcacacagccactcgaggctgagcctccactagacccagacctcctggggcctggcctcatgtgcgttcctgagactacagggttttggtgaggggctgccctgccatctgttgctgtaccctagggaggggagggtgtggcccgggctggactcctccaagttgctctgtccctgggttttggaaggggaggggccgcttcatgaaattgcaccacctggccaaggctcgggcaagcccaggttggatgcaggtggccaggcttttctgacaggtgagggcagaagtggaagtaatgcaggtgttcagagaaagggccggatgtgtgtgcatgcgcacacccagctacaaaacaaggggtgccattcctcagggaccaggccattaacgtgagccacccgtctgatgcgtagtcacccgccggggtgacgggggacttcctggactctgcggcctgatcctgcctgtctggtgacattcctgatctggagtacacattgggcctgcagtgggtgctttggtgtttgtggaatgaatgaatgggctggcggcacccactgatgagcatctgccaagatgtctgtgtgcgtggaggtggcaggtgtggtccaggtacccgataacggatagacacctgtacaaaacagcctcttctccaatgcctggtggtggtgagggatgggggtgtggctattttgcagttggatggtgtggacacttacaagtcaactaatcccgatgctctggactcctgtctgtaaaatgggatggcgtaggtgtgggctggtggtgcctggtgggtcccgcccaagccccagagaaggggctgatggcagctagttgttatttttattactaaatcatggctcagcccagcctggcctggcaagcccaagttcctggtggatgtctgcctcttccacgcccgcttggaagccttctgaacctccttttttttttttttttttttttcttttgagacggagtctcactctgtcgcccaggctggagtgcagcggtgcgatctcggctcactgcaacctctgcctcccgggttcaagcgattctcctgcctcagcctcccaagtagctgggatacaggtgcacgccaccaggctcggctaatttttttatttttagtagagatggggtttcactgtgttggccaggctgatctcaaactcctgaccttaagtgatccgcctgcctctgaacctcccagatttcatcggttccccaccgtactctcctgcctctagcctttgcccaagctgaccttggccccagtcttccccactgaacagccacccagcctttggggccagtgctcctgggccgatgccagccatccatcctggatgtgcccacgcctggtcactccccacatgaggagctgatgatctttggtcaccgtttataaactttagcttctctttcctcacccaggagctccagggcaaggagtgggcctgattcacccccgttcagggactgggtcctaacaggtgtggtgaaaatgagcacttagtcagcgtcccacagcatctaaaagacgggaacaagggctgaggatgtgggtaggcccaagactggaaatagggaagcctctggaatggggactagaagatgaaagggctctggaagatggggcatccaagtgtttaaagcaagaacggggctgggcgtggtggatcgcgcctgtaatcccagcactttgggaggctgaggagggaggatcacttgaggccaggagtttgagaccagcctggccaacatggtgaaaccccatctctactaaaaatacaaaaattagccacacatgccagtgcgcacctgtaatccccgctactcaagaggctgagtcaggagaatcacttgaacctgagagacagaggttgcagtgagctaagatcgcaccagtgcactccagcctgggcgacagttttttttttgtgtccaaaaaaaaaaagaggtgcggggagggccagagggcatttggggtgggacggggcagggcagggctgggtgactggaatggggtgactataatgaatgctttggagtaggtcagggcaggtggggaggccagatgccaggggagggagggggcatggggatccttccatctggggccaaggatggcaaggccctcagacaacttctagcccaggttctccattgacagatggagaaactgaggcccagggaggggcagtgctagtgctgaggttttacatagcaggtgggctgttccccagcccactgcagggcatagcctgccctgggacacctgtcctcacccgttggctcagtggttgcaggggcatgggtgggtagaggtcggggagtgagccggctcaggcgggcagggctgggggccccgtgagccagcgccccaggattagatcacccacgagtaatgggcttttttccgtccagccttttcccgacaagaaaaggcctgatgttcctcatccgtgttgttctgagaaggcatgtttatgtctggcaagcgaagggttcttgggagacaggatcccagggcccccctgcactgcctggccccaggggttggcaccgccccagagctggtttcctcccactgtctcctgacacccagcccccacgcttttcagatgcctgcctgagaacaaataaatacttctgcaccatgcacatgagctcagataagcctccggggctcagccagaactgggggcaccaaatgcccgggttccctgacccctagctgggtgccaagcctgcatttcccacccagcactccccaaccgccccttgcgtggagggacagagatatactgtgagcaacacgggacctgatgtcaggggtggacagcagctcggcgggtgatgtcagcttgagcaatcgtccccgtcatcactgctgttaagtgagcgggcacttggtgtccccaggcccagcgccaggccctgttcacacattctcacgtggggctctcacagagctgagagcagtagaattaccatcacccttttgctcagtggggagaggaaagtttgagcattgtgtgtgtgtgtgtgtgtttagagacagggtcttgctctgtcacccaggctggagtgcagtggtgcgatcatagctcactgtagcctagaactcttgggctcaagcgagcctcccacctcatcctcctgagtagctgggattacaggcacatgccaccacgcccaactaatttttatgcttttagtagagatggggtttcaccatgttggccaggctggtctcaaactcctggcctcaagtgaaccacccacctcagcctcccaaagtgctgggattataggcatgagccaccagccccacctttttttttgagatagggtcttgctgtattgtccaggctggagtgcagtagcgtgatcatggctcactgcaacctctgcctcctgggcccaagcaaccctcccaccccagcctctggagtagctgggactacaggcacatgctatcacactaggctaattaaaaaaaaaaaaattatagagatggggtctcactatgttgcccaggctggtctcaaactcctgggatcagaaacctggtggtcattccaggtgcctcccttgggaccccccgtcgccagctcctggtcccaaagctctgccccgtcctccatcccctgctgctgtctgcttcatgcctggctgtctctggcctgggctgtcgcagagacttggcaactcctggctccccaactccaagcatgacccgacagttcctccgccgtagcttcctgggatccccctcactgcccacgtctcacccccgccccacaccctgcagcgaggctgaccttccgaggtccttggcctcaccccaatggccacgctggtctctgcccaccacttcctgccctgccctgcacactccagccatgcagagctggatttgttccccacccacccacccactcccacagcctctggccccgctcaggcccgaccaggacacgtgggcggcccaggctggcggttgggtttcctgggcagccagtaatttggcactccttcaaacaggtctttatttattcagcatttatttctaggggaggtgggtgctgcggtggggcagggaaggcgcctcccttgtagaagagcagggcctgggcacagtgcctgtctcccctcctcacctgcaaacgccaactcccctgggagggtcccggcagctcaggtgtcacctcctccaggaagccccaccctgactgcctcacccgccgtcctgggcttcttccatgccacttatttttatctttcactgaagcataatttacttccagtaaagtacatgagtacatgaatcttttttttttttttttttttttggagacagagtcctgctctgtcatctaggctggagtggcgtggtcttggctcattgcaacgtccccatcctgggttcaaacaattctcctgtctcagcctcctgagtggcttataggcgcgtccaccatgcccagctaatttttgtatttttagtagagacggggttttgccatgttggccaggctggtctcaaactcctgacctcaagtgatctgcccgcctcggcctccctaagtgctgggattacagtcgtgagccatcgcacccagcccaagtacataaatcttaagcatcccgtgtgatgaattttcccccgacttgtatactcatgtaaccatcactcagctcaaatccttgcactgtgttttaatcttttttttttttcccagtagtctatttttttggtcattttccctgccagcctgggaatccttcaagggcaggagcacctgctgttgggccctgtgcggtgtgggacacagtgtgagagagtattggtgcctgtgagctggtggctgtgtccccacccctgtgattgtccccacgtgtgtgtgtgacggaggctgtggccgtgggaacatgtggatctgtgagcctggccaggggccccagtgcaggggcaagcgccccctcctccactggaagagagccttgtccgatcccccagccaagggcctttgcagggagccgtggccctgctggagagtccccgccggctgacagcccggagattagtctccaaggccacaacgccagttgccataggcacgcaggcccgcgtcaggactgcgatttctcatcctggtcacgcaggcaggcggccgcccctgcccgcctgccaggatccaggctcaggctttaaataacaagggtggaaacctgaaccgcggagccgtctgcccggcggatcctggcctcccctcctggtagagcaggcatggggcggcctggaccccgcatactgccggcggcggcggagtccctccgtgcccgccccgggggacgggagagaaatggagaaacctgagtttgggggctctctttgagtgctcctagtacctgatgcacagcccgagctgagaggagacagccccttttcctaaatcccgtcctccacgtggaggaaggacgccctaccttccagaagcctagatgaagggcagatggggcttcgcatggccaggcctcagatcggcttcccccagcccctccagggaagaggcaggaggctccctcacttccccttggaaggcagcatgaatccctgtacttcctggactgcccctttgcccccgcctggggccaactttcctgtcatggggtggagcagctgtgttggatggttggttttgctttttgttttgctctattttttatttaaaaggaaaatttttttagaaatgaggtcttgctctatcgcccaggctggagtgcagtggcgcaatcccagttcgatgcattcttgaactcctgggctcaagccatcctcccacctcagctttctgagtagctgtgacgacaggcgcgtgccaccacgcccggctcatattttaaattttttgttagagatggggtcttgcgatgttgcccaggctggtctcaaactcttggcctcaggcaatcctcctgcttctctggctcccagagtgttgggattacaggagtgagccaccacgcccagcctgcttttgtttttaaaggatgaggtttctgttgtttctttccaaattgtaaaagtaatacttaccttaggtgacttagaaaatacagaaaagtagagggaagcaaagtcaggcatggatcccaccctgagatgcacggtctggagtttgcatcccgggctgcactgtgtatgcccctgaggtcatcctgtccagtgttggaatcagcctctgctgggcatcaggttgcctgcacctactccttgtttatatgtgggtgtgtgtatctgtggatgtaccaagtgaaagctttggggaaacatctttgcatgtaaatctttgcatttgggataattaactcaggattaatttatagaattataagtcctggagcgaagggtgggaacagagttaaaattgaacttcctgaaacacgtcacagcgtcaccaaatcgcttggctgggaggactgtgtgcacccagggcccttctgtggggtgggccaggatttagtgtgaaactcatggctgctaggctgggaagagctcgaccacaggtgtggggttttgtctccagtgacattcccagctggctcttgcagcccctgccctagtgacagcatggggtgagggggccagaggaggctggaggtggagccctgcctctaggcggaactgtaccatctgtagttgcagggcaggattaaaaagggacagttttgctgtttgtttgtttgtttttttctgtcatctgactgggtgtcccaatacctgatgtctcctaaaactttttttttttttttttttttttgagacgggcctccttctgtatcccaggctggagtgcagtgatgcaatctcggctcactgcagcctcaacctcatgggatcaagtgatcctcctgccttagcctcccgagtagctgggacgacaggcatgcgccaccacacatggctaaattttaaattttttgtagagtcagggtctctctgtgttgtccaggctggtctcaaatttctgggctcaagtggtcctcctgcctcagcctcccaaagtgctgggattacgggtgcgagccactgtttctggccttatgcacacttttcattgagaacaaagttatttgttgtaagagaaacaccttgataactgttcacacactaaactacccaggtaaccagcacccagatcaagaaacagcattgacaagcccctctcacccccttccagttactaccactctccctgacccaccacgataaccgccgttccatctcctggcttcagaatgtggcctccttttgaaccttacataaatggaattctaccatgtgacctcagattctttcatcatccttgcgagattccaccgtggtgttgcgtgtctttgtggtttgctcatacgtctgatgccttttccaatagacggggcacccaggaggagtcagtggaaacacatgtaccgtggaaacagatcaggtcttgcgctgaaattcggatacctctgaattactgcccatcgtcaaagaaataaagtttatttccctaaaggatgttttgtggtgaataggaaagaatttgcaatcagcgtagctgttaagcccacaggagagcaagttgtattatgttgtgagcctgggttgggtgtgcagagatctggggttcagtctgacgcctctgggccgtggtttccctagatggacatgcaggtggttagatgaggggcccatctagctcagtgctgtgatgctaagcatatacttctcagtgctaagaggttgttttccaaagtgtttgaagtttgctcttaagatcttatttaggccggtcacagtggctcattcctgtaatcccagcactttgggagactgaggcaggattgcttgagcccaagaatttgagcccagcctgggcaacatagcaaggccccatctctaaaaaaaaaaaaattttttttttaattagctgggcatggtggcatgtgtctgcagttccagctacttgcgaggctgagggaaagaatcgcttgagcccaggaatttgaggctgcaatgagctatgattgcagcactgcactccaggctgggtggcagaacaagactgtctctacaaaaaaaatttttaaaaatcaggcatggcagcatgcacctgtaaccccagctacttgggaggctgaggcaggcggatggctggagtccaggaatttgaggctgcagtgagccatgatcgtgccactgcattccagcctgggtgacagagcgagactccatctttacaaaacatttttaaaaaaattagcagggagctactcgggaggctgaggccggcagatggcttgagtccaggagtttgagggtgcagtgagccataatcacgccattgcattccagcctaggtggcagagcaagactctgtctctttaaaaaaaaaaaaatcttatttaccaacttggctcatttctaagtggagcaaaaatgcagtgtctcacttctgctctgcctgaattacctccaggccagatttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaattctctgtcagcgtaacggcaatgaacctggacttgggtcttcaggaaccaaagccatggagtcaaggatttggagagatggtatattcatcaccgggcctaacatgatggtctttttttatttttaaattgagacagggtctcactctgtcacccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctcactctttcacccacccaggctggagcgaagtggtgcgatcttggcttactgcaacctccaccctccgggttcaagcaattctcctgcctcagcctcccgagtagctgtgattacaggcacctgccaccacagccagctaatttttgtatttttagtagagacgagatttcaccatgttggccaggctggtctcaaactcctgacgtcaggtgatccacccgcctcagcctcccaaatgttaggattacagtcatgagccactgcacccagcctgtctttcctttttaaggctcagtaatattccattgtatggatagactgtggttttttatccattcatcatcggacgctgggacggtttctgccttttggctattgtgaatactgatcctatgaacatggctgtacagatgtgtctttgagactattactgttttattaacaacattgctgtaatgagggatctcaaatctggagtggatctgagaaatcgcctctttcaaccccttatccaatgcttgagtccttccttccagaatcccactgagacttcttctggcctcagatgcgtgggtgggagacatgccacctcccgacacctctgaccaagggcccggagctgggtggcttagggtgcaggaaagaggcttgtgagtgggatcatgccagagggatgtgcatcaaggcatcctctagctacagatgccccaggggaggcagcagtggggctgctgcaggagaaacctggaatggatgtttggacacactttcctcaatggccaggattgatggacagtggaattcatcagacgagtcttggagactgaggcctttaaaaatagatgcagctggctgggtgcggtggctcacgcctgtaatcccagcactttgagaggccgaggcgggcggatcacgaggtcaggagatcgagaccatcctggctaacacggtgaaaccccgtctctactaaaaacacaaaaaattagctgggcgtggtggcggacgcctgtagtcccagctactcgggaggctgaggcaggagaatggtgtgaacccaggaggcggagcttgcagtgagccgagatagtgccactgcagtctggcctgggtaaaagagcaagactccatctcaaagaaaaaaaaaaaatagatgcagctgggagcagtggctcacacctataatcccggcactttgagaggccgaggcaggtggatcacttgagggcaggagtttgagaccagcctgggcaacatagcaagactctgtctctactaaaaattttttaaaaaattagccgggtatggtggcgcaatcatgtagtcccaggtactcgtgagcctgaggcaggagaattgcttgagtccaggaaggtggggctgcagtgagctatgatcgtgcctctgcactccagcctcggtgacagagtgagaccctgtctttaaaaaaaaagaagaagaaagaaaagaaaatgcctcccatggaatctgtttctttttttttttgagatggagtcttgccctgtcacccaggctggagtacggtggcatgatcttggctcactgcaacctccgcctcccaggttcaagcagttctcctgcctcagcctcctgagtagctgggattataggtgcccaacaccacgcccagctaatttttgtatttttagtagagatgtggtttcaccatgttggccaggctggtctcgaactcttgacctcaagtgatccgcccacaccgccgtggagtctatttctgttaggaatgtgtttgttgcaagcaacctgagaaacagaggcttaggagagaggggtgtctcgtgtaacaggaggcatgggtgggtggtccagccgcaggcagctgctcaggcacatctgaggggcctgcgccatctctctctctctcctctggctgagggctttggtcatcctggcctaaagtggatgtcagccaccaggcagggcatagggagtaagggattgagccccccattgcctgcttccagggaaactctgctcttttgtttgggaatgcctcactggttagactgtgtcttgtggtcatctctggctgcaagagagtataggaatgggaggattttgtgttgtggcccctacagaagaggagagcaagggagaagttggttatatggggattgaggtaccagccacacagcatctgtctgcctcacaatcccagcacgttcagctgggcatggtggctcatgcctatagtcccagctactcaggaagctgaggcaggaggattgcttgagcctaggagttcaggaccagcctgagcaacatagcaagaccatgtctctacaaaaaaaaaaaatgaaaaaaaatagccaagcgtggttgtgtgctcctgtaatcccagctactcaggacactgagggtggcgtggggaagatcccttgagcccaggagtttgaaaccagcctggacaacatagcaagaccctgtctctaaaaacaaagaaatgagacgcattagacaaaagttcccaaaagttggactcagtgatgtagatgagagaattacaagataacttttcttttcttttttccttttgagatggagtctctgtcacccaggtgggagtgcagtggcgcgatcttggctcactgcaacctccgcctcccaggttcacatgattctccctgcctcagcctcccaagtagctagaattacaggcacccaacaccatgcagggctaatttttgtattttaatagagatgaggtttcgccatgttggccaggctggtcttgaactccggacctcaggttatcgaccgcctcggcctcccaaagtgctgggattacaggcgtgagccactgcacctggccagggtaacttctctctttgtctctattccctttctgaatatgaaagctttccagttctacttgatatcgtaagaaatactaagtcacccaaagtgtaacacctgttttttgcagtctcctatctaagaactaaccagacccgactctgcttagcttctgagatcagatgagatcaggctctttcagggtggtggggccgtagactgtttttgcaatctctaggaaattttttttaaagccagagaaagataaattatccacattacttaaacaatttttaaaaatatacaagaaagcctagcttatttaaagcccaaaacactgtaattccattggtaacaaagatgttaaacatttaaaatgtgattaaatctaaaattggtggcttctgaataaactgtagttttgaatttgatacagcaaatctgtggcaatgttgaacaaaacaacttatacataatgcatttttatattttaaactaacaaagatgcttcagaaatatagaggacatttttaaaagaattacttatattttaatcttttcaaattttccattttgtttccatcacttccatttttttcagaatattgtgcctcctcaaacatcatggtaagagggtggtgggactagagatggagccctcagcataaaaaataaagttagccgggtgcagtggctcacactcataatctagcactttgggagcccaaggtgagaagatcacttgaggccaggagttcaagatcagcctgggcaacacagtgagaccctatctctaaaaagtaaaaataaaaacttagctgggtgtggcgacacacgctgtggtcccagctactcaggaggctgaggcgggaggatcgcttgagcccaggagttggaggctgcagtgagctatgatcacacccacttcactccagcctagagacagagtgagaccctgtgtcaaaataaagaattgtagcacactcagaatcttcaaatcttgctctgggtatcaaaatcggatgtaggctcttcagctgcagttggaaaggaaattgtaaaatagacctgtagtcaaaaacaaatgggtgactttacaactggtaaagactgacttaagtaggatgtttttagctgcaaatgaaagaaacctctggctgggcacggtggctcacgcctgtaatcccatcactttgggaggccaaggcaggaggattgcttgagaccaggagttcagaaccagcctgggcaacatagtgagaccctgtctctaacaagattttttaagtgagccaggtgtggtggcaggcgcccgtagtcccagctacttgggaggctgaggctggaggattgcttgagtctaggagagatcaagatcgaggctgcagttagctatgattgcatcactgcactccagcctgggtgacagaagaaaaaaagagagagagagagaagaaaagaaactctagtcctgggggggtaaaaaaggaaagaagaaaagaaacctctactaagagtgccttaagaaatatggacttttgcctgggcgcggtggttcattcctgtaatcccagcactttgggaggccaaggtggcggatcacctgaggtcaggagttcaagaccagcctggccaacataacaaaaccccgtctctactaacaatacaaaaattagccgggtgtggtggtgggttcctgtaatcccagctactcaggaggctgaggcaggagaatcatttgaacccaggaggcagaagttgcagtgagccaagatcgtgccactgcactccagcctgggcaacagggtaagactccatctcaaaaagaaaaaaaaagacttttactgtttcacccaaagcttagagatggcagatctggggtcatacaggaccaagttcttccacgagttcaccctgccatcctcagataccctcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctcccgggttcaagcgattctcctgcctcagcctcccaagtagctgggattacaggcatgtaccaccacacctggctaatttttgtatttttagtagagacggggtttcgccatgttggccaggctggtctcaaactcctgacctcaggtgatctgcccaccttggcctcccaaagtgctgagatgacaggtgtgagccaccactcctggcctggtttcagttcctttctaagggcaaggacagctctcctagaagtccctcatgtctcagtggccagaattgggttctggcctctccttacacctgtcccagctaggggaaaaggagtgccttgctctgagccttggagaatcaccaaagttcctcccagggactgggagggcccagctgccccaagcactggttgttgggacaacccagcaaagtttgtcccatctttagataccaggacacaacggggggattctgttagcagggagtggggcagaggacttggaggacagcttttggggtcagatccaggactggaactcagattttttttgtgtgtgtgtgtgacagagtctagctctgtcccctgggttggactgcagtgctgcagtcatagctcattgcagccttgacctcccgtgtcaagctatcctcctgcctcagcaccccgagtagctgggacaacaggcacgcaccaccacacctggctaacttttttgtttttttgtagagatggggtctcactgtgctgcccaggctgatcttgaactcctgggcttgatcctcctgccttagcctcccaaagcactgggattacaggcgtgagccactgcgcccagtgagaccccaggtgtcttaaccatgaccccagactgccttctactgcactgcggctgggtgtaagaccccctcccgctgcccagcccagagcctggcctgagcagatacgaatggaaggccagggctgtgactggcagtgttcttcccggctacagtgacagtggtggtgggggagggcaggaatccaggacccccaggccactctacccccactggggagcctctgggactagagagggagtattcagagggaggctgaggctgctggggagaaaggataccccccccccgcccgccttccagaaggggagaaatttcttttttgtttgttctctcaagcttctttttcaagaaacaagcatatggcagcggatggtgcgggggccgtgtttgggtggggtgtgtgcctgcctttgccttttacgtggttgggtgtatttttttttttctccatcagctccaacgccccagctggtccatagggcagtgagacttgaatcacagagacgcttctctggtgtccagaaaaatccggctctttctagtggcgcttccaagggggaagagattggagagctctccagcaaacccaggcctgagctttgcagaggtctgagctgaggactgagtgtccaaggggctgaggatgtggactgtctttgtgaggtggggtacagccagtgaaggagccagtgttaatttcctgaagctgctgtaacacgggccacacagacttcgtgccttaaagcaacagaaatttcaggccgagtgcggtggctcatgcctgtaatcccagcactttggaaggctaaagtgggcagatcatgaggtcaggagttcaagaccattctggccaacatggtgaaaccccatctctactaaaaatacaaaaattagatgggcgtggtggcaggcacctgtaatcccagctactcaggaggctgaggcacgagaatcgcctgaaccctggaggtggaggttgcagtgagctgagatcccactgctgcactccagcctgggtgacagagtgagggagaaaaaaaaattctttttttttttttttttttttttactttgaggttcttgggtacaagtgtgcaggtttgtgacataggtaaacttgtgtcatgggggtttgttgtacagattcttttttcacccaggtattaagcccagtacccaatagttatttcttatgatcttctccctcctcccaccctccaccttctgaaaggccccagtgtgtgttgcccccctctctgtgtccatgtgttctcattgttcagctcccacttataagtgagaacatgcagtatttggttttctgttcttgtgttagtttgctaaggataatggcctccagctccatccatgtccctgcaaagaacatgatcttgttcttttttgtggctgcatagtattccatggtgtatacctaccacattttctttacccagtctatcattgatgggcatttaggttgattccatgtttttgctgttgtgaatagtgctgcagtaaacatacgtgtgcatgtgtctttattgtagaatgatttctattcctttgggtatatacccagtaagggattgccgggtccaatggtatttctgtctttaggtttttgaggaatcaccacactgtcttccacaatggctgaactaatttacaacagtgtataagtgttcctttttctccacaacctcaccaacatctgttattttcttgttcgtttgtttttgtttttgtttttgttttgagacggagtcttactctgttgtccagactggaatgcagtggtgcaatctcagctcactgcaacctctacttcctgggttcaagcaattctcctgcctcagcctcccgagtagctgggattacaggcacacactaccattcccggctaattttttttttttttttttgagacagagtctcactctgtcgcccaggctggagttcagtggcgtgatctcggctcaccgcaagctctgcctcccgggttcacgccattctcctccctcagcctcccgagtagctgggactacaggtgcctgccaccacgcctggctaattttttgtatttttagtggaaactgagtttcaccatgttagccaggatggtcttgatctcctgacctcatgatctgcccaccttggcctccaaaagtgctgggattactggtgtgagccaccacgcctggcccagcatctgtcattttttgactttaataatagccattctgactggtgtgagatgatatctcattgtggttgtgatttgcatttcactcatgatcaatgatgttgattgagtcttttttcataagattgttggctgcatgtacatctccttttgaaaagtgtctgttcatgtcctttgcccatgtttttatgagaacaagagaaatttctattctcacagttctggaggccaaaggtccaaaatcattaccactgggccaaaatcaaggtgccgacagtgccatgctccctccagaggctctcggggggaatctgttcctggcctcttctagctcctgggggctgccagcactcctgggcttgtggccgcatcactccagtcttcaaggccagcatcttccaatctctctctacttcgtcttcacttggacttctcttctatatggatgtccagtcttcctctaccctatttttaaaaaatgtttgtagagctggggtcttgctgtgttgctcaggctagtctcaaactcttagcctcaagtggtcctcctgacttgaagtgatcctgctgccttggcctcccaaagcactgagattacaggaatgagccactgtgcctggcatgacctcttcttcttcttctttttttttttttttttgagataggggtctcactgtcttgctcaggctggagggcagtgacgtgatctcagctcacagcatccttgacctcctgggctcaggggatcctcccatctcagcctcccgagtaactgggactataggcatgctccaccacacccagctaatttttttttattttttgtagagatggggtctcactatgtttcccaggctggtctcaaactcctgggctcaagcaatcctcctgccttggcccccaaagtgctgggcttacaggtatgagctaccgcgcccggccatgacctcttcttataaggatgcatgtgatggcatttagagcctacccggctaagccagaataatcccctacctcaagatccttaatcacatctgcaaagtgattttgccatataaggtaacacaggctctggggattaggacatggctgtcttttggaggtcatttttttgagcctatctcgggtctctaagggcaaactccagcagccattctagtagacaggttctcctgtgatagatgccggccaggtaaaggagacaaatggaagatcccagctgacccacctcggctctgtcccctctgaggggaccttattctcatttatgtggactccctaagccatatatctaggctggagtgcagtggtgtgatcttggctcactgcagccttgacctcctgggctcaggggatcctcccatctcagcctcccaagcagctgggactacaggcatgcaccaccacacccagctgatttttttattttttgttgagatggggtcttgccatattacccaggctggtcttgaactcctgaactcaagccgtgtccactctcccaaacagctgccccctcttggggggtacagcagcgtcagcctggtgtgccctcagggtgtatccgttatttatcttggactgcataaaccaatagcccaacattagcagtgtcaaacaacagtcatttcttcttttactcttcacattgtgagagttgtctgagctcagccagatgggtcttactcaatctctcctacaattgcagtcaaaaggttgccggtgggagttggaggctgcagtgagctacgatcgcaccacggcactccagcctgggcaacagagcaagatcccgtttctaaataaaaagttagcagggcttgaggtcattttgaagatgtttcacttgctggcccggggcctgagccgaggaacagctggggccccttgggcttctctgctgccccccggcccctccagcacggtggcctcaggatagtcgggcttcccacgtgtcagctcagagtccagggcaagggtctgagagtgagtgagtggctgggggaagtctagcgcctttggggacctggctgcagaggtcacgtgttggcgctgcccacacattctgttggttcaaagtgggtctttattcaaatcacattcaagaggagagaattagatgacaccacttgttgggagaagtattaagaacttatttatttatttttttcactttgggaggccgaggtgggaagatcctttgagcccaggagttcgagaccagcctgggcaatatagggaaactcccatttctatttaaaaaaaacaaaaaaccaaaaaacttatttatttattttttagagacagggttctcactctgtcactcaggctggagagcagtggtgtgatcacagttcactgtagcctccacttcctgggctcaagtggtcctcttgcctcagcctccccagtagctgggactacaggtatgcactaccatgcctagctaattttaaattttttttgtagagatggggggtctcactatgttacccagtctggtcttgaactcctggcctcaagcaatccttctgcctcagcctctcaaagtgctggattacaggcatgagccaccacacctggcctaagaatgtattgtcagatttaaaaccattgcaggaggatggaccagagaagagggccctggggccccagaatgggggtttatctgccagctggattccaggggtctgagtacccaggtgtctggggtgggagagtgggtgcaggctccaggtgggcgtgtcccctttgggaagggcgggacagggccctccagagcccaggcccaggctctgggctgaggctaggacagtctcagagcatttcccgctggacagccccagaatctgactgcagtctgtgccaagagcacttcggcgttctgctccactcctgccagccccaccacggacgtcacaccccatcgggctcccttgtgccttagtgcctttgcctgagctgtcccctctgtctggactgccccatccctcaccattcaccttcttcatggctcatgattcttccaaacttgcatcaacggcccctctcttcggaggcctttccaggccttgttatgtgtagcaggcccgggcacacacagatgaaagcaatcagccctgttctccaggagccagtgcatgggggctctgacacctccacatcctggaggaggagggaaggaggggctgagggagcccaaccgaggggcacaacaggaggtgttgacgagcccacaagagctaagagggagccagcagcggggaagggcatttcttaaaaagggcacagcaggtgcaaaggcctgagcgagagtgcaaggcccacccaggggcctgcagactggagtgtggggctctggagggaagacaggttcagcttgatctgtgatgtgactcctgatgggacagtgagcctttggagggtgaggtcatgccctgcgcgtctctgtgtcccagcacgactgtggctggggccagccaccttctctgtgaaggttttcactgcattcagactgtgctgggactggccccaggaggacttggactagcgtgtgtgtgagtgagtgtgcatgtgtgcacacatgtgtctgtatgtgtggacatgcatgtgagtttgcatgcatgtgtgtgcatatgtgtgtatgcatgtgtgagtgtgcatgcatatgtgagtgcattgtgtgcacaagtacgtgtatgtgtgtatgcatgtgagtggctatgcgtgcgtatgtgtatggggtgtctgcatgtgggtgtgcatgcgtgtgtgggtgtctgcatatgtgtgtatgcatgtgagtgggtatgcgtgtgtatgtgggtgtgcatgtgtgtgggggtgggggtgtgcatgggggtgtgcatgtatgtgcatgtgtgtgtgggtgcatgtgtgtgtgcatatatgtgtgtgatatatgtgggtgtgtgtgcatgtgggtgtcaatgtgtgtgcatgtgtgtatgcatttgagtgtgggtgtgcatgtgtgttcatgtgggtgtgcacgtatgtgtgtgtgtgtgtgttcatgtgggtgtgcgtgtgtgggtgtgcatgtatgtgtgggtgtgtgcgtttggggggtgtacatgtgtgggtgtgcatgtgtgtgggtgggtgtgggtgtgcatgtatgtgggtgtgcgtgtgggtgtgcatgtatgtgtgcgtgtgggtgtgtgtgtgagtgtgcatgcatgtgtgtgttgacttgctagtgctcacacttacctctggggcagagatgtgcttgttaggtgccccctccctctctccactccattccagcaaaggtcactgagtgtcctctctagtcttaggaacgacactcgacagtggacaatgagaacaaccaaacacttcctctcttcccccctccccccattttgaaaaattctattaaggccaggcatggtggcttatgcctataatcccagcaggttgggaggctgaggtgggaggattgtttgaggccaggtgttcaaggccagcctgggcaacatagcaagaccccatctctacaaaaaaatttaaaattagccaggcatggcggtgcacacctgtagtcccagctgcttggaaggctgaggtgggaagatggcttgaacccaggaatttgaggctgcagtgagctatgatcacaccactgcaatccagcctgggcaacagagtgagactctttctaaataaaataaaataaaatataaaaacagaactactatacaattcaacagttccacctctgggtatataccccaaatcattgaaaacaggtttaccaagtgatttgcatactcatgttaatagcagcattatttgcaagagcggaaacgtggagtgcagttgcacagtcacacctcactgcagccccaacctccgcaggctcaagccatcctcccgcctcagcttcccaagtagctgggactacaggtgtgcaccaccacacccagctaatttttgtattttctgtagagatggaatcttgccaggctggtctcaaactcctgagctcaagcaatcctcctgcctcagcctcccaaagtgctgggattacaggcctgagctactggacctggctggtagtcctatttttaattttttgaggaaccgccatgctgttttccacagtgcctgtaccattttgcatccctaccagcagcacacagggttccaatttccccacgttctcaccagctcttgtttttttcctgtgtgtggttttgtttgttttgtttgtttttgttttagacagagtttcactcttgttgccccgcctggagtgcaatggcatgatgtcagctcactgcaacctccgcctcctgggttcaagcaattctcctgcctcagcctcccaagtagctgggattacaggcatgtgccaccatgcccggctaatttttgtaattttagtggagatgggtttcaccatgttggtcaggctggtctcgaactcctgaccttagatgatccgcctgccttggcctcccaaagtgctgggattacaggcatgagccaccgcgccccgctttcttgtgttttttatagtaggtatcctggtgggtgtgaggtggagtttagatttgcattttgctaatctttagtgatgttggacatcttttcatctgttttatggccatttgtatatcttcttaggggaaaggtttactcaagtcatttgcctattttttaattggattattattattaatggagatgatgtctcgctctgttgcccaggctggtctcgagctcctggcctcaagttatcctctcaccttggcctcccaaagtgctgggattacaggcatgaaccactgcatccagtcttagttgttgagttttaggaggtgtctgcatatcctggatattaatcccttaccgatatactatttacaaatattttcacccattctgtggtttgcctttttattccattgattctgtccaaaacttctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaataaaacatttaaataaaacataggtaacccctttccccattgtcaagctctgtgcctgcgcgagcttctctgcttgtccttctttcgtggtcctgtagttcttttttttttttttaaataagatggactctcactctttcacccaggctggagtgcagtggcaagatctcagctcactgcaacctccaactcccaggttctagcaattctcctgcctcggcctccctagtagctgggactataggcgtgtaccaccacccccagctaattttttgtatttttagtagagatggggtttcaccatgttggccaggctggtctcaaactcctgacctcaagtgatcctcccacctctgcctcccaaagtgctgggattacaggcatgagccatcgcacccagcctggtcctgtaattctctctggacacactggccctgtgagctggaggagggcaggcggagcctggcacagagcagcctcttggtaggtgttgagtgaatgagtaggggtggtgaggggaggccacggaaggcacccaggctgtgttcctcccactcccagccttgccacgacctaccaggtctccagctcctgctgagctcttgcagggtggcccctccccacttacagctcactgccttggactaggtcccagccaatggcccggcggaggtgtcctcactgttcttacccagtatgacctaggcgggagccaataagcacagggaatgagtatcaccctgagggttcaaaagtgtgcaaggaagggaggaagggaaggaaggaaggaaggaagagaagggagtgggggagggagagagagaaggaaggaaggaaagaaggaaggaaggaagggagcaatgaatgaatgcatacatcaaggaatgaatgaatgcatatacacaaaggaatgaatgcacacaccaaggaatggatgaatgaatgcacacactaaagaataaatgaatgcacacaaaggaattaatgaatgtacacaaaggaatgcatgcacacaccaaggaatgaatgaatgcacacaccaagaaatgaatgaatgaatgcacacatgaatgaatgcatacacacaaaggaattaatgcacacaccaagggatgaatgaatgcatacaccaaggaatgaatgagtgttcacaccaaggaatgagtgagtgaatgaatgcacacgaaagaaagaatgaatgtgcacaccaagtaattagtgaatgaatgaatgcacacaaaggaatgaatgagtgaatgtacacaccaaggaattagtcaatgaatgcacacacacaggaatgagtgaatgaatacacacaaaggaatgaatgtacacatcaaggaattagtgaatgaatgcacacacagaggaatgagtgaatgaacctgccacttgtggagagtgaaaaaagcctgagagatccccagatgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctccccagatgtaacatggattagaagaaccacctcatggtgcttttctgaaaatttggtaggcctaacgtggtggctctcgcctgtaatcctagcactttgggagggaggccaaggtgggtggatcgcttgggctcgggagtttgagaccagcctgggaaacatagtgagaccctatctgttttgttaaaaaaaaaaaaaaagaaaaaaaatttggtggggtgatgggtgtgccagttggagagctgtgacatttgtttttttggttcaaccccaagccagtgcagacaagtgaccctccccagccagcgggccaggcctctcagtgtcaccctggctgaggttgttcgtgtatgtgtgtgtgtgtgtgtccctttctttactgtcctcattctttgcatcacgtgtgtggtcttttctgtctcatacacgcacacccgtcgcatttgcatgctctgacacacagacacacattgatgcttccttttttaaattttttatttttggaggcagggtcttgctctgtcgcccaggctggagtgcaacggcatgatcacagttctctgtagcctcgaactcctgggctcaagtgatcctcctgcctcagcctcctgagtagctgggaccacaggtgtggaccaccacacctggctaattttttttatttttgtagaggtggggtcttgctatgttgcccaggctggtacactcctgcttctttatgtatgtatgtatttattctctttttagaaaattatttcattgaatcgtcctttaagcacacacttttctgaagctctggggacacttggggagaagaggaggggagggttctagctgtcctgtagggccacattggtcctgggtgcaggacaagcccaggcaggagaaacggaccctgctgaggggtctcctctttgcctcttccctgggtcccagctgggtggtctcgcctgttcactgccgggcagggttgggcagtgcagagccgagcccaccgctgtgtcatcattccacgggggaaggggcttgaaggctgcgttgtggggtgatgggaacccggatttagttggtatgacccgagctcaggtttcagctttgcgacatccttgtggtggggtcttcaggtgggaattcctcctctgtaaaatgagagcttgtgagaattaaactggtcccggcatttgggaaacagccctgtgactccttccgtctcttccctccggagggggcggtccttgagctctactgagcccatgccagcgagagtcgtcatggccgagcccctgggccagattccaagttccatgccaccttggcacttacttttttggctccagtcctctttggctgtcccctctgtgaagggcatctaaggtggtggatgggggaggggagtttgtttgtttgtttgttttggttttttcttttttcgaaaaggagtctcactctgtcacccacactggagtgcagtggcgtgatctctgctcactgcaacctcgacctcctgggttcgagcgattctcctgtctcagccacctgagtagctgggactacaggcacctaccacagtgcctggctaatttttaaatttttagtagaggtggggtttcaccatattggccaagctggtcttgaactcttgacctcaagtgatccacccaccttagcctcccaaaatgctgggattacaggtgtgagctaccgcgcctggcctttgttgttgttttgagacagggtcttgctctgtctcccaggctgcagtacagtggcacaatcatagctcactacagcctcaaactcctggctcaagtgatcctcccgtctcagcctcccaagtagctggcgccacaggcatacacccggctaatttctgtattttttgtagagacaggattttgccatgtttcccaggctggtcttgaacttctggcctcaagccatcctcccaccttggcctcccagagtgctggaattataggcgtgagccaccatgcccggccagaaaggggagtttatttaaatgggccgagccaggagctttgtcttagccttgttcttctgtctacatgcccttttcccacctcccactaggctgcacttcactggggtaaatcggtcagaaccagctagtgggaacaacctgtaacacctgtttccagacatccaggctttgggctgcagaataggctcgcacctgttagctcactctctgctagcctcctaactggccctgagcgccaggtgcagggtgtttgggattggaaatcacagctggatttctgttagttcactgtcaccctggccccagggctggctagaaagtgggcgctctgggccggacttctatgggggtcccccagcctggaggcagccctgccttgagtcagggcagcactgattcagacgtggccacgagtgcttggctaatttttggctcagggtccgggcaggcctccagctcttggcggccggcaaatctgctgctgtctgggcaaggagtccctggcaagacggggcaggtggcaggcaggcagggaagctgagcttcttggagtctggaatagggaacatccctagaagatgacccaggccctgcacctggctgggtgtaagagtcccctgtgaacttaaaaatacagtgtccagggctgggcgcggtggctcacgcctgtaatcccagcagtctgggaggccgaggcgggcggatcacctgaggtcaggcgttcgagaccagcctgaccaacatggtgaaaccctgtctctactaataatacaaaaattagccgggtgtggtggtgcacgcttgtaatcgcagctacttgggaggctaagtcaggagaatcacttgaacctgggaggtggaggttgcaatgaactgaaatcatgccactgcactccagtctgggcaatagagtgagactccatctcaaaaaaaaaaaaatacagtgtccagggccccgctgcccagggagcggtcacctctgatgaggtagggcacaggagcccgggcactgaacagcaggtgttggcagcagctgagctaccagccgtccttgcttcacaggtgggcggagcaaaatcgggagctgggtgatgggacagatgtgacagtcgctcttctactattctcggactgtaacctgggatcttcccagtggacttccctccacccatcccagctctgccttttgggggcttcatgtctttctcattattattattactttaatatttcagcttttaggccgggctgtaatcccagcactttgggaggccaaggtgggcagatcacttgaggtcaggagttcgagaccagtctggccaacatggggaaaccccgtctctactaaaaatacaaacattagccaggcgtggtggtgggcacctgtaatcccagctacgggggaggctgaggcaggagaatcacttggacatgggaggcggaggccgcagtgagccgagatcacaccactgtactccaatctgggggacagtgagactgtctcaaaaataataataattttaacttttattttagattctcagggtacatgtgcaggtttgttacaaaggtatattgtacgatgctgagatttgggatacaagtgatctcgtcacccaggcagtgagcatagcacccaataagtcgtttttcagcccctccttttcccctctctccctgcttttggaggcctcagcgtctgtcattcccatctttatgtctgtgagtacccaacgtttagctccccttataagtgagaacatttgatatttggttttctgtttctatgttaatttgcgtaggataatgatgtccagctacttccatgttgccgcaaaggacatgattttgttcttttttatggctgcataatattccatggtgtgcatgtaccacattttctttatccattctaccgctgatggacacatgggttgattccatgtctttgctattgtgaatactgctgctctgaacagatgcgtctctcaccttattaagggaagttgactttttgaacccaaaggatggacatttgggatatttctcttccttgcgagtgtctgcgttttgggctgctgagagaggcgtctgggctcctgttcccattgctccctgcgttgcagtgtgaccaaccatcctaggtggcctaggactgaggggtttcccaggagacggaactttctgtgtaaacccaggaatgtcgagttgggcccagttggctgtgtgtcagctctgcgtgtgagcagctggtctgttccctgcatccctgtgaatgtgagaagcgtggtcttcctaccgcatggtgacagcaaggacaccagcaaggctggagacagacagccttcttccccgctgtgcactggctgaggcctggagctagtgcctttcttgtctctaagatagagtgatgctggaagaaggatagtagctcatgcgggccaatgctgccatcagaatttttacttttttttttttttttttttttaatggagtgttgctctgttgcccaggctggaatgcagtggcgccatctcggctcactgcaacctccaccgccggggttccagcgattctcctgcctcagactcccaagtagctgggattacaggcgcccgccaccacgccaggctaatttttgtatttttagtagagacggggtttcaccatgttgtccaggccggtctcaaactcctgacctcaagtgatctgcctgcttcaccctctcaaagcgctgggattacagacatgagccactgcgcctggccctgctatcagaatttttattttttatttaaaagacagggtcttgctgtgtcacccaggctggagtgcagtgttgccatcatagctcactacagcctcgagctccttgtctcaagcagtcctcccgcctcggcctcccaaagtgctgggactataagcatgaaccaccgcacccggcctctgccttcattttctgtttagaaccattcccactttacaaatgaaaaatctcgggctttcaggactcacccgaggtgctcctagcagacgtgggcctgggtctcatcttcccccgcttctcctgctgcattcttgctccaggcacgtggaacctgcctctccctccatctgaggccctttgcagggagtggctgtctctctccatgctccccaagtgcacccacctgggctgtggctcgggacagggggtcctacaagcccggatgaccgagacaaggagctggggatggcccacagcccagcccctcttccctctctgtgtccctccctcctggagtccctggttccttcctaaacggattagagcctttaccggaaggagccggccgctgtctggggcagccggggggccagggctagatggctgtctggtgcctcctgctttgccctgattcgatttgggcctcagcagctgggaggctggcagccctaaggcctttctgggaatggttcaagggacgggcttgcaggggatggcttgggggagggggacaccttccagcccccaggcaggcagacctctcagctggatcttttatgaagtctggtcgcatgcaagaccctcaagcgggcttcctgccacggaacatccccagccgtggccactggccacctcgtggttcatcagcgggtgtcatccaaggcctgtgtcccatccatggcctgtcatcccctccgcatcccttaatacagcagatttcaaacttctataaaattgcaacccagaagaagaaatgtcttttataaacatttagcagcaaactcaacatacattttggccaaacgcccaccggccagttgtttaaatcaatatttatccacagccaaaaagcagaggagagccagaactgaggccagagccgagctctgatgcatctctcatttctcgggatgtttctgtccctgtggttggacacctctggccttgtgaagtgtgatgcactgtcacatctcctgttctgtgtcattggccaatgatcatatatcatgacctgctggaaggcctgtctgtggctgggaccacacgccttgggccttatgcacactgggcactggtcgggatcctggggtgcaacagtggcaggcagacctggtttctgccctcaaagagcttacagatggcaggggcacccatggcggcagaagacaccccaggcctggtgccctttgtggtgccagccccatggtcctcctgcctgggccttccctaccccattgggtgcagaaactccctgtctgcaggtaggagacagagggtaggttttcaggctcccttgggaactgcagccctgctctctgccatcaacacccagcaggggccacacagagagcaccgggactgagcccatagaggggaaccgagaggcccctgcctctagtctctgccttctttgcttggattggtgcagggacagctgccttgagggcaggccctggcactggggcagcctgtgggtgccccctgggtcaagaaggagaggggcagggtagaaccaggagccaaaggaggctgatctttgcatctcatgggtgcccagctggacactgtcatacccaggaagcctgtgccatgccatggggacccacaactgggggccctggacttgagggggaggatgcagctctgtcccccaggaaccccattgcaacaggacacagtcctgccctggggagcccctgacctgagacaaagcagcctcggccctgctgtatctttccatacccctgatgccaagtctcctggctaggagggaaactgaggctggaaggcctcggcgggggtggcattggcctcgggagcatgtggcttgatgcagaaatgtgacggcagagctcagaggcatgcggaagggaggggaggacatcaccggctcctgacccagctgggcttcaggttgggggtacaggaggtgggcaagcaggttggacaattaaaagcttcgatgaggctgggtgagtggcttatgcctgtatttccaacactttgggaggctgaggtgggcagatcacctgaggccaggagttcaagaccagcctggccaacatggtgaaaccccatctctactaaaaatacaaaaattagccagacgtgtggtggcacctgtaatcccagctacccgggaggctgaggcaggagaatcactcgaacccaggaaggggaggttgcagtgagccaagattgcaccactgcactatagcctgggcaacagagtgagactctgtctcgaaataaaattaaatttaaaatttaaaaaagcttcaaggacaaccagcagatgatggcaggaccaggaagggtgcttcaggcagcgggaactgaacctgcacagactagggaagcatgaacatcggtacatctgggagtggcacagcttagagggcctggagcatggagtgtgagggggaactggagtgagggacaggagaccaggtaactagaataccaggctgaggagttgagagctaatatgggcagtagggagccatggagggtgtgtgagcgagggagggctgtggccagaattgcacacgccgggagaggtggcagttggggcctgtccaacagactggtcctggtgctgggctcagcttgggtgtgcagacttaggagggtgtgccacaaggtgtgagttatcctgccacctgtgcccaggcctgtgcaggctctaatcccatcacacataaagcccttgggcccagggaaggtcagccctggatacagaggcggtcttgggagtccgggggtcaggtggattggggtgggcagccaccatatgagacaagccccctgccttgtgcccaccaccactgcctcctccctccccacaggcgaccatggccttgctgggtaagcgctgtgacgtccccaccaacggctgcggacccgaccgctggaactccgcgttcacccgcaaagacgagatcatcaccagcctcgtgtctgccttagactccatggtgagtgtccccacccacccaagaggaggggacagggtgagcgtccccacctgccttgtagctcaagtcctacctcagctactcgaaggagctttcactgacctgaacctcagtttatctgactgcagctagggccacgatgcctgcatcaagggtgtgagatgtgagacttcagcgagatccagtacataaaaatctagccctggggccgggcacagtggctcatgcctgtaatcctagcactttgggaggccggggtcggtggatcactaggtcagtggttcgagactagcctggccaacatggtgaaaccccatctctactaaagatacaaaaaattagctgggcgtggtggcatgcgcctgtaatcccagctacttgggaggctgaggcaggagaattgcttgaacctgggaggtggaggttgcagtgagccgaggtcgtgccattgtactccagcctgggtgacagggcaagactccgtcttaaaaaaaaaaaaaaaaaaatctagccctggaataaacactggctctccgccctcgtccccttgtcccttcacccctcttgccattcccactttgtccctgggatgaaccacatgcctatctcctagcaggtgacctgggggataatgtgtggggagccattcactagaaagatgtaatccccaacgttaaagcaagagttctaactgcatctcgggcaggaagagagaaaccgagctttgtataatacatcactcccctggcgctattgcctacatacctagacctataacaatttatcccaaatgaggacatcataataccattttcctctagccttttcctggggggaagttctgtgatggaagtgttaaaaaaaaaaatctggcccagcacggtggctcacgcaagtaatcccagcacttttaggggccgaggcgggtggatcatttggggtcaggagttcgagaccagcctggccaacatggcaaaatcccatctctagtaaaaatataaaaattagctgggcctggtggcacatgcctgtaatcccagctactcgggaggctgaggcaggagaatcacttgaaccctggaagtggaggttgcagtgagaagagatagcaccactgcactcccgcctgggcaacagagggggactccgtctcaaaaaaaaataaataaaaataaaaaaattagactggcatggtggcacattcctgtaatcctgcctactcaggagggatgaggcaggagaattgcttgaacctgggaggcagaggttgcagcgaaccgagatcgtgccactgcacttcagcctgggcaacagaggagactctctcaattaaaaaaatttttttaaataaaaataaaattaaaaatctgtctaacatcagttagctgcgctcctgcattttaggatgatgaagcacagagagggtagtaccttgcccaaagtcacacagcatgaccagttttgttttgttttgttttgttttgtttttgagacggagtttcgctctgtcgccaggctggagtgcagtggtgtgatctcgactcactgcaacctccgcctcccaggttcaagcaattctcctgcctcagcctccccagtagctgggactacaggcccccaccaccacacgtggccagataatttttgtacttttagtagagaccgggtttcaccatgttggccaggatggtcacaatctcttgacctcgtgatccgcccacctcagcctctcaaagtgctgggattacaggcgtgagccactgcgcctggcccagcaagaccagtttttagagcgaacttctgggtacaaagtctccccgaaaaataaaggacctccttcaagctgttcctgctgtaggtggctcaagggctgcttaagtggtgtttggggcagcggtgggagacacccctggaaaaggggctgggtgccacactctctccatgatgacccctcccctatgcagagtgactttcatgaggagggggccccaggagctcagccctgtgtcccaaagtactgtgagcttggcattgatggaggtgtggctgatgtgggcagtgatgggcgatgccatggccactagtgacatgtggctatttgcaatttttttttttttttttggagatagggttttgctctgtcacccaggctggagtgcaatggcgcgatcttggctcactgcaacctccgcctcctgggctcaagtgattctcctgcctcagcctctggagtagctgggattacaggtgtgcgccaccacacctggctaatttttttgtatttttagtagagacggggtttcaccatgttggccaggctggtctcaaactcctgacctcaggtgatccacctgcctcagcctcccaaagtgctgggattacaggtgtgagccactgcccctgattcatttaaattcgaattcgttaaaacgaaataaacaactcagttgttcagttgcaccagcctcattttacgtgctcagtagtcagaagtggctggtgtctatggattggacagtgcagaggtagaatgttttcatagtcatagaaagttacactgggttggccaggcgcaatggctcacgcatataatcccagcaccctgagaggctgagtggggcagatcacttgaggccaggagtttgagaccagcctggccaacatggtgaaactccatctctactgaaaatacaaaaattagccaggcatggtgatgcatgcctgtggtcctagctattcgggaggccgaggcaggagaatcgcctgagcctgggaggcagaggttacagtgagccgaggtcgtgccactgcactccagcctaggtgacagagcaagactttgtctcaaaaaaaaaaaaaaaaagttctacttggcagcagtggtctagtgagtgtttcagagcctccttggaggagcacatgaccctatagttatcctagcagtgcgaacaagacaggctcccccgtccctgggccttttaagggtttcctgagggaccctatgggtgacaatgatatttgcttagcagtaacttaagtccagcctcctccaaatgctagggtcttttggtgacctgtagggagggtgggctgaagggatgtgccttcgtcacccgcccccaatctcatcctcttccccaccagctctgggtgcctttaggtgggtgagttttctgccatggtctcggcgtcttcagctgagcggtgactgtgggatgaagcagctctttcagctgtgatggatgagaaacagctggatttatttgttttattttttgttaatagtctacagtgttcccgcgcagaaagggaacagcaagcttttgttttcatcttagaagaaaatgaatgccctgtgttttaattttccagtagggaccctggaggacaggcttcctggccccacgccgcgtgcaccttcctaaccagagcgactccaggctggggctggcacaataggcaagattatggcccagagaggttacctgtcccaggccacgcagcacagaactgcgtttggaagccagactttatagctgccagcactacctgactcagatgaaaaccagcatttattagacacaactgcctgccacaggcttcacagtcagggttttcctggtggggtaggtcagagacctgagatgctggtggtcttggttgtagggaccccctacattaaggcctctgggctatggggctgcagacctcgactctggggccatgaggatagccagctgcctgtatacccatatagggtgtcccagtttagagatctttttcctccaaccattgaatccccatacccaagcccagtggcactgtggaactgggctgcttgtccccaattctatagacgtggaaactggccacgcagagtggctcacgcctgtaatcccagcactttgggaggctgagacgggcagatcacctgaggtcaggagtttgagaccagcctggccaacatggtgaaaccccatctctacttataatacaaaaattagcaaggcgtggtggcgggcgcctgtagtcccagctactcgggaggctgaggcaggagaatcgcttgaacctgggaggcagaggttgcagtgaaccaagattgtgccactgcactccagcctgggcgacagagtgagactgtgtctcaaaaaacaaaacaaaacagatgtggaaactggagcccagaggagggacgtgacttgctcaagtcccacagcagaagtggccgaggtgggattgcagccccagtctgtccagtccccgcctgtcctgcagttcttcccacctcctcctcatccaggacttgagaggggccaagaaaacccagcacggcattgtccctggggctggggctaaggggggcctaccccaaggaggaggaccttggagggaggagcagaggacacttgtcctcctccaccccccatcgccaatgcctgcagggccatttcattcagtcccactacagaatctgagaccaagaacagtagaggggccgtctgtccctggagctgctgctggggtctcaggcagctgggagctcacatcccacccccgaagtggatactagaggtgttcggagtatggggagcccttccgctcacacagcctgcccttcccacagtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgtgagtaccccagggctccggagggccgggcccgccatttcccgagggcaggcgctctagcccatctctgggtccccaaccctgtctagccagggtggcggtgtgtggggagtgaacctaacaagctaggttgtctgagattcccgatgtggtgttattgaggcagcccctgagttgatagagactggctgggtgaaccccagggtaggccagagccagccacttccatctgccttttccagatggggacaccaaggccaaggctgctgctcagttcttcctcttaactatgtattcctgaacacaaggaccaaatgcacttatgccaacacaattttttttttctttaaatgagacagagtcttgccctgtcacccaggctggagtgcagtggcacaattttggctcactgcaacctctgcctcccaggttcaagtgattctcctgcctcagcttcccgagcagctgggattacaggcacctaccaccacgcccaactaattttgtatttttagtagagacggggtttcaccttgttggccaggctggtctcgaactcctgacctcaggtgacccgcccacctcagcctcccaaagtgctgggattacagatgtgagccgccatgcctggccatgttccaataagatttattgaatgcctgctgtacatagcatcttttctgatgctaactcacctaccctgacatcaacctgagggggcaggcactgtcatggctatagtcagggttaacatcttaggccaggtgcagtggctcatgtctgtagtcctagcacttcgggaggctgaaatgggaggatcacttgagcccaggagttggagaccaggctgggcaacatagcaaggcctctgtctctacaaaaaatttaaaaattaaccaggcttgatggtgtacacctgtagtcccagctgcttgagaggctgaggcaggaggatcacttgagcctgggagttcaagactacagtgagctacgatggcacccctgcactccagcctgggtgacagtgagtccccatctcaaaagaaccatggtatagcatgaggttaagagaacgggccgcctgggtccacaactgctgtgcctcaacccactcatctgtgaaaggggaggacgggtgggtctgagggttaaacgaattggtaccttgcaagcacttagggcagtgtctggcacttggttcacactcagtagacaccagctgttgttactattattagtattcacctcacacccctaagatcagctgtttcagggaagggcatcccccagcgctgggcctagcattactggggtgcagccgcatccccagccagccccccacccccctcagccctcagagcctagaccttctccagggccaggatgggggactgggccgggtagaatggacagcagcaggtcgtgtggcaccccagccgcccagagcctgaggcggtgcacctgccttctagagccacgcagagccgctatttatagcaccaggaactcggctggtttatttcaagctccgcagatcccagaggagaataggctccaagctgggagggggccgcaggcccctcctctcatctcctttccaatgcagcttctagaacattccccaaggatccaccaacactctccggtccccaccctggcccagcctggcatgaacctgctgtttgcaacccacggcctccttggagcaggggttggggggtgcctcccaaccctctgccggagggttttctctccctccggcagagcagaaaacggtggcatagattggtcaagacagtgttcgtgtcagagcacagaaaggcatggatggggccgggcatggtagctcacacctgtaatcccagcactttggtcaggagttcgagaccagcctggccaacatggtgagaccccatctctactaaaaatacaaaaattagctgggtaaggtggcaggcgcctataatcccagctactcgggaggctgaggcaggagaatcacttgaaccctggaggtggaggttgtagtgagccaagcttgtgccactgcactccagcctgggcaacagagcgagactctgtctcaaaaaaaaaaaaaaaaaaaaaaatagaaagacacagatggaacattcatcgaacctcagttctgagctggaatagctggcctcccgtgaacattcacagactgaggctcagagagagaagggactaacccaaggtcacacagcaaattagaggtgaccagaggtgaggcccagccctgggaactctgagatgaccagccctggccctcagtggggtggttggaatagggcttgctcactcattaattcttcattcattcattcacttgtgtatcacattgtgtgccagtctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagtaagatccttcctcattccatttgggggccccagggagggtgggagcctcggtccccacccagcagagggggccccctcctgtcccactatgggccctgggcaaagccggaccccaaggcatggggctactggctaccccagcccttcctcatctctgcattcccagacacagaagttctgctccagccgttttccaaacctccacccctactgtccctgccctggctcaagtcactgccacctctcgcctagaaatagccccaggcttgccacggtctccctgcttccagaccagctctctacacctgccctgcaaccaagggtatcttctcaaagcacaagtctgatcattaatgaagctcttctctccacagccttcgggggctccccatcaccctgagcatggcacaggggcccacacacccatcctcatcccctccacaccttcttctcccactaggtgacagggccctactgacctctctacagaaccacttccagttctccagcactcgctggtgcatttcacatgccctggacttcgcgctgttacatcttttgagactgcctttcccctcctgtgtctggcagacacctgcgtggcactgaggctctgctcctggaagccccctcacagtgggtttaggcccctctcttggcacccacagtgccctgtcccctctccagcccaagagctctccagagtcaggggctgtgtctgccctttctagctgtctccagcctacagttcagagcccagcaacagcaggtgcttggagaatgtttgttgaatgactaagtgaaggctgattgctcagccatgtctttcctgcaggaagaggagacctggcctcccttgggaagcgtcaggttgcagagggcctcagggccccagtggtggtcttcacacgccctgggaaacatcgggcaggtccctttggtgctcagggtcccacctcattcatttctgatttggctttatcccttctcctactgtagcctttggttttatggagcaaaggtctgtgaggaaacttctgctgttcttatgtcagaaggaggggtacccagaggccctgggtggtcacactggccaccctgggatgggggacttgccacgcatggttggctgtgcctctgtcgacacttttgccagctgcagggccccgcgcccctgcccgccttgccctggccccccttgtccactttgggcagaattcaaggaggctatgagaggatgggcctctttctggctcagggtgggggctgtagcatggaggtgacaacagatatcccagtgcccagtcctcagtccccagcctgcctcccctcctctgtgcccccgagcccccatctttgttcctgcgtcttctcagtctgtctctttctcctctctcctgtctttgttgttgttgttgttgttgttgttgttgttgttgttttgagatgaagtttcactctgttgcccaggctggagtgcaatggcatgatctcggctcattacaacctccccctcctgggttcaagcaattctcctgcctcagcctcctgagtagctgggattacaggcacctgccaccacacctggataatttttatatttttagtagagacggggtttcaccatgttggccaggctggtctcaaactcctgacctcaagtgatccacctgcctcggtaatcccaaagtgctgggattacaggcgtgagccaccacgcccagcctctcccatctttttctcaatcccctatttttgctccctctccacttcctcttcttcttactttctctcccccctctcggtctctctcccttcctccctacacctttttttttttttttttttttttgagatggattctcgttctgttacccaggctggagtgcagcggctcactgcaacccacctcccgggttcaagcgattctcctgcctcagcctcccaagtagctgggattacaggcatgcaccaccacacccagctaatttttgtatttttagtagagacggggtttcatcatgttggccaggctggtctcgaactcctggcctcaagtgatcctccctcctcagcctcccaaaatgctgggatgacaggcgtgagccaccacgcccagcccttatagctttttccttgcagcctggctcatgcaagtccccacttctccgtctcttctgccctcttttctcctaccggattgtctgcctctgctctgtcctctgggcccttgagtccccgatttcccctccagccaggtgcccagagtggagaggggcttggtcggggagggcagcagggaacctgcttggtgggggagccccagccccccagatgcagacaattgggccttgtccacaccacccacccccagcctgcaggcggttattctgcacaaagtctgcagttatgaggggtccatgggaaccccgcaccaaggggagccactcagcactgcccccactctggggcacagcagccccgaccccagcctggctgccctctcataccaggcccctctcctggactctcccctacaggcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggtgagtgaggtagccggcccggggctgggctggggctgggccagggccgggtcagggccgggggctggaggccacttagccagaggggaagggacttgagatgcccgtgggggaccctggtggtgaaagctcccagtctgatggtggaggtgaagtgaaagcgaagtcatagaacaggatctgagccaggtcattaagccttgaagtcttcccagggaagttgcattgcagagagacttgaagagacatgacttgggacaaaatagcaccaaagtggtcgggtacagtagctcatgcctgtaatctcagcactttgggaggctgaggtgggaggatcacttgaggccaggagttcaagaccagcctgggcaacataccaagaccctgtctctgccaaaaaataaaaataaaaaaaattacccaggtgtggtggtgcacacctgtcatctcagctgttcaggaggctgaggcaggaggcttgcttgagcccaggagtttgaggatgcagtgagctgtgattgcgtcactgcactccagcatgggcaacagagcaagaccccatctcttaaaaaaaaaatatggcattttaggtgtcagaaacgggagaaccatgtcctgtgcttgctcaggttgtaaatctggggttaattagggatccaggggagattaggttgttgaggctggtctgaggcagtaccagttgtcaggagagccaagaaggcagcctgagggcttaaggttgaacccatctctgctaagtgccccaggcaatgcagaggcaggaaggggaggggtgcagcaggagacaggaggcaatcaaccgcacctggcgggatctgaacagtggattggagcagaggggcagggcccaggtcctccggtggcctagctctgtggccctgggcacaccattcccacctccgagcctgcatccccacttgtgaagtggaagagcagctcctgtcctgccctcctcatggggctgttatgttctgcagagggcagggatgcggggttttcgggggaagagctgcaatgtgtgaaacagatgtacaaagctgtccatgtgtcctctcctttactcaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggtaacattgctgctgggatctccaagtctagggggtgggacagaggtcactcatgcaggggacagcctcccagggcaggtcaggatgcctgggccctcttaggttggaaggagccatgtctgggcatgggagtgggactggacagatggtgtcctggctgagacccccttggaccttgggtctctgctcagccatctgtgaatgatgtccttggccttggactaagaggacgcctgcgaggactccctgggtcccagctactcgggaggctgaggcaggaggatcacctgagcccaggagtttgaggctgcattgagctatgattgcacacctctgcactccagcctgggtgacagcacagctctgtctcaaaaaaaaaaaaaaaaaaaaaaaaaaaaaagcaccagcgatatttcaggtgtcaaaggtgggagatccacatcacgtgctataaaggaagtaagcatactagtcatcctcatgcattccatgaggacccattccaactgaatgagcacccactgcatacccagcctgattaagggcactgggggaagtaggtcctggaagtaggtcctggggtgaacaggacaaaaggaacaactgcaggtgaggagcacctggattcatatcctggctcctctacttagtggctaggcatcctggggcaaatctctactctctgagcctcagtttcttcctctataaaatggggatgctagtggtacctgcttcccagaagtgttatcatgattaaatgacagatcggtggcagtagcatctcctgagagagggttagaaatgcatattctcaggcaccactgcagtcttgctgaatctgaagctttggggatgggacccggtagtctttttggataactctgccaagtggttccaatgtgctcaagtttgagagttgctgaattaaagcgctgggtcttgccaggcatacctgtaattccagctctttgggaggctgaggtggaaggattgcttgagcccaggagttcgagaccagcctgggtaacatagcaagatcctatctctaccaaaaaaaaaaaaaaaaaaaaagcgtttgggtctaatgcttggcctgtagtaggtgcttgtaagttatatatactattattattattattattattattattattattattattattattataagggggaaaaaagcccaaatatgtgggctgaccagggcttcgaacttatacatgtaaaacaagtgttcttacctggaaaaggtaacctccgacatccctttcttgttaacctggctttcggctagcagattctggtgcagaatgtcttagacctctggtcaggggccttgccttgagtttgtgatcacaggaatcagttattggatgtccctggcagatgaggctgttaccccagagccagggcctgtgcactggggccagatctggggaaccctcttgggtcccacctggaaccttcttccttctctcccttgtccaggacagaagcccactgggcctggtgggcctctcatccagaacgtccatgcctccaagcgcattctcttctccatcgtccatgacaagtcaggtaggacagcgcccacgaagcaccccggcctgagtgggaatctgaggttggaggtggtgcttattgaaatggaagtgtatctcctgggtctttgtgaaagaaaggaggaacagctctgctcaaggggctgcaagtaaactggggtgtaatagttatctattgctgtgtgataaactaccccaaactaggcatggtgtctcatgcctgtaatcccagcactttgggaggctgaggcaggagggttgcttgaaaccaggagtttgagaccagcctgggcaatgtagcgaaatgctgtctctacaaaaaataagaaaaattagtggatgtggtggtgcctacccgtagtcccagctacttgggagactgtggtgggaggatcacttgagcccaggagttggaggctgcagtgagctgtgatcgcaccactgcactccagcccgggcaacagttagaccctatctctaaaaaaagttgtaacaaaaaataaaataaataaccccaaaatggagcttaaaacatcaagtgtttattacctcacagtttctgggggttgggaattcgggactggccgagttgggcagtgctcggtcagggtctttcatgaggatgcagtcaaaatgttggctggggctgctgtcatccaagagctcaactggggcgggaggagacgcttctgagctcattcacacggctgttcgtaggaggcctcagtcccccaccatgtgggctagccttgacggggctgcttgagcatcctcacaacatggccactggtttcctccagagttattgatccaaaagagaggaacgaggaagccacgtggcttttatgacccatccttagaaattgctgtcatattctatctgttagaagccagaaacatgatccagccttccctctgtgggagaggaattaaactccaccttttaaaggcagtgatatatttaaaaaaaaaaaaaagtggacagatttttaaagtatcacacagaaggcctgagtgtaggaaagtttgggattcagttataccaagaaggaatgcagtaggacttgccagcagttttgctttgagggcctcagcctcacctccaggaaaaggttctgtaagaaaacccagtcctaggccaggtgcggtgactcacacctgtaatcccagtgctttgggaggctaaggtgggaggatggcttgaggccagaagttctagaccagcctgggcaacttagtgagaccccatctctacaaaattttaagaaagaaagaaaacccagtcccctgggatcagaatggaggaccctcccccccaacaacaacccaacctgtcactgccccaaacaaggtccagccctggcagggaggagatgtgaatgtccagatggaacagtatcatgacaggcccatgggccagggacacaagctgggatagaatctcactgggttatcacaagcaagatactcagtttctttgagcctcagttttcctatctgcaaaatgggactaatatctctgtttaaaacttgtcataaggaattaaataggatattattatatatataaagtacttagcacagataagcacttaacaagttaaagttgttacttttactgattataaatgaaccaatgatcacttgttattattcaatcaagacagaggttttgagagagagaccagcagagctgagagtttgggggaagccaacaaggccagtgctgagtgagacctcagatgtaggaggtacaagggttagattctcaagatcaagactcagcccttagccagacatggtggtaggcacctgtagtcgcagccactcaggaggctgaaatgggaggatcgtttgagtccaagagttggaggctgctgtgagctatgatcacaccacagcactccagcctgggcaacagagtgagaccctgtctgtaaaaaagaaaaaaggaaaaaacacagccaggagtgttggctcatacctgtcatcccagctgcctggggggccgaggcagagggatcacgtgagcccaggagttcaaggctacagtgagctatgattgcaccactgcagtccagcctgggcaacagagtgagaccctgtctctatttttttaaaaaaatttaaattaaaaaataaaatactcgacctcaggccggacttggtggctcacacctgtaatcccagcactttgggaggccaaggcgggtggatcacctgaggtcaggagttcgacaccagcctggccaacatggtgaaaccccatctctactaaaaatacaaaaataagccaggtgtggtggcaggtgccctgtaatcccagctacttgggaggctgaggcaggagaatcgcttgaacctgggaggcagaggttgcagtgagctgagaccacgccactgcactccagcctgggtgacagagtgagtcaccatctaaaggaaaaaaaaaaacataagactcgacctctttttctgctgaagggactgctcttccagcctcctgtatgtctggggcaggatgggctcgggatggacaggctgagcctgttctgacaccacacccgtgggagaggccagagacaaatgttagggcaggaacgggcagacgggggaccatcagagcaccctgaattcgtgtatggtccgaggtgggagagggtggaaggactgggggctggggccggcctcgggggctctgggggtgaaagcccggtggtcatggccggtggagggcgtgtgaccgtcccgtggggccctgctcacttgtgcctcctgtgttttgatagagaagtgggacgccttcataaaggaaaccgaggacatcaacacgctccgggagtgtgtgcagatcctgtttaacagcagatatggtgagtgggcggcgcggcccgccgtgtggccccagcagccgtgttgagcatctcattacgtggcaatcactcgtgttccccaacacggcagcgggagccatatgctggctcccgcgcgccggcaccgctaatgtcatccgtcgcgggctcctcctgtctgggtagggggtggttgtgtcaatatttcccttccagattcttcagggggcggaactgatggcaaagccccagacctgggctcagtggcggggagcgggacaggttgggggcagagattacccatctgggggccgggcgcagtggctcatgcctgtcatcccagcactttgggaggccacggtgggaggatcacctgaggccgggagttcaagaccagcctgaccaacacagtgagacctcccatctctacaaaaacaaattttttaactaggctgggtgcagtggctcatgcctgtaatcccagcactttgggaggcagaggcaggcggatcacctgaggtcaggagttcaaggccagcctggccaacatgccagaaccctgtctctactaaaaatacaaaaattaactgggtgtggtaatacacgcctgtaatcccagttactcagatcctgaggcaccagaatcactggaacctaggaggtgcaggttgcagtgagtcgagatcgtggcattgcacttcagcctggtgacacagtgagactctgtctcaaaaaatataaataaatacaaattaaaaattaaaaaattaaccacacacctgtggtcttagctacttgcaggctgaggtgggaggattgcttgagtccagaaggttgaggctacagtgagctacgattgtacccctgcactccagcctgggtgacagagcgagaccctatctctacaaaaaaacaaacaaaacagattgcccatcaggggaactatccataaggcccagaaaaatctctgttggcctcatgtgcaagtcccccacagtaacacaccatttcccacctcccagctttacctgtgctgtgccctctgtctggcacagtcttttcacattttagggacaaattcctaattgttctttgagactcgtcttgggagtcacctcctctaggaagcctttgggtccccagcctgggccaggtaggcctgggtaccctgatggttccctctctgtgacacattgggaacttgacgccccctgcctgccgctgtctccctgagggccaggactgcacccaacccctctctttgtccctagcacccaggacagagtcaggctcatagcagatgtcagcccaccgcactctggaaagaaaacacaagtggtaggcgctgtggctcatgcctgtcatcccagcactttgggaggccgaggcaggtgaatcacttgagctcgagagttcgagaccagcctggccaacatggtgaaaccccgtctctacaaaaatacaaaaattaactgggcgtggcatggtggcatgcacctgtaatcttagctactttgggaggctgaggcagaagaatcacttgaacccgggaggcagaggttgcagtgggccgagatcacgccactgcactccagcctgggtgacagagtgagactttctctcaaaaaaagaaaagaaaatcattaaggaaagaatttaaaaagaaaaaaaaaagaagggaggataattccaaggaagaaacagtctcaataggctgggaagtcaggggtggcttcatggacgaggtgtcttgtgaccacgtctggggcagcctctgcgtgtgggctggaccttccacattgacatggggctgaacaagactctggaggccttagtgaggagcctgggatagccagctacctttgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttcctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaagtctcgaggacatgtcctctgggatgatgctgggaccaggtgaggggccgaggagggtgcatggtggcactgcatgaaggcagccccttcccaaggggcaacagcagggttcgggggttggccctctgtccactgaatctccccagtgctgaaaagacaagccccaataaaccagatgaaccagacggagacaaattcacaggcactcaaaggaccaattgctcaagggctggggctgggggtggctgctgatgtgggaggtgggggggaagtggggagagatgctttgccagctgttgagatttcgaaggtttcatttgacaacgagctaagtgtgacatctcagtgggatctggatgccaaagccgccaacgcagacctgggccgctgcatcaacaggaaaacagtgtcagaggcacccaagggagggcccaagcagggctggagggaggtccagctctgggctggcacttacaggaacacagacaaagcatagtgtggccagagaagcagggctaggacagggaggggcctgaggaacagccaggagatatgggagcctggagggaggacagtgtatcgaggccccgtccatggtcatacggggaggcaagagtgaagtggatactcaggtcaggggaagggtgacccatgaaagtacttgcttaaggccaggagcggtggctcatgcctgtaatcttagcactttgggaagctgaggcaagaggatcacttgagcccaggagttcaagatcagtctgggcaacatagcaagaccccgtctcttcaaaaaataaaaaagtaaatagctgggcatggtaacacatgcctgtagtcctagctactcaaaaggctgaggtaggaggatgactttagccagaagtcgaggctgcagtgagcaatgattatgccactgcacttcagcctgggctgttagcaagaccctgtctctgaaaaagaaagaaagaaagtaccagcttgtattaggaacatagtaggtgcttaaaaagtatttggtgtggggccggggactgtggttcactcctttaatcccagcactttgggaggccaaggcaggcggatcacctgaggtcaggagttcaaaaccagcctggccaacatggtgaaaccctgactctactaaaaatacaaaaattagctgggcgtggtggcacacgcctgtaatcccagctactcgggaggctgaggcaggagaattgcttgaacccagtcagggagtttgcagtgagccaagattgtgccgctgcactccagcctgggcaacagagcaagactccatcagggaaaaaaaaaaagtatttgatgaatgaattaatgaaaacgtgtagctggggtcgaagtgaatgactgaaatggcacaagtctgggaaaacagagcaagtagcctgggcatgagcctggattctgtctgcttggctgttggcagagccgtcagcttctggggtgtgttttgtttatggcgctggtgaatgaagggcgtgccaagctcctccctggaagaaggcacacacctgtgctcacctgtgcaactactcgcctgccaggagctaatctcaagcttgggcacttcctttagccatttgtatattcactatgcagaaagcacttagtgtgtgcccagccccattgaggtcgcagtggcaaggcagaaaacaaaacccctactctttttcagacagtctcgctctgtcacccaggctggagtgtagtggtgcaatcacagctcactgcatcttcgaactcctggactcaagcgatcctccagcatcagcctgccaagtagctgggactacaggcccaagcccggctaattttttgtatttttatagagatggcttcttactgtgttgcccaggctggtcttgaactcctgggctcaagcatttcccaacaactgtagccttccaaagtgctgggatgacaggcatgagccactgcacctggccaaaacccctgttcttatgcagcttcctttctagacagtacacatagagatgagtgtggatgtagtgtcaggtgatgaccagtggatgacagacacagcaggggagggaatgagggatggaggaggctgtgttaggctgccaaagtgctatttgagcaaacacctgaaaggagggagggagggagggagggaaggaaagatgggtggatggatggatggatggatggatggatggatggatggatggatggatgaatggatggatgggcagatggatatacagccgggtgggtgggtgggtggatggatggatggatggatggatggatggatggatggatgaaaggatggatggatgaatgggcagatggatggatggatggatggatggatggatggatggatggatggatggatggacggacaaccgggtggatgggtggatggatggatggatggatggatggatggatggatggatggatagacggatggatggatggatggatagacggactgatggatggatgtttatggatttctaggagaaagggatctgagcagacagaagagcaggtacaaaggcattgaaccgagtgtatgctcctggcctgtaggggaagcaccaagggggcggcaggggtagggggagcacacagaggcatgaagggggcagatgaggccagaggtgatgaagtcacatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcaccgcacccagcccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatgagccaagatcatgccactgcactccagcctgggtgacaaagtgagactctgtctcaaaaaagagaggtgcgggtgggcgtaggggtctggccttctgctccgggcttggcttgggctccgggttttggggcatgtgggctaagcaggggcctggggaggcaatgatggggcaggggcagaatgaatgggttctctaacttaacacagagaataagacgagtctgagagagaattctgttatagctccttgtgtagctgtgtggcctattccttctgggccttttgaggattgaatggaaaatgcaggcacggtgtctggcctaatcaggcactttgtaatttttttttttttttttttttgaatagagatgggatcttgctatattgcccaggcctgcatagcctgagtgtcagagcaaggccctgtttcttaaaaaaaaaaaaaaaaaaaaaaaggcggcaggggtggggggaagggacaatgatggcccccccgacccaagttttcctaacataaaatgaaaaagtggatgaaacacacctgacatgtagcagatgtttaataagcatgaggtgttttttcattgtccttatttcccttgtgaattaaaacatcattaagtgcatcggtgcacctgaagacatttccgacctgggcgtccttgggcaagttacttaaccactctgtgcctcatttacataaaccaggcctgataccagcccaggcaacatggcgagaccccatctctgcaaaatatttaaaaagttagccaggcatggtggcaggtacctgtagtcccagctacttggaggctgagatgggaggatcacttgaccacaggagttcgagactgcagtgagctatgatcgtgccactgcactccagcctgggtgacagagtgacaccccatctcaaaaaataaaaaataggccaggcatggtggcctggattacgcctgtaatcccagcactttgggaggccaggatgagtggatcacctgaggtcaagagtttgagaccagcccggccaacatggtgaaactccgtctctactaaacatacaaaaattagccaggtgtggtggcgcacgcctgtagtcccagctactcgggaggctgaggcatgagaatggcttgaattcgggcgacagagattgcagtgagccaagatggcacaactgcactccagcctgggtgacagcgagaatccatctctaaataaataaattaaacatagaataaccaggcctgataattgtccatgcctcatagtgttgatcggagagtaaattaccagatgtggatgaaatgcttagaacagtggctacagcttcagagcctccaagtacacttttttctattacacaccccagcctcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaaagtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcactctattgcccaggctggagtgcagtggtgctatgtcggctcactgaaacctccgcctctcaggttcaagcaattctcctgcctccgcctcccaagtagctgggattacaggcatgcaccaccacacctggctagtttttgtatttttagtagagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatgcctatagtcccagctacttgggaggttgaggtaggaggatcgcttgaacccaggagttcaagtctgcagtgagctatgattgcaccactgcactccagcctgggtgatagagcaagaccccaactcaaaaaaaaaaaaaaggatcccacggttcaccttgtgctgccacgatcggttggcagctctgctctgtgccgtcctgtgcctgtcactgagtaagatgcaggagaagttgggcaaaagccctcaggataaacgaataagtcattcagagtaggtgctggtgggaaatgggcttgagtcactcacctggggccagaagaggcccccagggagttgtgagcagattagaccctccaagaccgccccaggggttggcccatgctttccctaactgtgcaaaaatggtttgggataggctgggtgccgtgggtcacgcctgtaatcccagcactttgggaggctgaggcaggtggatcacctcaagtcaggagttcgagaccagcctggccaacatggtgaaaccccatctctactaaaaatacagaaattagctgggtgtggttgcacacgcctgtaatcccagctactcaggaggctgagggaggagaatcccttgaacccgggaggcggaggttcatggggaacccagcaggaaattagaatagaaccaaaaacgccagtcatgggaggcagagctgggggagcgaggctgacaatgactcctgttttcacgctgagagaccccactcccctgctgagatcgcgccactgcactccagcctgggcgacagagcaagactccatctcaaaaaaaaagttaattaattaattagattaaagtacaacaattagcagggcatggtggtgcacgtctgtagtcccagctactcaggaggctgaggcagaagaatcgcttgaaccctggaggcggaggttgccgtgagccaagatcgcaccactgcactccagcctgggcgacaaagtgagactctgtctccaaaaataaaaataaaaataaacggtttgggatgttctgaggttccagacatgccctctcctgcctgcatgtctgccggatgcccaggtctgtagctgtgcatgtgtcactcagtgaccatcaccaaaggggactggaggcatctccccgagccctgggagagtcctccagcctgcactgttctcatgcctgtctctcttctctccccaggatgtttgatgagcgaattttcacaggtatgtggggaccatctagtccattctgaagtttccggattggttccccaacagaacccgagctgccaccaccctggacttggtcctcctgagcgcctcccctcaggcagggagggaggctgggctgtggtttctgtgtcctgggacagaaatgggtcccaggcttctaggtgctgacagactgtcaggacaacccctcccagcttcaaatgccctggacagagagtactaaagctggacgctaaccggtgccaggttggtgaacctgagcctgtgccaggctctctttgaagctgccagcatattttattttaatctgattccaacaatcctatgaaggtggctccactccactactctcacgtgcagacagaggaacggaagcccagctggtgagcacgggtccctgctgcatgcccagcagtgtgactccagagcccatgcagtggcccgtgggccagcacacctgtcccaggaggaagatgcgggctcttcccggggtagcaaaagcatcacggttcttggggtgatcctggcaccccagttccggtcccgcctcccaccagctgtgtgactttgggcaaggtcttgtgggcttcagtgtccacgtctgtgagatgaggataagggcgccttcctctgggctcctggcacgatgacatgagagcctggtcttgtgatgcagccatggggaagccccggcccttttctgagggctcagcccccatagtgtgttggagggcaggagaaccatctctggttgctgcctcccattcctcctgccccttgctctcccaaatctctggccacctctggcactagggctgctgttcctccttctggcgtcagagtctctccccaggacccgttcctggctgttggctggacgtggcgcccacaaggacaggcagaggccaggccctatccccgggattcccccagcttcacacacagacctttacccaggggctctgcagcaagaggaggccagagggccttcaccctgacctccctgactctccccacagggaacaagtttaccaaagacaccacgaagctggagccagccagcccgccagaggacacctctgcagaggtctctagggccaccgtccttgaccttgctgggaatgctcggtgaggccccgcccctggccccggaggcccgcggccagccctgctctgggctgaggcagtgttacctgcaagggggtacccagggcggctcccaccacaccaccacccctcgaaggtgcaaagggagggcaagggaaaacagactccacctacttccctctgcctagagaactctcacatagagaactctcccgcccccaacatctagccagatgtcacctctctcagaagcctctaaatgcccacactaggccaggtgcggtggctcacacctgtaatcccagcactttgggaggccgaggcgggcggatctcttgaggtcaggagttcgagaccagcctgggcaacatggtgaaactcccatctctactaaaaacaaaattagccgggtgtggtggtgcgcatgtgtaatcccagctactcgggaggctgaggcaagagaatggcttgaacctgggagggagaggttgcagtgagctgagattgcactactgtactccagtctgggtgacagagcaagactctatctcaaaataaatacatgcccacaccaggccggacttggtggctcactcctgtaatcccagcgctttgggaggctgaggtgggtggatctcttgatcccaggagtttgagaccagcttgggcaacatagtgagacccttgtctctacaaaaaataaaaagttagctgggcgtggtggctggtacctgtggtcccagctacttgggaggctgagatgggaggattgcttgagcctgggaggtaaaggctgcagtgagctatgatcgcaccactgcactccagcctgggcaacagagtaaagaccttgtttcaaaaatacaaacatgcagctgggcatgatggctcacgcctgtaatcccagcactttgcgaggctgagccaggcagatcacctgaggtcaggagttcgaaaccaacctggccaacatggcaaaaccccgtctctactaaaaatacaaaaaaaattagccaggcgcagcggcgcatgcctgtagtcccagccactcgggaggttgaggcaggagaatcgcttgaaccctggaagcggaggttgcagtgagccaagattgtgccactgcactccagcctgggcaacagaacaagactccgtctcaaaaaaaaaaaacaaaaaaaacatggatgcatgtatacatacctactacatgcatacatacctactacatgcatacacacctacctacatgcatacatacataccaacaccaggtctgatgcctgtcctgagtgcccaccagaccctgcccccagcactcagcttggctaccatccaccaacaccccccaagcacattctgacctcttaggggcaggggtgggccgtttatcccagaatccccacatcatatcaggcctctccctgcagttccctgggagggagggaattaaccaaatcatctgtcccagggttcctgccaccttcattccccagccccttccccagatttttaaccctttccaggccctgcaggtctcagtcccccacaagcagtgatcaaacccccagtgtgccaagcctaggatccccagagctcccagatggtgaagaagggggatccccagatggttcaccccaggagagtgagcaggtgcctggctcggccacccctggagattgtggtccctggagacaagacacggggaatctgtcttcctggtggaggtggggagcaccatcctggagggccaggggccgatggggacagggatgccttctgcagtggcgcccgcggtgggccctgactgcctggaggggcaaggctggggcagggtggccctggacttggctgacaggtgtcatttcctgcttcccttcacaggtcagacaagggcagcatgtctgaagactgtgggccaggtgagaaggaacagggcccgctgtgtgtgtggtgggccgggagggcaaccaccagccctacccggcagccttggggaggagctcaactcagcccatgagcctggagtgctaacgagcctcctctgcccacctgcctccactaggcctcgcagagctgaggtgcaaggcatgctgggagcttactggggtcagggacatggagagctgggtgctggcatcaccactgcctcctgtcgatgcccagacccaggctgcaggttcttggaccagcagcctcccctctggggggcctcagtcaccgggtctgtaaatcggagcccctaagcctggcctgagggctcccctgacctccaattccagtttgggcggagccagggggctgacatgacttgtcctaggtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtggattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggcacagtggctcatgcttgtaatcctggcattttgggtggctgacacgggaggatggcttgaggccaggagttcaagaccagcctgggcagcatagcaacacccacatctccacaaaaaatacaaaacattagccagatgtggtggtgtgtgcctgtcggtgtagcttctcaggaggctagggcaggaggatcacttgagcccaagagttggaggctgcagtgagcagtcatcccaccactgcactccagcctgggcaacagagcgagaccctatctcaaaaaaaaagaaatgactgggcgcagtggctcacgcctataatcccagcactttgggaggccgaggcgggcacatcacctgaggtcaggagttagagaccagcctggccaacatagtgaaaccccatctctactaaaaatacaaaaataagccaggcatggtggctcacgcctgtagtcccagctactcaggaggctgaggcaggagaatcgcttgaacccgggaggcggaggttacagtgagccaagatggcgccactgcactcctgcctggacgacagagtgagactccatctcaaaccaaaaaaaaaaaagagacagaaagaaaaggacccttgtctgtggggagactgggctgggtgggccctgagggactgtgacaggagtatgacaggcagaagatacccgtgtcattcggagttttgtcttcagacccctcgccaacctctgaggaaatgacagactcgatgcctgggcacctgccatcggaggattctggttatgggatggagatgctgacaggtaagaaatggacctgggctggtggtgcttgggactcagctctccagggagcaaagggaaaggggtgggccaggccgtccccaggtgtttcttggtgtcagccgtctgtagtagaggaaacccaatatatgcctgaccctaatccaaggctgggttccttttggaaacctcaagtaggctctatttatttatttagagacggagtttcactcttgttgcccaggctggagtgcagtggcacgatctcggctcaccgcaacctctgcctcccaggttcaagtgattctcctgcctcagcctcctgagtagctggaattacaggcatgtgccaccatgcctagctaattttgtatttttagtagaggcgggctttcgctatgttggtcaggctggtcttgaactcccgacctcaggtgatccacctgcctcagcctcccaaagtgctgggattacaggcgtgagccaccgtgcctggccataggctccatttataacaaggcccagcgtccttcccaggagccacctgttggaattaatttgtccatttatccaacaactatttattgagcatctgttgtgtaccaggtcctgtgtaaggggctggagacaaagcagtgaaccaagcagaagtccccacctcctggggtgcacatcctcatgtgaagagatagatggatagtacgcaaataagtaaaataggcagggtaaggtggctcgtgcctgtaatcccagcactttgggaacccaaggtgaggggattacttgaggctgggagttcaagatcagcctgggcaacatagagagacccatctcttaaattttttgagatggagcctcactctgtcacccagactggagtgcagtggcgcgatctcagctcactgcaacctccacctcccggcttcaagcagttctcctgagtagctgggattacaggcgcccgccaccacgcctggttaatttttttgtatttttagtagagacggggtttcaccatgatggtcaggcaggtctcgaactcctgacctcaaatgatcctcctgcctcagcctcccaaagtgctgggattacaggcgtgagccaccacaccttgcctcaacaaatatttattgagcacctgctatgtactaggtcctgcgtaaggggctggggaaaaagcagtggaccaaacaggtgtccccacctgctggggtacacatcctcgtgcggagagataaacagtaagcaaataagtaaaataggcagggtgaggtggctcacgcctgtaattccagcactttgggaggccaaggcgagggtactgcttgaggccaggagttcgagaccagcctgggcaacatagcaagactccatctctaaaagatttttttttaattgactgacacagtgtctcacagctataatctcaacactttgggaggccaaggcaggaggattgcctcagcccaggagcttgagaccagcctgggcaacatggtgaaaccctatctctacaaaaaatacagaaattagttgggtgtggtggtgcgtgcctgtagttccagctacttgggaggctgaggtaggaggattgattgagcccaggaggttgaggctgtggtgagccgtgatggtgccactgagtaagaccctatcttaaaataaataaataggtcaggtgcattggcttacaactgtaattcaccattttgggaggctgaggcgggcagatcacttgaggtcagagttcaaaaccagcctggccagcatgatgaaacccccttctctactaaaaatacaaaaattagctgggcatggtggcgcatgcctgtagtcccagctactcaggaggctgaagcaggagaatcacttgaacccaggaggcagaggttgcagtgagccaagattttgccattgcactccagcctggacaacagagcgaagctctgcctcaaaataactaaatagatagatagatagatagatagatagataaaaattagacaggaacggtaggacctatgtgtagtcccatctactcaggaggctgaggcaggaggatcctttgagcccaggagttggagcctgcagtgggctatgatggtgccactgcactccagtctgggtgccacagcaagacaccatctcaaaaaaaaaaaacaaaaataggctgggcatgaagaattgcgtaatcctagcactttgggaggccgaggcaggcagatcacctgaggccaggagttcaagatcagcctggccaacctagtgaaaccccatctctgctaaaaagaccaaaaaaaaattagctgggcatggtggcaggcacctgcagtcccagctacttgggacactgaggcaggaaaaccgcttgaaccttgggaggcggagtttgcagccgagatcacgccactgcactccagcctgggcaacagagtgaaattctatctcaaaaacaagcaaacaaaaataggcaacaaggcaggatgcttaggatgtaacactaagcaaaagaggaaaaattgattgtgctttgcttacaactgtgttgcaaacgtaatcactggggacaaacaagggtagagcaaaacagtagcagtgttaggcaaaatgatttgcgttttttattttctaaatcagttatgatgcacttctaatactttggtaatgaagaaaaaaatatgatttgtccagcacaaactgggcatgaccagacttgacagcagtctgtggcgtagctatccagagagtttggttgacgccaagctcaggctgagatgacagcatggcgtggcgcctaaggaattggcacggtgcccagctgggtttgcagtggccttagaaaacaccatagaagcctccatgcagcactcacagccagaggctgggtggcactgcaggggttgggggccttggatgagcacagcatcattgctgtttgtttcacagagcagaacacaggctcagcaaggctcatccacctccccaaggtcacacagccttgggctggaaaacatgtttcccatgcagggttccttcccaggcaccccagtcaaacctgatgaattaagaaaattctggctgggtgtggtggctcacacttataatcccagcactttgggaggccgaggcgggatcacctgagatcaggagttcgagaccagcctgcccaacatggcgaaactccgtctccactaaaaatacaaaattagctgggcatggtggtgcgcacctgttatcccagctatttgggaggctgaagcaggagaatcacttgaacccaggaggcagaggttgcagtgagccaagatcgcaccattgcacttcagcctgggtgacaagagcgaaactctgtctagaaaaagaaaaaaaaagaaaaagaaaattctgatggtagtcacatctgtaatcccagctactcaggaggctgaggcaggagaatcgcttgaacccaggaggtggaggttgcagtgagctgagactgcaccactgcactccagcctgggtgacagagcgagactctgtctcaaaaagcacaaaacaacaacaaaaaaagaaaattctgagatgtccaggaccaccatggattagaggattttgcatttgtgtgctttttctgtttacacatatttgatatgaaacagttaaatgatacagaactgtgtaatacattgagcaggtgcagtggctcatgtctgtaatcctagcactttgggaggccaaggtgggaggatcgcttgagcccaggagttcgagaccagcttggacaacatggcgaaaccctgtctctacaaaaaattttaaaaagtagccagccgtggtggtacatgcctctagttccagctattgaggagactgaggcgggtggatcgtttgatcccaggagtttacaaccagcctggggagcatagcaagaccccatctctacaaaaaaaaaaaaaaaaaaaaaaaacaattagctggatgtggtggtacctacctgtagtcccagctattcaggtggccaaggagggaggatagcttgagcccaagaggttgaggctgtagtgagctgtgattgctccactgcactccatcctgggcaacagagcaagacccaggaaaaagctccagtcacatcctcctcaggcaaccactagtattcctagcatcttccttttgtatgtttttatctatgtgctaattcatgtgatgactattttaaacaaattgtcccttgtattctcacctggaagtttttttgtttgtttgtttgtttgtttttgagacggagtctcactctgttgcccaggctggagtgcaatagcatgacctcgctgcaacctccgcctcctaggttcaggcgattctcctgcctcagcctcccgagtagctgggattacaggcatgcgccaccatgcccagccaatttttgtatttttagtagagacagcatttccccatgttggccaagctggtctcaaactcctggcctcaagtaatccacccatctcagcctcccaaagtgctgggattacaggtgtgagccaccgtgcccagccgaggactttgtcttgttcccacgtgtcctcagtgtctagaacagactagcttgggaggtgcatgcaaaatgatctcagcctgctttcgtgtgaaggccagggtaggcacctgtatggaatcggggtccctgatcccattggagtgggtgccatgcttcagagttggggccccctggcctgccattccccagctatctggcctgacgtcggcagtgcatggcttaggagatgatgaatgtggcttcccggcatcctctgttctcttttagacaaaggtctgagtgaggacgcgcggcccgaggagaggcccgtggagggtgaggccctgtctacccctgacattttacacccacccccaccccatctctcttcccctgccgcccacctccccttggcctctgggtctcttcgttctctccacctcatctctctccagcaccctggtgtgggggtgggaatcctgtgggctgcctgatatgggaggagatttaaggatttgtcttctagaaccaggaagttcctggtcaaaggtgagagcagttcccactgctaaggaaaattgcaagcctttgtttttattacacaccctgctgctttgcgcaaaggttttaagactgggaactgagcctcctctatctgagcaagtagattagaggcctgaaagcacaaaatttgctttgtgtccagcagacacgcccattctcaggaacgtgagaattccctccctgctgagaatggaagtaggacagagagagagggaggccagggtgagggtgggtctgtttcatctctgtagtatcctggaatggaatgagtgagtgtcagaggagagaattgtcacttccccaaacccagcctggcaggaggaaccatgaagtcttaacacagttccgctgccacctggtggcagcctgctcaatttgcaggcttagtgggtacccactagttctatcacatgctacactcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccacggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggccctgtggcaccgggtggccctacagcagccatgtctctgcagccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggtaaggcccaaccaggtccatgggagacagcaccggccctgctcagcaccaaggggcaggagcagcaccaaattgccatcaagcaattcttgtgcctcagccacctgaatagctgggaccacaggtgtgaggtgtgtgccaccatgcccagcctttttttttttttttttttttgagacagagtctcactgtctcccaggctggagtacagtgatacgaacttggctcactgcaacctccgctctggcttcaagcgagtctcctgcctcagccccttgagtagctgagactacaggtgcgcgccaccacgcccggctaatttttgtatttttagtggagacagggtttcaccatgttggccaggctggtcttgaactaccaacctcaagtgatccggccacctcagcctcccaaagtgctgggattacaggtgtgagccacggcaccaggcctttcttttctctctctcttttttttttttttttttttttgacagcaaggtgttagatggggtttggctgcagttggcagacatgaggctccccaggcctgccagacccaaagccaccgaactgacccctctcgcagtctcaggagagcagtgttcagtttccccagatgcagaatgggaacgtcccatcagctcacgggttctccaggctggcgtgttggtgtcctgggccgggggctgggagcaatgccctgtcgtcccagaatgggaaggaccagcagtggcttctacaggctgtttctgtttccttgagcgtgttgtgtttttgccaatgagggcccgggacagcacccatggacataccctgtgtgcccagctgggataaaaagtccctttgggcccgggcgcggtggctcacgcctgtaatcccagcactttgggaggctgaggcgggtggatcacgaggtcaggagatcgagaccatcctggctaacacggtgaaaccccgtctctactaaaaaaaaaatacagaaaattagtcaggcatggtggtgggtgcctgtagttccagctactcaggaggctgaggcaggagaatggcatgaacctgggaggtggagcttgcagtgagcggagattgtgccactgcactccagtctgggcaacagagcgagacttcgtctcaaaaaaaaaaaaaagtccctttggagaaggtggtggcagttattgagtaaaaatgtggttgggggatttcaggaacagtggctcatgcctataatcccagcactttgggaagctgaggtgggaggattgcttgagcccaagagttcaagaccagcctgggcaacatggcaagactgtgtcactataatttttttttttaaactctggtgtggcagcacatgcctgtagtctcagctactcaggaggctgaagcagaaggatcacttgaggccaggagttcaagactagcatgggcaacataacaagaccccatctctacaaaaaaattttaaattagctgggcatgatggtgcacacctgtaatctcagctactcaggaggctgaggtgggaggatcacttaagcccaggaggggtttggaggctccagtgagctatgattgcaccactgcactccagcctgggtaacagagcaagactcttcctcaaaaacaaaaaaaaccagggaatgggaggatcatatttccattttgtgtttgttacttctgtgttactgtaatagcacatatttaggcttggtttacagctgggcatgacggctcatgcctgtaatcccagctggcatttgggaggccaaggtaggcagatcacttgaggtcaggagttcgagaccagcctggccaacatggtgagatcccatctctactaaaaatacacagattagccaggtgtggtggctcacacctgtaatcccagctgtaatctccctgtcatcaggagactgaggcacaagaatcacttgaacccgggaggcggaggttgcactgagctgagatcgtaccacgacactccagcctgggcaacagagcaagactctgtctcaaaaaaaaaaaaaaaaataggcttggtttggttgaaagtggcaagaaagaagagactcttaagggtttgttcctccaggagaatagatagttctcaaactgggagactcacagcgtcatttttcatacagtggcgaggagatccgctgggacagggagctctactgcagggcctgctctgtgccaggagggaggctgctgctccatgacacacaaagagcagatagcaaaaagctatgcaacagggctggagagcaagagtcatgattcgtgcagtagaagcaaaggcttcagcaggccaggatgaatgcagccacatgcccggtgtgtctgggcatattaaaaggaagattgagccaggcatggtggctcatgcctgtaatcccagcactttgggaggctgaggtgggcagatcacttgagatcaggactactgaaaatacaaaaattaaggccgggtgcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcaggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatggtggcatgcacctgtaatcccagctactcaagaggcaaagaggagaatcacttgaacccgagaggcagaggttgcagtgagccgagatcgcactcctgcatttcagcctgggggacagtaacactcttgtctcaaaaaaataaaaagggaagatcacatttcaggtggtttaaggataaactcatgatagacatatagcccatcagatgtgtgaaaacagggaaataaagattcacaagagaatatgtgtaattatagtacagtaattggctctactatatacatgtatagtactgtactggttgaaggagggcttctttcaacaaattctcagcctgagcaatgtgtgaaaccccatctctagggaaaaaaaaaaattagccaggcttggtggtgtgcacctgtagtcccagctacttgggaggctgaggtgggaggatcgcttgagccaggaggtcgaggctgcagtgagccctgattgcaccactgcactctagcctgggtgacagagtaagaccctgtctcgaaaattttttttttttaatttttttaaaaatacattccgtccaggcgtgatggctcacgcctgtaatcccaacaccttgggaggcccagataggaggatcgcttgagcccaggaatttgagagcagcctgggcaatgtatcaagaccccatctctacaaaaaattttaaaaattctcacacctgtaatcccagcactttgagaggacaaaacaggagggtcgcttgaggccaggagttcgagaccagtctggtcaacatagcaaccccatctctattttatttttaaaattaaaaaattagccaggtgcagtggtgtgtgtctgtagtcccagatacttgggaggctgaggcggaaggcggaagaatagcttaagcacagagggtccaggctgcagtgagctatgatggcattactgcactccagtctgggtgacagagcaagacctcgtccctttaaaaatacaaagagaggccggggcatggtggctcacatctgtaatcccagcactttgagaggccaaggcagatggatcacttgagttccagagtttgaaatcagcctggccaacatggtgaaacaccatctctactaaaagtaccacaaattagctgggcgtggtggtgcacacctgtagtccgagctcctcgggtggctgaggctcaagaatcacttgaacctgggaggtggaggttgcagtgagctgagatcacatcactgcactccagcctgggcgacagagcgagactccttctcaaaataaataaatatagggtttataaataaataaaacacaaagagacaaacaaactaaaaaaccatcctggatgcctgccaggtcccgggcttgcagcccagcagtaaatgccaccaagtcctgccctggagttgccgatgtcacccagacaaaatcaaaatgtcatgtcaggtagagataactgctgtgacaggatataatgcagagtgagggggagagagggacaggaggaacctggataagaaggtgacattgaagcggtgacccaatgaagggagagggccagccaggtgcataaagagtgtgggagcaggccaggcgtggtggctcacacctgtaatcccagcactttgggaggctgaggcaggcagatcacgaggtcaagagttcgagaccagcctgaccaacatagtgaaaccccgtctctactaaaaatgcaaaaattagccgggtgtggtggcgtgtgcctgtaatcccagctactcgggaggctgaggcaggagaatcacttgaacctgggaggtggaggttgcagtgagccgagattgtgccattgcacttcagcctgggtgacagagggagactctgtctcaaaaaataaataaataaaaataaagactgttgggacagagaaaaagtcatgcaaagtccctgaggcaacaacgtgcttgggtgtttgaaagcttgcaaggtgcccttgcagctggtacagggtgagtgagggaaggatggtgaggttgaggcccaagaggtagcaggggaccaggcgtgtggcccacgcctgtaatcctagcattttgggaggctgaggcaggaggattgcttgagctcaggagtttgtgaccagcctaggcaacatggtgagaccctatctctataaaaaagaaaaataggccaggagaggtggctcacgcctgtaatcccagcactttgtgggggttgaggagggtgtatcacctgaggtcagaagttcgagaccagcctgcccaacatggtgacaccccatttctaaaaattcaaaaattagccaggcatggtgagggggtcctgtaattccagctactcaggagactgaggcaggagaattgcttaaacccaggagacagaggttgcagtgagctgagatcgcgcccctgcactccagcctgggcgacaagagcaaaactctctctcaaaataaataaataaaaaggtagcaggagccagatcacatggattttgggccagcttaaagagtttgaattttattttattttttaaaaagtcttaagagacagtgtctcattctggtttgtttttatttttgtttttgctttctatgcctattccctcaaaccataaactaggggcacccgggcagcttgaggtcaggtgccaattcaacagcaagtcctcatgaatgacattttttatggctttgtgcagagacaccttgtgctcatgagcattggttttttgttttttgtgggttggtttttttgttgttgtttgtttgttttctattttttgagacagagtctcactcactctattgcccaggctggagtgcagtggcaccatctcagcttactgcaacctccgcctcccgggttccagcgattccccggcctcagcctcctgagtagctgggataacaggcgcatgtcactacacctggctaaattttgtatttttagtagagacggtgtttcaccatgttggtcaggctggtctcgaactcctaaccttaagtgatccatccaccttgacctcccaaagtgctgggattagaggcgtgagccaccatgcctggccttttgtgggttttttttgagacagagtctcactccaggctggagtacagtggtgctgtctcggctcactgtagcctccaccttccaggtttaaacgattctcctgcctcagcctcccgagtaactgggattacaggcgtgagccaccatgcctggccatgagcatttgttttaagagacaagtctttctttagcccaggctggagtgtagtggcacaatcataactcactgcagccttaaactcctgggctcaagcaatcctgcttcagcctcctgagtagctgggactgcaggggcacgccaccacacctggctaatttttacattttttgtagagaaggggtctcgctatgttgcccaagctggtctccaactcctgggctcaaagcgatgcccctgcctcagcctcccaaagtgctgggattacaggttgagccaccatgcccagccttgagcactttttaaagtcacgatggctttctccacctgtcatttggaaagggagacaggtcagtgcagtggccgacgggagaggccgtctggtgggtttgaggccagctcctcctgttactccctgtggccttggcagccggctgtgctatttaaggggaagcactgtcgctactctggcctgggactcaggggctctgcccagcttctgcctctctaagtttactgctgggaagtcacttcccctttcagaacctgagttctcccataaagaggaggggcctaaatgcagtccgaagccttttctagctcctgagactgtggttcaaggcagggctatgcttcccctcccagccctggccccgtgaccccagctctgtgcctggcactgtacagaagcctaagagatgcccaccgccagagcgggcaccaaatcctcatctactggggaccccaggggtgccctccctgagagtttggcctttgggctcactcccaggcagagactcctcggagttgctgcttgattacccctgtgacagagagctcattacctctccaggcccattacctctccagagagctcattacctctctgctccatggcctaccctgccatcccccgacagcccccttctggccagcatgattttcccagtgtcctctacccaccacaaaccccagccccacaacaggcttgctctaacaggacaagttgtgctgaagatggggccttcagaagcagtgctgtatgacaaagaaggttgactcatgtctggacagggctttctggagtctgtggagctaaagacattagcataatacagagctgggcttggtcactggtgcttccgactgcagtaacacagcagctctcagacgtgagccgtagatctcagacctttccagaagcttggagttcttgcttcgtagtgggccccgactgtttctactcttttctttcattttgagacggagtcttactctgtcacccaggctggagtgcagtggtgctatctcagttcactgcaacctctgcctcctgggttcaagccattcccctccctcagcctcccaagtagctgggattataggcacctgccaccacacctggctaatttttgtatttttagtagagacgggtttcaccatgttggccaggctggtctcagactcctgacctcaagtgatctgccctcctcggcctcccaaaatgctgggattacaggcgtgagctactgcacctgaccttgtttctacactttaaaccagctccacgggaggccacctgaggccacctgctccaatcccaggcagtgacaatcgtgcaatgtccctggagcaggagtgagatatcagatggacctgttcaggactggggggggtctcactcccagctggatccttcaagcccagcgcagccccccagattccacatgtggggcggcagggactccaggcctgaactatgcatagccagaagggtccattgcagggctgtgtagactgaggcccagagaggagggctgagcagtcccagagatgcttggagggacctctgtgatagcctcgcttgtgttttccaggcccgagctgctcactgagggagtcaaagagcccatcatggatagtcaaggtacccagcgcggggtcgggagccatggtgtgggcgggcaagggagggccccaggcctctgccaccagcccctcctcctgctgcctctgtcctgctcccatcctggccctggcattctccccacacccccacattgggtttcccctaacgatgccatcttgggtcccaggaactgcctcctcacttggcttctctccccctgccctgcccccagagagggattccggggaccctctggtggacgagagcctgaagagacagggctttcaaggtaaggttgagctcacggggaggtctgttgtcccagcaccaggacattgacctggtttgggtttggagggccaggctggaagtggggaggagctggcccccaacttcagggcctaagggaccaggcaagccaggttggcagcccaggcccggctgtaccctgccagctctgtgttagagactccaggggagagggggtgcctacaggtggacggtcgggggagcccaggagcctgcctgccccctccctgccccaccccccagaggtagctgacacgcccactcctttttcagcaatcagctgtggtcttagtgctttgaaatcagaataggagccagacgcggcacctcacgcctgtaatctcagcacttgggaaggtcaaggtgggaggatcgcttgaggctgggagctcgagacaagcctggacaacatagaacccgtctctatgtctatttttaagaaaagaaatcagaggccgagtgcagtggctcacgcctgtaatcccagcactttgggcggccgaggcaggtggatcacttgaggccaggagttcaagaccagcctggccaacatggtgaaaccccgtgtctaccaaaaaaatacaagaattagttgggcgaggtggcgtgcacctgtgatcccagctactagggaggctaaggcgggagaatcgcttgaacctgggaggcggagattgcagtgagccgagatcatgccactgcactccagcctgggtgacagagcaagaccctgtctcaaaaaaaaaagaaagagagagagagagagagatggtggtctgggatccctccagcacatgctggcacttgtctttgtttgtttgtttggatggagttttactcttgttgcccaggctggagtgcaatggcgtgatctcagcccactgcaacctccgcttcccgggttcaagcaattctcctgcctcaggctcccaagtagctgggattataggcacgtgccaccacacccggctaatttttgtattttttagtagagacggggtttcaccatgttggacaggctggtctcgagctcctgacctcagatgatctgcccacctcagcctcccaaagtgttgggattacaggcatgaaccactgcacccagctttttttttttttttttttttgagacagagtcttgctctgtcacccaggctggagtgcagtggtgcgatcttggctcactacaacctccacctcccaggttcaaggggttctcttgcctcagcctcccaagtagctgggattacaggtacgcaccaccatgcctggctaatttttgtatttttagtagagatagggtttcaccacattggccaggctggtttccaactcctgccctcaggtgatcctcctgcctcagcttcccaaaatgctggggttacaggcatgagccgccgcgcccggtcacacttgggcgtttttaatgaacactttctgggtgagggtgtcttggtggctcatgcctgtaatcccagcacttttggaggctgaggcaggcagatcacttgagcttgggggttcgaggccagcctgggcaacatggcgaaaccccatctctaccaaaaacacaaaaaagaaattagccaggtgcggtggtgcacgcctgtggtcccagctactcagaaggctgaagcaggagaatcgcctgagcctgggaggtggaggttccattgggagccgccaggcccatcccctgtgtctgtggggactgcccatcctcctccatctgctagatcagctgggcttccattccctcgcttgtctccagccccctagtgacttcatgaagcccccgccccctgcctgccagcccagggcacaggactccgtactctatggtgtccctcccctccggggcttatttattggtttggtggttttcaaatgtcatcaattaacttaatttccaactcatcactgttgtggcaacagtgcatgtccttctgaaaaaaagacatctccatcaacatgtcggtgctgaaggacctgaggggcccactccaaagatcctttaattgccggagaaggagttccccataattagaaaatcatcttccttaaaagtcaccaagtgctttttcactcaacagcccaaacccataatcgttttgcgctttgcagaaaattatgacgcgaggctctcacggatcgacatcgccaacacactaagggagcaggtccaggaccttttcaataagaaatacggtaagcagtgcagaacccccggggagggacacgcagctgctgtgcacagagaagtgggaggcttcccagttccagccgagggcatttctggggaaacaattcacccctttacatgtatttcttgagcatatactacgtgccaggcactgtctcaggcactggggatattgctgtgaataaaacagacacagtccctgtactcatgagccttgcagaccaatgaggtgagatacactttcaagaactacacacagaatttaatagacaagggcccggcacagtggctcctgcctgtaatcccagcacttttggaggctgaggcaggtggatcacttgagctcaggagttcgaggccagcctgggcaacatggcaaaaccccatctctaccaaaaacacaaaaaagaaattagccaggtgcagtggtgcacacctgtggtcccagctactcaggaagctgaagcaggagaatcgcttgagcctgcgagggggaggttgcagtgagctgagatcgcgccattgcattccagcctaggcaacaaaagcgaaactccgtctcaaaaaaaaaaaaaaaaaaatggagcatatgacatgggagcatattggtgtggctttttctttcgtttcttttttttttttttttttttttttttttttgagacagggtctcactctgtcacccatgctggagtacagtggcgtgatcatggttcactacagcctcaaactcctgggctcaagcaatcctcctgcctcagcctcccaagtggctggaactacaccccactgggcactaccatgcccaactagtttttagaaatttttagtaaagacagggtcttgctgtgttgcccaggctgatctcgaactcttagacttaagagatcctcctgccttggttccccaaaatgctgggattacgggcataagccaccatgctggccttttttttatgttctgatcaaacagctcagattgtaatgcctatacctttccacagtgctacactacataagagctttctcgtaccattcactctcctgcacgcatgtctttccatcacatccccgcaatcccatgtacacacaccccacgctgcctctcactcctgacgggcaggaccctgcctctcgcccacaggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggtactcagtgggaagggtgagggtgaagaggcaggactagctcagatgggagcttgcacctgcgaatccttagcctttccctaggtcctgccctcccccctggacaaggtggctctcctggcaccatcctgggtcctgggggtggttggagagggactgcaggccagcccaagtgaagggagcccttcagaagtgggactggtcacccccccatggcaagggcagcctttgagggcatcttcaacctgttcagcaacacccgctcactgcacccccagcccccgggaaaggtattcagcccccatcagagggatttgcccaaggtcccggggccagccagggcaaagcctgcacaaggcccaggtctgcgtcctgcagagtgacactgccaatgccagcaccctgccacattgtctcagtgtcccgcacacacagagccccagggcagcttgttaaaatgcagattctgctgctgtaggtctggggtgctcccaggggagaccgaggccactgaatcccaggggtgtcttcctcatcccccaggccctccccatgacacccctgcctctgtttctcttctaggcctttccaaggactcatcccaaagcctggtaagaggcactggctgtggagggggcactgggaatagggcccgatcgtggtgctggggactggagctaagcctgctgtggggcacaggttctggggtctgggaacagaagccaggcccctgcctttcttttttttttttctgaggcagagtccttctctgtcacccaggctggagtgcagtggcttcatctcggttcactgcaacctccacctcctggattcaagcaattctcctgcctcagactcctgagtagctgggattacaggcaattgtcaccatacctggctattttttgtatttttggtagagacggggtttcaccatgttggccagggctggtctcaaactcctgacctcaagtgatccacccacctcggcctcccaaagcgttgggattacaggcgtgagccactgcgcccggcctaggcctctgcccttctgtttagccaccttacctgggctcctgccccaggtagatggaggaagactaagcttgaatgtggccccagatcctgggacagagaaaggggtggtggcgtcagtgacttctaagttttacccagtctgggttcaggagggaggggccaggccgagtcagtgcacctgctcctcctgataaaggggctctggttgacctcagtgaataggcgaggttggaggtgagtgggttcctaaccgcagaaggaggggtgtctgcatggggaccacaagcatgttggtaagatgtgggtggcgcctaccctgccttaaacagtgcagtgcctctcctgaccctttttaaaaaaatattttatatatataataaaatatatacataataaaaaatatatataataaaaatattatatataattaaaaatatttatataattaaaatattatatataattaaaaatattatatatataataaaaaatattatatagagagagagagagacagagacagaccaagtctcactttgttgcccaggctggaatgcaatggcactatctctgctcactgcaaactccacctcccaggttcaagctattctgcctcagcctaccaagtagctgggattataggtgggcaccaccatgcccggctaatttttgtgtttttagtagagctgggtttcaccatattggctaggctggtctcaaactcctggcctcaagtgatcctcctgcctcagcctcccaaagtgctgggattacaggcatgagccaccacacccgacctcctgaccctttttaaggcacccatccacttctgtctccaccatggactgtgtcctggcctcccaaacccagatttgcaggggctgtccctgcagggtgatcccaaacccagatttgcaggggctgtccctgcggggcgacatgccacttggcaagcactaagggctggccagagcctccagggcgggccaggcacggtggctcacacctgtaatcccagcactttgggaagccaaggcaggaggatcacttgaggtcaggagttcgagatcagcctgaccaacatggtgaaaccccatgtctatttaaaatcccaaaattagccaggtgtggtggcgcacacctgtaatcccagctacttgggaggctgaggcaggagaatcacttgaacccgggaggcagaggttgcagtgagccgagatcgcgcgactgcactccaccttgggcgacgggactagattgtctcaaaaaaaaaaaaaaaaaaagaacttagggtacagtgatgtggcggctgctgacaggccacgggaacccccagaagggggatcaggagggtgaggggtagttggagagggtttcctggagtaaggatggccctgcttgggcctcaggggaagatgggactttgagaggcagagaggagggtgggtttggcggggtgaacggcaggggttggggggtcactggatgccagaagtgtgtttccggagctctcggaggggcagagtggtcagatgatgttggaaaggtggagagagtggaagctgcagcagcacagtgcagtgagtgtggctccagtggacacccggctgagaggtcactgggtttctggccctgcactggtgctttatgcgggtgcctttcacacatattttgggaggtcctgctgggacaaggtggtattctagaggaactagggttacagcagagtgcagacagaggaggcatctcatttagtcttcatagctaggaggttgacgctagagcccaccttacagagggggagactgaggctcggtgtgagtgatgtgttaatactctgtgtcccagggctagcaggtggtcgtggcctcagccctcagggatggacctgccagcccctttccaggcgttggcacccaagccaggtatccaccaggtatccacacttactcatgccactagtcatgctgggctgggaacacgtccaggctcctgggagtctctgagggttcaccagaggtcactgagtgctacttctgcaccagaatgggcttttctcaaactctccctcacacggttcccgaagcctggcctgggccagcaccggcagttccagggtgaatcggagtggaagctggggtctgctgggggaggcaggggaaatagcagaccccttcatctggaggcaggtgtcccagggcaggtggaggggtggcagatagttgcagagaggcgggtggctggggacagtgcccaggagtcagccttcagggtcttaggcagcatgtgggccatgggaaagtgccgcctcattcaagtccctgtacccgcctgactagccatgggaatctgagccttcacttccttaccgccaagatggacaagcacacctgcctcaccatgtgatctgaatatgggaaaagatgggcagtgctaggttagctgggaggactattttccgccaattgccctcttttttttttttttttttttttttttttttgagatggaatttagctcttgttgcccaggctagagtgcaatggtgtgatcctggttcactgtaacctccgcctcccaggttcaaatgattctcctgcctcagcctcctgagtagctgagattataggcgtgtgccacagcatccagctaaatttttgtatttgtaggcaccctaacacaatgaaagtccaggctggttgaccaggctggtctcgaactcctggccagcctcaagtgatccgcccatcttgacctcccaaagtgctgggattacaggcgtgagccaccgcattcagccgcctttctttttgtcctcgtttgcaaatacagaatggaccttagtctgcaaactcagaagtgcgagacatgtatttttatttttctaaaattgaactggactcctaccaaaagcccccaatgcagagtggcagaaactttatctgagtccattttggatcatcatttcccttgagcttgcactagggcctggaaccttctgtgaggcccactcagtagacacttccacaccgcagagagactgagcatgagaaggtccgtgcttgaaaaaggcctaacggtgggatctcggtgcaaagatgggagagtggaaaccgagtggtgaagagatgactgtggcacccagcagggaattcccaggagggtgaggcttcgggaactttccagggggacaaaccctgttaagaatggctctagggcctggtgctgtggctcacgcctgtaattccagcactttgggaggccgaagtaggcagatcacgaggtcaggagttcgagaccagcctggccaacatggtgaaaccccgtctctactaaaaataaaaaattagctgggcatggtggcgggtgcctctaatcccagctactcgggaggctgaggcaggagaatcgcttgaaacttgaaggcggaggttgcagtcagccaagatcacaccattgcactccagcctgggcaacaagagtgaaactccgtctcagaaaaaaaaaaaaagaatggctctaaaccaggaacagtggttcacccctgtaatcctagcactttgggaggccaaggtaggaggatcacttgaggccaagagtttgaggccagcctgggcaacataacaagaccccgtctctacaaaaaaattaaaaattagccaggcacggtggcacgcacctgtagtctcagctactcaggaggccgaagcaggaggatggcttgagcccaggaggtggaggttgcagtgagctgagattgtgcaactgcactccagcctgggtgacagagcatgacgccatctggaaaaaataaaaataaaaagaatggctctgagatttttttaggtcacttattgaaggttcccatggaagcctttcctaacagaaccaccccgagaaggtaaaaattctgaaagagattgtgcttttttgtttttgttttgttttgtttttttgttttaagatggagtttctcttcttgttgcccaggctggagtgcaatggcacaatcttggctcactgcaacctccacctcccgagttcaagcgattcgcctgcctcagcctcctgagtagctggaattacaggtgtgcaccatgacactcggctaatttttgtattttgagtagagacggggtttcaccatgttggccaggctgatctcaaacttctgacctcaggtgatcagcccgcctcagcctcccagagtgttgggattacaggcgtgagccaccgcacctggctgagattgtgcttttttgaagatgaatcagtcattaaattgcaagagccccactgcaccctagagctgtgagcctccccagtgtagggtgagagtacagccactcctggactggttttgttctgggtcaaaagagatgactcaggccagacgtggtggcttatacctataatcccagcattttgggaggccaagatgggaaaatcacttgagcccaggagtttgagaccagcctgggtaacatagcaagatcccatcctgcaaagacatttttttaaattagccagacatggtggggacgaacgactgtattcccagctactcgggaggctgaggcgggaggatccctcgagcctaggagttggaggctgcagggagccataattccagtgtgtgtgacagagcgaggtcttgtctctaaaaaagagagagagagagagataagcccagaatgtctttaatattttcccagctgaggacatcacgtttgccttcagtgcctcagtttccccactaaaatctagaggccctgcctgctctgacatgctgagtggcgggcaggcgtctagcttgagaggaaggcatacttggacttggaccaagcctcagagggcagtgggtgaatttcaggcctcaggtcaagggagctgtgggccaggggtttctgggggccaggggtactagaaagcaccagactgaactggaggggacctggtggggggcctcgggttgcagagggatgggggggactgggtcccccaactcataccagaaggaactccagccctgcccgcaaggggctgagacaacccacgctcgaccctgggggctgaacgccattggtagctggtagctctatactgcccaaccaggccacacccacctgcctgcagcggcactgaattaaattagggagactgccaggcgcggtggctcatgcctgtaatcccagcactttgggaggccaaggtgggtggatcacgtaaagtcaggagttcgagaccagcctgggcaacatggtgaaaccccaactctactaaaaatacaaaaattagccaggcatggtggtgcactcctgtaatcccagctacttaggaggctaaggcaggagaatcacttgaacctgggaggcagaggttgcagtgagccaagatcgcgccattgcactccagcttgggcaacagagcacaacccggtcacaaaaaaagaaagaaaaaagaaaacccaggacagctaacgggggctgttcaggatatgctgggaagaagcggtggtgactaaggcgggagaaaccctctacccaggtagctgctgtaatattccatccgaagaacattctagtaggtcataaaaacctaaagggggtcgggcatggtggctcatgcctataatcccagcgctttgggaggccagtgcaggaggattgcttgaagccaggagttggagatcagcctgggcagcatagtgagaacccatctctacaaaaaaaattttttttaattagctgggcatggtggtgggtggtggcgcttgcctgtagtcctagctacccaggaggctgaggcaggagggtcacttgagcccaggagtttgaggctgcagcgagctatgatcacaaagctcacatcacctcacttcaacctgagtgacagagtaagaccctctctctaaaagacacacaaacacacacacacacacacacacacacacacaccctaaagagaaatgcaaatatatgcccatggtagaaatttggaaaatacagaaatctaacaacccagatggctgttcatttttatgatgatacatttcttccagatttccccccaagcttattaattttacatctcactgttcttctttctataaatttacacatttaaccttaaaacataaacatgttcccatgtctttaaaaagctctgttccctcttcaggctgtatcatggttatgtaactaccctgtcccccagttatggacatttgagcagcccctcacaccacagacacctaacactcacgtcacacttttttttgagacggagtctcgctctgtcccccaggctggactgcagtcgtgtgatctcaactcaccgtaacctccgcctcccgagttcaagcaattttcctgcctcagcctcccaagtagctgggattacaggtgcccgccaccatgccaggctaattttcctattttagtagagacggggttttgccatgttggccaggctggtctcgaactcctgacctcaggcgatccacccgcctcggcttcccaaactgctgggattacaggtgtgagccaccatgcctgaccacgtcatacttacgatttgccggttacaaagcccactcacgttaccacgtcatctccccaagtagctggccttattggaggggactgaggctcagagagattaagcagctttctcaaggtcacacagtagtgtggtagagatttgaacctaagtctttaccattttattatacttcggaacccagggcaggctctaccactagcctagggcttgttgtgtgtccctgaagtgggttgcagccacgccctctttcccaccacccctctggtctcatccacacagggtggctctttgctgtcccctcctggctaccagcagctattacactggtcctgcctgtgtaaacctttaggcttgtagttaatcctttgagttcatttatttgtacaacaaaaatgtatggagggccaggcgcagtggctcacgcctgtaatcctagcactttgggaggctgaggcaggcggatcacaaggtcaggagatcaagaccatcctggccagcatggtgaaaccccgtctctactaaaaatacaaaaattcgctgggcatggtggcgcatgcctgtaatcccagctacttgggagcctgaggcaggagaatcgcttgaacccgggaggcagaggttgcagtgaactgagattgcaccacagcactccaacccggcgacacagcgagaccctgtctcaaaaataaaaaagaaaaaaaaaaggagagagaggtggaaagtccgcaggtgaagcccagggagaaacttactgaagggggtgattggttgcaccagcctctgctgggaggtcagtcctaatgcctgagagtagacggaggtgctaagcaacaggttgcagtgggatggttcagagcaattttgggggaagtggtggggaccagagtggaatagtgggctcaagagacaatgagaaaggcaagtgattgaatctgccaaggaccaagcaccaaagtgccagctcactgccaccctcagtaaagactaacttgccctttcccccaactcccctcccagaagtagcttgctctcctctgcctgccacacatcgggggggtcaggtctaaaaggatcaccttttagagggcaggagagaatgaacaagagttgagagtggaatggctgcagagagggctttcttttttttggtggagggaggggacagagtctcgctctattgcccaggctggagtgcagtggcgtgatctcggctcactgcaacccccgcctcccgggttcaagtgattctcctgcctcagcctcccgagtagctgggattacaggcgcgtgctatcacgcccgactattttttgtattttttagtagagatggggtttcaccatgttggccaagccggtgtcaaactcctgacctcaaatgatccacctgcctcagcctcccaaagtgctgggattacatatatgacccaccacacccagccaagagagggttttagaggtaggaacagcagctgcatgatcttcagcagattcagtagagagggaagtgagctgtgggagaggaaggaggatggggggaatggcaagaaaaggagcaccctgcttagaaagggaacggagctgggtgtggtggctcacgcctgtaatccagcactttgggaggccgaggcagtaggatcacttgagcccaggagtttgagaccagccacataacaagactgcatctctatttaaaaaaaaaaaaaaaaaagaaggagaaagggccgggcgtggtggctcacgcctataatcccagcactttgggaggcccaggcgggcagatcacaaggtcaggagatcaagaccatcctggctaacacagtgaaaccccgtctctactaaaaatacaaaaaattagctgggcgtgatggcgggcacctgtagtcccagctacttgggaggctgagtcaggagaatggcgtgaacccgggaggcggaacttgcagtgagccgagattgtgccactgcactccagcctgtgcgacagagcgagactctgtctcaaaaaaaaagaagaagaagaagaaagagaaagaaacaggatgggtggaagagggttgctgaatgctcatgcaagctcctgtctgcctgctccttctctcagggagggacaggggagggtgatgagtcagtggactaaatgtccccatggggatgaaggacagttggggtcaggtttctagagggagggctggaaggagggaaggagatggccagagaaggatgtgggacacagaggtgccgccatggatcaccaagaggttcaggactggccagagggaggagaagaggtcaaggtacgtgtggggcacttggatgacgcatctgtgcctgcacacagctgaaatccccaggaaataagacgggagcagggtgggtttctgcagccaaggtgagaccaaaatgccagctcactgccaccctcagtaaagactaacttgccctttcccccaactcccctcccagaagtagctcactctcctctgcctgccacacatcggggggtcagggaaagctccccctccctgaggagctggtgttccctaggccaggggccagtccctgcagagattaggagctgggaaatcccctcctcccatcccgcacgtccacgcgtgccagaccctgtgctgtgggcttttcacacacagcctcttagacgcttagcctgtgaggtgggtgctgttgtccttccttcccattttgtaactgagcaaacagcctgaaacagacaaaaatcaggtagttagcatgaggccaaagccactccctggtctatgctgttctgcggcctgagcctggggtggccaggtggggttgtgcagtgagggggggatggagaatagcccccaaaaatgctgccggaatggtaaagggcctagcctgcaaagctagtaacttgagctttattttgtggcactggcggtttttccagtcattgtaatgatacgatcagatttgcgctgtcttcaggttaccatggtaaccatatttccacccaccaagggtggattagagaaggcaaaactagggcagagaagccagggagtgttgagaaggtctgaacccaggcagtgggcagctgggccccacgatggatggggttaggatctagaggcagcagcagggtgtgaagagggcggaaggttccggaagggtgatggtggtgctcgtctctaaggctgggtctgtgggcttgtgagacacatccaggggcccatagtgaaacctgagtggtatttagtgcaggcagggtggcaggcaggctgggggcctctcagaagcgtggagctggcagagagagacctgcccggggcatcggaggaaagggcgactgtgcaggaacagagtagacgaggtgggggaacctttgggtaagaagagctgagtcaggagcattgaggcagcggttttcaaacctcagaagcaacagcagggccgggcgcggtggctcagcctgtaatcccaggactttgggaggctgaggcgggtagatcacctgaggtcgggagttcgaaaccagcctggccaacatggtgagaccctgtctccaccaaaaaatacaaaaattagccaggcatggtggcggacgcctgtaatcccagctactcgggagcttgaggcaggagaatcgcttgaacctgagacgcagaggttgcaatgagctgagatcacaccactgcactccagcctgggtgacagagcaagactctgtctcaaaaaaaaaaaaaaagccagacacagtggctcattgcctgtaatcccagcacttcgggaggccaaggcaggaggattgcttgaagccaggagaccagcctgggcaacatagtgagaccctgtctctacaaaaaatgaaaacattgagccagtgttgtggcacacatctgtagtctcaggtactcgggaggctgaggagggaggatcgcttgagcccaggaagtcaaagctgcagtaagctgtgatcacaccactgcactctagcctgcgagacagaatgagaccttgtctttcaaaaaaaaattctagaattgttcttgaatagcagtggttaacgttttttaaaagctttggaaggtagtgaactccccgtcactggaggcatttaagcagaggttgagctgccactcactagagaggccgcttcctatagggcttgctgcaggagaggagaaagggacaagagagccctgccggttttggaggggctgtggggaggactaaaaccaaggaggggcccctctacccaccaaatccacttctctttgctgccccgccaccagctccccacagctcctccctgcgtatgggcccagccacccttctccagttcccttttgggcaaacacgagggctctccccggacccaggccagcttccgctccttttagttctcctctcaccctgggggtacagcagtccctgccagcttgaggggactgtgggaaggcagcgccccacctctccttccccagagcaggggctccagaccccagggatgtggcagagctgccaacttcctgtgtgactccagcaagtcaggcttgcctacctgggcctcagtttccctacttgtaaaatgagaagaattgcccacgccacgtctgcctcccctggggccaccctggagtgcatgaccaggtgagaaggagggatgggctgtcatgagtgggaggtggtgaggcagagagactggccaggatggagcggggacagcctgggaggcctggctttgcagcatggacagggcccttcaggcctggccctggtaagctcttctgctgacgtccccatagcggaggaacccgtacagccccactggtcggggccaagctcttggcgggctccagttttatctaggacatccccacatcgtctcctctgtaaacgttccactttcatctcagtttaaggaactatgtcaaattacatgctgctagctgggcacagtggctcacgcctgtaatcccagcactttgggaggccaaggcaggagggtcacttgcatccaggagttcgaaaccagcctgggaaacataaagagatcctgtctcgacaaaaaataaaaaattagccaggcatggtggcgtgtgcctatagtcccagctactcaggaggctgaggtgggaggatcccttgaccctgggagttggaggctgtagtgggctatgattttgtcattgtactccagcctgggcaacagagtgagaccttgtctcaaaaaaaaaaaattacatgccaccgaggaagatcattccacttacactcacctctcacccccaccagaattgtttgaggcccattttgagaagctcagctgtgggtgaaatgcctgccaggcacagggctgtgatcccttttcagggggtacaagtggagaaaagccagaagcctcaaatacagtagcaccacttgtcattgtcctctttgatctcctgctaagcctctctcttctgtggggtctcctgtcacccagtgggtgctatggtgggatgggcttcctggagaggatgacctgagccaggcctggatgctagtgtaggactgacctctgcagagggtactggggtggacatggggagggactgaagagcggcaggcacaggaacaggtccctttttgccttctcaggaagaagtaccatcacttctgagctgtgtgatcttggataagttaacctactatctctgatcttggataagttaacttgctatctctgatcttggataagttaacttgctacctgtgatcttggataagttaacttaccatctctgatctagataagtcaacttactatctctgatcttggataagttaacttgcttgtctctgattttagataagttaacttactgtctttgatcttggatgagttaactgtctttgggtctccatttctttgacgtgatacagaacaaggacatcctccatgatcctcccttctgctgcccaagacttgagagtcatttccttgtcgccaatcacacacaggcacacaccctctggcccctgcctccctctctcagccttccccaccccctctctacccttccaactctgtcttgagctcttgaaagctcaaaataaagccaccctttctcaagtttctaaagatatcacaattccagcgccagccacatgtttctccactgaattatctctgcttgtctttgttaattagggttcagtaatgatctcccttctgccttcccagggagagctggcatctgcggggcggggcttggaggcctttgtgggcagacgagacgccctactgccgggcccagagttggcccgacgcctcctttcttctgaagtggcagagtgggccatgaaatgatggcatgttggggagaccctgcccttttctggctggtggggacttagctggggtcattgcaacaccattctgccccccaaccttccacacgtcggggaagggaactccaaggtttttagcctttattagatgggcttccaggctgggtgcggttgcttacacttgtcatcccagcactgtgggaagttgaggcaggcggattgcttgagcaatcctggagttcgagaccagcctgggcaacatggcaaaatcccatcttgacaaaaaatgagccaggcatgagggcacatgcctgtagtcccagctactcaggaggttaaggcaagaggctcacttgagcccaggaggttgaggctgtggtgagccgtgatcgtgccactgcccaccagcctgggcaacagagcaagaccttctctcaaaaaaaaaaaaaacgattaaaatttaaaatagacaggggctttccggacccgaaagggagcagggttgggggcgcctttagagtcttttgcaacatcccagaaagcctcccagaaaccctttccccagcgaagaccacccaagctgacaagagcaaccagcacctttatttgggctggaatgagatcagcaccgaggggtcgccaggcaccttgtgcagaacagaagctgatgcgtgtgtctgagccatagaagtagagcaggggcagggtggtaaccatggctcagcacatgtggtttactgggtgtacccgatccttccagccttgtggggaggggtgtggggacaaaagaggagggaggtggaggttgggggccatgcaggcctagccctctaagaaccttcgtgtcatggagagggctcagcaccacccacagcagacttcgtgtggccccaacagaggccttgggggcgcaggtgcagtcactcatttgtgcacaggcccaggtgtctcactggggccagcactgtgccagatactggtcttttattattatttcattattctttttgtttgtttctgttttgttttgtctttgagacagagttgcgctcttattgcccaggctggagtgcagcagtgcaatctcagctcactgcaacctccgcctcccgggttcaagcaattctcctgccttagcctcctgagcatctgggattacaggcatgcaccaccacaccaagctaatttttttttttttttttttttttgtatttttagtagagactggatttcaccatgttggccaggctggtctcgaactcctgacctcaggtgatccacctgcctcgacctcccaaagtgccgggattactggtgtgagccactgagcccggcctcattattcttatttaatatttttgtaggacagcatcttgcttcattgcccaggctggtctagaactcctggcttcaagggatctcaccgccttggtttcccaaagtgctgggattacaggcgtgagccactacaccgggcctagatactggaatttttttttttttttttttttaaggcagggtctctctctgtcactcaggctggagtgcagtagcacgatcacggctcactgcatcctcgacctccctaagctcaagtgatcctcctgcctcagcctcccaagtagctgggactggaggcgtgcaccaccgtgccaggctaatttttgtatttttttgtagagacggggttttgccatgtttcccaggctggtctggaactcctgggctcaagtaatccacacacctctaacttccaaagtactgggattacagatgtgagccaccgtgcccggcctatgctggacttttaatcaacactgattaaaaaaaaaaaaaaacccggctgagtgcagtggttcacgtctgtaatcccagcacttcgggaggctgaggtgggcggatcacctaaggtcaggagtttgagaccagcctggctaacatggtgaaactccgtttctactaaaaatacaaaaaattagcccagcatcatgacacacacctataatcccagctacttgggaggctgaggcaggagaatcgcttgaacccgggaggtggaagttgcagtgagccgagattgcgccattgcgctccagcttgggcaacaagagcgaaactccgtctcaaaatacaaaaaaacaaaaaaacccagcctcacggagcctacatggtggggcggggggataaacagaaaatctgcaaagcgtaaaccatgggagcaattgtatttatttttaggagattgcaacattatttaggtgatgaccagaaggaggccttagttttaaaggcctgaaggggcagcagggaacagcattgcaggcagagagaacagcagctgcaaagcccctgaggtcacctgccaaggtatcagaggaaggtcaggggaagtgagagatgagatggagatggacagggaagatggtacatggccagataaggattttgacttttgctcagagtgagcttagagtcggtgcagttctgagcagagggtaacaggatccagcttgttttaacagaatccctctggttgctggcttgaggacagacaagggtggagagacataaggaggttgtaataatccaggcgacgcctgtggcggcagtggggtggtgagtcacccactcttaggtgagttggctgaagccaacagaatgtgctgatataagctgtgagaaaatgaggagctgactttgacttcagaggttcaggctgaacttggggaaggacggaggtgctgtgggtggagacagggaagatgcaggagaagctggtggggcaggaggtggcggatcaggcgtgttcaatctggggtctcatccagtcgaagttggaagcaagttggggctcaggggagcagtccaggcttgagatatgatttggggaatcatgaatttataactggtatttcaagccttaaaacaggccgggtccagtggctcacgccagcactctggaaggctgagacagaagggtcacttgagcccaggagttcgagacaagcctgggcaacatagcaagaccccatctctaaaaaaaaaaaaatagctgcacgtagtgcacacctgtggtcccagctactagggaggctgaggtgggaggatgacttgagctcaggaggtcaggctgcagtgagccacgattgtgccactgaactccagcgtgggaaacagagtgagaccctgtctcaaaaaaataaataaattacctaaacgtagtggcttcaaacaacacaaatttattgccttacagttttggagatcagaagtctgaaatgagtcttccaaggctaatgtcaaggtgtcaggggccaggtgcagtggctcacgactgtaatcctagcacttcgggaggctgaggcgggcgaatcacttgagatcaggagttcgagaccagcctggccaacgtggtaaaaccccatctctactaaaaatacaaaaattagccaggtgtggtggtgcgcacttgtaatcccagctactcgggaggctgaggcaagagaatcccttgaacccaggaggcggagtttgcagtgagctgagatcgtgccattgcactccagcctgggctacaagaaaaaaaaaaaaaaaagatgtcagcagggctgatccttctggaggctctaggggaaaatctatttccttgtcttttttttttttttttttttttttttttttttgagacagagtcttcaggctggagtgcagtggcgcgatctcagctcactgcaacctccgccttccaggttcaagcaattctcctgcctcagcttcctgagtagctgggattacaggcatatgccaacatgcccggctaatttttgtatttgtagtagagacagggtttcaccatgttgcccaggctggtctcaaactcctgacctcaagtgatctgcccactttggccttccaaagtgctgggattacaggtgtgagccactgagcacggccccctgttttaaggattaaatgaatgaatccatgcaaagatcaaagagcagtgcctggcacagaagagctcagattctctgagttaccaagtgcccgtgatgggttgggcattttttttatttgtttgtttgttttgagatggagtcttgctctgtcgcccaggctggagtgcagtggcgcaatctcggctcactgcaagctctgcctcctgagttcaagcaattctcctgcctcagcctcctgagtagctgtgactacaagcgtgcaccacctatcccagctaattttttgtatttttagtagagacgggatttcgccatgttggccagactagtcttgaactcctggcctcaagcgatccacccgcctcagcctcccaaagtggtgggattacaggcgtgagccaccgcgcccagctgggttcagtaattcttagcatattgccaattttccctgctttctctctcacacacacgcgcacacacataatttctctttctttttctctatttgaagtaaggtgcaaacatcttgactcttcgtgcctaaatgtttcaatgcacatctcctaagaaaacactgttatcttacatactcacaatagcatcatcgtacttatacaacttaataattccctgtcatctaatacatggtctttattcaaatttccaaaactgtcttctatgcctgttctcctccatgatataatcatttttcactggttgatttcttttttaattttttttttttttaaagacagtctccctcttgcccaggcaggagtgcagtggcacagtcatagcttactgcagcctggaccttctaggctcaaaccatccttaccacctcagcccctcgagtggctaggactacaagcacacgtgctaccatgcccagctcatattttattttttacttttgtagagataggctggagtgcagtgacactatcacatagctcactgtaacctccaactcctgggctcaaacaatcctcccgcatcagcctcccaagtagctgggactatagctgggtgccactgtaccagctacttttaaattttttgtagacagagtctctctatgttacccaaggctggtctccaactcctgccctcaagtgatcctcctgtctcggcctcccaaagtgctgagattataggtgtgagccaccacgccaggctcacgggttaattttttaaaaattattttattgcatgtaatgtttgcctaaacaaaaattatttcattttgcttataattttactttcttttttttgagacggagtctcgcactgtcgcccaggctggagtgaagtagtgtgatcttggctcactgcaacctccacctcccaggttcaagtgattctcctgcctcactcagccttccgagtagctgggactataggtgcccgccaccacgcccagctaattttttgtagagacggggtttcactgtgttagccaggatggtctccatctcctgacctcacgatccacccgcctcagcctcccaaaatgctgggattacaggcatgagccaccgcgcccagcctataattttacttttatgacaaaggcgtgttattgaatagagtctgggacttgctgttttccacttagctttggttgacataatgctgaagtgtgtagctgtagcttcttagttctcatggctctataatcttccattgagtggaattttaccatgatgcaattcctctctctcccctccttggggattgggctgcttccattgttttgctgttactaagaatgcaattaacacttatagccgggcacgatggctcatgcctgtaaacccagcactgtggcaggccacgacgggaggatcccttgagctcaggagtttgagaccagcctgggcaacatggcaagaccccatctctactaaaaatacaaaaaaattagccaggcatggtggcatgcttgctattcaagaggctgaggcgggaggatcgcttcagcccaggaggcagaggttgcagtgagctgagatcatgccactgcactccagcctgggcaacagagcgagatcctgtctcaaaaaaaaaaaaaaagcagaggaggagaagcatagatccgttaaaaagtttaaggcccagcctggtgactcgcccctgtaatcccaacactttgggaggctgaggcggaagaattgcttgaagccaggagtttgagatcaacctgggcaacatagcaagatcctgtctctacaaaaatgttaaaattagccagacgtggtggtatgcacctgtaggcccatgtactcaggagactgcggcaggaggatgaggtcaaggctgcagtgagctaggatcgcactactgcatgggtgacaaaatgagactacatctctaaaaaaaaattttttttgaaaaggaagaggaagaaggccaggcgcagtggctcatgcctgtaatcccagcactttgggagaccgaggcaggcggatcacctgaggtcaggagttcaagaccagcctgaccaacatgatgaaaccccgtctctactaaaaatacaaaaattagccaagcgtggtggctcgtgccggtagtctcagctacttaggaggctaaggcaggagaattgctggaacctgggaggcggaggttgcagtgagcccagatcacgccaccgcactccaccctgagcgacagagcaagactccatcttaagaaaaaaaaaaaaaaactacagttccctttgtaaaatgggtttttggtagagacagtgtcttgctgtcattccggctagagtccagtagctgggactacaggtgtgggccaccatgcccagctaatttttccatttttatagagatgggatcttgctatgttgcccaggctacatttttttttaaatcatgagtttttgaaggaaattggatagggcaggctgtggtaggggatggattggacaagcccctgcttgaatgcctgcatacagtggggaaaagggggatcaaaatgggtcaagccttaagggtccctcctgcacgcagtgtccaggtgcaggtctgggatggcagaagaaccacaggctcatgagcactggcctgggcacaggtccacaggtctctgccccgctgcagcttggccctcctctctccaggcctcagttatctcatccatgaaatggagctgatggaattcctgctaaacctgtgcacaggccctacaaggggttaaaagctgaacctgaatgtagcttttttattttttcgagaccgggtctcactctgtcacccaggctggaatgcagtggtgcaatcgctgcagccgtgaactctgcccgggcctggcagggagttggggctctgtgaagtggttcaggaggggagagaaggaccattatcccacgcttctgctacagatcgcagtctctcccctctaaaccgcccttgcccttcgctggctgcgtctccctgctgtgaatggtcgtaattaccaacgtgaggtcgtcagtctgagctgaagtcctctaactaggcggggagagtcagggctggccagggctcttgcactttgccccgagagagagccgtggagccagcccaggcaccacccgagccagttggtttaaaattgtgtacatagcatggctgtgattcagtgagcttggttgtcttttttttttcccccttggcaaatttcagttactccttgggctaacagacagcagactggtaaagataagatgagagttgcccagccagcgttaaagagagagaggagaccgaagaacagaatgagcaggaggcgggcaggaaaaatgtcaagggaaggcctgtccaccaaaggtgtcactgtccaggggcagtgggcaggaggtcgctgctgcggggatgggttctttcagcaggactttctgcacagcactgggggcagaaacatgaaggtgaaaccctacacacactgagtcctaactatgacatttccaaacagagaacactctgaaatgtttgcaactgtgggtgtctttacagccagcctgggttcaggggagctcaggcaggtcctcccgagaataggtttgctgacttggtgttccggacggtaaactaaacccccttttctggggggggttggggggagacggagttttgctcttgttgcccaggctggagtgcagtggcgccatctcggctcactgcaacctccgcctcccgggttcaagtgattctcctgcctcagcctcccaagtagctgggattacaggcacccgccactatgcccggctaatttttttttattagtagtagagatgaggtttcaccatgttggccaggctggtcttgaactcctgacctcagctgatccacccacattggcctctcaaagtgttgggatgaaaggcatgagccaccgcatgcccggcccattgctgctttacagatgaggacatcgagtggttcagggacttgcccagggtcgcgagctgattgcagagctgggatttgaacccaggcaatcagtcttgggtagaccactgggcttgtgaccctggccttgaagggcccggtattgctcctgcccctgcagtgtcctcagcagctctctgaggcgattctctgatccgtgtttttcccgtgagcagattagactcaaaggtgaccgggcatgctggagctgccctgccccacctgaggccgaggccaccactgcccacagcagtccttggggaactccctggtggcgacctggtggtggtggcaggagcctggctctgttgggaaagaggactcatgaccccacctgcagctctccgagatgctcagctggtctgggcacgatggctcacgcctgtatctcagcactttggaaggccaaggtgggtggattgcttgagcttaggagttgaagaccagcctgggcaacatagtgagaccttgtctctacaaataacacaaaaattagacagacatagtggcacacacctgtagcaccagctactcaggaggctgaggatggaggatggcttcagctcaggaggcggaggttacagtgagctgagattgctccactgcgctccagcctgggcaacagagccagaccatctcaactcaaaaaaataaataaataaataaagcttggctgggccatctgggttagcaaggatcttagcattctccctcagggctaaccagggtgcgtgggcgagctgtctcggttgcagcgggggccacgattcctgtcgggcaagactggtgccagcctgcacacctcagagcccaacaggaatatctgttcagatcgagacgttgccctttcccctgcagggcacggctagagcacagacacaaacccagtgtcaggtccccagacacggcaggggacaggggagttggtcttcacctgtggttcaggttccctcccagacagtgagtcacttatgtgcccaaggagctgcctctggtgcactcacagttcccagaagatctgggatgggactacaggtgtgcaccaccatgcccagcattttttctttttttttggtagaaacagggtttccctctgttgcccagactggtcttgaactcctggcctcaagcaatcctcccacttcagccttccaaagtgctgggatgacaggcatgagccactgtgcccagcctgtagtgctttttgatatgtgagattagatccagcaggcccagagtcccagttgaggaatgtggaaacaggctcagagaggttgagtgactttccatacaccacacagcattagggattagaatcaagattgccttccagtctgatgagccagggactttccccatacctggccctggggatcccccttttccccactgtatgcaggcattcaagcaggggcttgtccaatccagctcccaccagagcctcccctactccatttccttcaaaaactcacgatttaaaaaaatgtagcctgggcaacatagcaagatcccatctctacaaaagatggaaaaattagctgggtgtggtagcccacacctgtagtcccagctactgcactccagcctgaatgacagcaagaccctgtctctaccaaaaaaaaaaaaccacgtaattctctttactctaaattaaataaaaagaaagaggtaggaaaatgcaagaacagctacagagaaaaatcagtgttcttcctgagcttgatgttgactgagctagagaatcccacagacaaggtatattgtgggccttgcacagtgtctgcacgtagtatgtgccaagcttgttttttattttttaatttttgtttggttgtttgtttgaaacaggatctagctcagtcacccaggctggagtgcagtggggcaatcatggcttactgcaacattgaccttccaggctcaagcaatcctcccacctcagcctcccaagtatctgggattacaggcacacaccaccatgcccagctaatttttctttttttttctttttttttttttttttttgtggagacagggtcttgccatgttgcccaggctggttgcaaactcgtggcctcagtctcccaaattgctgggattacaggcgtgagccactacatccggccagttcttggtgttattgacaaaggcatttagccccactccacccctcccacactccagaggtggtcaggacgcctccccaaactgccagccccctcagccagcccggccccactttcctgacatgcacactcccaccacttctggtccaccgcctgggacctgtgccccatatagaattgccatagtatcctatcgactgccccgtagtgtcactcctggttagctgcagcctggtttagggttgcacttcttcccagaccaggcaagacttggaaggaagaggggaagtttcctgattggctaaagcatgttgagcacctgaaatcacaggatactacaagtttccttgtgtcttactcaccgctcacaactgccttggaggtccgtgtgatgagccccagcgtgcagatgagcccacatccttggagctttgggccccgtgtggtggtcacctcctctgggaagtcctccctgactcccagctgggtcaggatccctgctatagacccccgtgggccatgtaaaccaaaagtgcctgaaacaggtctcaatcaatttaaagatttattttgccatgggggaggacacagccaggaaaaagagactcaagctgcaatagggtctgtggcctgtgcttttttccagagttttgaggactttggtatttaaaggggaaagagggcctgggtacggtggctcacagcactttgggaggccaagccaggtggatcacctgaggtcaggagttcgagactggcctgggcagcataacaaaaccccatctctactaaaaatacaaaaaattagccaggtgtggtggcgggtacctgtaatcccagctactctggaggctgaggcacgagaatcactcgaacccggtaggcggaggttgcagtgagccaaaatcatgccactgcactccagcctggaaaacagggagactctgtctcgaaaaataaaaaaataaagggggaagaggaatagttaatgatgtatttatcctgtgctcagtaaatctgccttttacataagataaagtaaatagagtagaggaagtcatataggcatttgtcttgggtagacagagcaatgatttctattcttatctttgtcccctgcctgtgaagataagctgtgaatttacatggccagggtgagggaggccaccaggggagctaggtggccttctatcttgcagccatctgtttaggaacaaaaggctattgcgtgactcagttcccaagcttaacatttccctttggcatagtaagtttggggtcccatgttttttgtttgtttgggttttttgtgtgttgttgttgttttgagatgaagtctcgctcttgtcccccaggctggagtacgatggcgcgatcttggctctctgtaacctccgcctcccaggtttaagcgattctcctgcctccgcccccggagtagctgggattacaggcacctgccaccacgcctggctaaattttgtacttttagttgagacggggtttcaccacgttggacaggctggtctcgaacttctgagctcaggtgatccacccacctcggcctcccaaagtgctgggattacagatgtgagccaccgcgcccagcctgtttggtgttttttttttttttttttttgagacggagtcttgctctgtcgcctaggctggagtgcagtggcgcaatctcagctcactgcaacctccacctcccagttcaagggattctcctgcttcagcctcctgagtaactgggattacaggcatgcaccaccacgcccagctaattttttgtatttttagtagagacggggtttcaccatgttggccaggctggtctggaactcctgacctcaagtgatccacctgcctcggcctctgagagtgctgggattataggcgtgagtcaccgtgcccggtctgggcctcgtctttgagaggcctgctaagcttctttctgtcctgcaggtttcgtagagctctgactttgagtctcgctctgtcccgacacaggagaagacagaggtgtggcattgtgggctgagagcaacagattagaggaaactatcttaaagattaagccttctttctacagctactgtaggggagcctgggcatggtggttcacgtctgtaatcccagcactttgggaggccgaggtgggcgaatcacctgaggccaggagttggagaccagcctgagtaacatggtgaaaccccatctctactaaaaatacaaaaatcagccaggtgtgatggtgggtgcctgtaatcccagatactcgagaggctgaggcaggagaatcacttgaacccagcaggcagaggttgcagtgagccaagatcgcaccactgcactccagtccagcctgggtgacagagcaagactcttccaaaaaaaaaaagaaaaagaaagaaactgtagaggaatctgagacctcaggaaacccagggctcatggtagagtggaaagaccagggctttggggttgacacagagtactcctggtgcttagaggctgtgtgaccttgggcaagtttctttacctctctgagcctctgtgtctttggctgcagtgtctaggaaagcatctgcacacagtgatgtgtgtgatccaggccatcctttctctgttctgtgcatgcatggccatgcctgctgagaatcctgccaccaaagattcctcagtggcatggggacagatggaatgtgctgttgcttccctgcaggctctaggagctggtccttgggcccaggactccatcactgttgtctgcatggatttggacaagggtggccttgattcttcccacatcctagtcctgaaaggaaggcccgtgttgggtcacaggagaagacgagggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagatgtgcagagattgctgagtgtgggtgtggacggaccaggccagggacctgcagggtttgggaggacctgaggtggtgggtgttggagccctgggaaaaggaggaaccaggccaagcaggtgcccagcctctgtcctgtgggaagctccctgctctttggggcaacccccacatggggaacagggcctccattctggcagcttgcgcacgggaggccaagccacccagacggggtcagcagactctaagcagcacagagcaccacgccaggagatgcagttcccaaggcagcctcctaaacagaagtgagctcttcccagagttttcaagattaaaagagccagacacagtggctcacaactgtaatcccagcactttcggaggctgcggacaggaggatcgcttgagcttaggagttcgagaacagcctgtgcaacagagagagactctctctacaaaaaattttaaaaaaacttagtctggcatggtgattcatgcctggagccccagctacttgagaggctgagtggggaggattgcttgagccaaagagttcaaggctgcagtgagctatgatggcaccactgtactccaacctgggaaacagggtgagaccctgtctcaaaaaacaggagtcaggctgggcacagtggctcacgcctgtaatcccagcactttgggagaccgaggcaggcagatcacctgagctcaggagtttgagaccaccctggccaatatggcaaaaccccatctctactaaatatacaaaaattaaccggacgttgtggcaggcgcctgtagtcccagctctcaggaggctgacgcaggagaatggcttgaacctgggaggcagaggttgcagcgaaccgagaccgtgccactgcactccagcctgggcaacagagtgagactctgtcttggaaaaacaaaaagaaaaaaaaacaggagtcattttgctccaaagacccatcagtctgctctgccctgaatcatccggccctggctccctgcctgcgtctagctccaccccacaacatctcacccttaccgaacccgcctgccccaagaggcccagcccatgtgaccccacgcttctcagagaggagatttcctgttggacatgcaaaccacccttcctgcaatcccagccccgtcctcaaccctggcacaagcccacaggctgctgcagagctctgccccagaccccatctccagcccaacccccactcagccttacagcccagctcaggccccatctccagggctaactgactccagcagctcctctaggctacagggaggggagagcagagcacaccagggctcaagcagcagataggccgtgacggttacctgggcagtgagcagggagaatgcacggcccccacactcccagacacggtctgtttcccattcacagaccttggtcagcgagcggtcaggggatttccaacagcccagcacagtgacaccggcccctgtgcatggaccccactaggcccatcagtcatctcccctgtaccaccccaaagttcagccacttccaggacatgggatctttttctttttttcttttcttttcttttttttttttttttttgagacggagtttcgctcttgttgcccaggctggagtgcagtggcgcgatctcagctcactgcaacctccgcctcctgggttcaagcagttctcctgtctcaatctcttgagtagttgggattacaggtgcccgccaccacactcggctaatttttgtatttttagtagagacggggtttcgctatgttggccagggtggtctcaaactcctgacctctggtgatctgccaatctcagcctccctcagtgctggggttacaggcgtgagccaccgcacccagccaacacaagatctttcacgcttgagtgcctatgcatggctggtccttctgtcctggtggcttcccactgccactccgtccttcacaaactcctacctgcctttttggagcccattttttgtttgtttgtttgttttcatttttgtttgagacaggtctctgtctcccgggctggactgcagtgacgtgatctctgctcactgcaacctccaccttccaggctcaagtgattctcctacctcaccctcctgagtagctgggactacaggtgcccgccacatgcccagctaatctttttgtatttttagtacagacggggtttcaccatgttggccagaatggtctcgaactcctggcctcaagtaatctgcctgcctctgcctcccaaagtgctgggattataggcatgagccaccatgtcaggccttgagagcccattcaagcatccttctctcttgggggaggtctccccagacttgcccacagagggtgggcaccctcattcatgccccttgtctcctaagtgtgtcctgttgtactttagtgaccagatgacaccccctctggctgggagcccctcagggaagcagccctgcctcttctctttaggttgttttgtgcccaacacagggcctgtgctggggacactgataaaaaaatgtgggatgggctggccaccgtggctcacatctgtaattcctgaactttgggagggcaaagcaagaggatcacttgaggccagcaagaggatcacttcagcctgggaaacatagcgagactccatctgtacaaaaactttaaaaaattaggcatggtggcacacatctttattcccagctactcaggaggctgaggtgggaggatcacttgagcctgggagttggaggctgccgtgagctatctatgatccactgctgccttccagcctgggtgacagagcaagaccgtgtctcaaaaaaagaaaaatggatggagggacagaccaataactgatgctagaaaccagctgcagccaggcacagtggctcacacctgtaatcccagcactttgggaggctgaggcgggtggatcacctgagccaggagtttgagaccagcctgggcaacatggtgaaaccccatctctactaaaaatacaaaaattagctgggcatggtggcacgtgcctgtgatcccagctacttgggatggtgaggcaggagaattcgcttgaacccagaaggcagaggttgcagtgagctgagatcacgccactgcactccagcctgggcaacagagcgagactctgtctcaaaaggaaaaaaaaaaaaacagctatataggagtgggtcggccctgcagagaatgtaatgttttggcagatcagggacgcctggtgggagaagcagcaggtccagtggctaagctggtgccaactctcatgcccccttgtcttcctcttgtagatgaagatgacgccaacagactcggggagaaggtgatcctgcgggagcaggtgaaggaactcttcaacgagaaatacggtcagtgcctgtggtcagggtcagcacaccaagccctcctcccgggggtggtggggggcctccctctgcagccagcctggctttcaggagcccccagctggctgcctgctccctggtgacatggctgctctgcccatgacccacgttttgtgtatgttgattttttttttttaaacagggtctcactctgttgcccaagctggagtacagtggcgtatctccgctcactgcagccttcacctcctgggcttaggtgatcctcctgcctcagcctcccaagtagctgggactacaagcatgcgccaacactcccggctaatttttctatttttagtagagacaaggtttcactatgttgcccagactggtcttgatcttctgggttcaagcgatcctcctgccttggcctcccaaagtgccaggattacaggtgtgagccaccatgcccagcctgtaggtcttgatttttttttttttggagacagagtctcactctgtcgcccaggctggagtgcagtggcgggatctccactcactgcaagctccacctcctgggttcacgtcattctcctgcctcagcctcacgagtagctgggactacaggtgcccgccaccacgcccggctaatttttttgtatttttttagtagagacgaggttttaccgagttagccacgatggtctcgatctcctgacctcgtgatcctcctgcctcagcctcccaaagtgctgggattacaggcgtgagccactgcgccccaccagggtcttgatttttaaactctctgggtgtgatggctgctgggctagggcagcccagactccagccctttccctagagggctttgccattgacaggagacatctttcctcactgtgacttcctgtgccctctaggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccagtgagtgcccggcctctggaacggggaacagagagggcgaggccatggggagggtgaaagtcaaggtcacggtgggtcagctgggatccagacccaggtgtactgtaatagttcctgcctctttctcctgaaacatacaacttcaacagtcatggacatttacttatttttaaagatttttttttagatattacatttgttctctggggaaaaaacaaaacatgttttaattaaatttgactttttctgactatacaattctgatttttaacatttaaatataaatatgtttatttaaatatgaatatttattatatattttagaataattataattccatagtctcagtgattctcttttttttttttttttttttttgagacagagtcttgctctgtcacccagtctggagtgcagtggcacgatctcagctcactgcacgcttcacctcctgagttcaaccgattctcgtgcctcagcctcccaagtagctgggattacaggtgtgcaccatcacaccggctaatttttgtatttttttggtagagatggagtttcaccatgttggccaggctggtctcgaactcctgacctgaagtgatctgcccgcctcagcctcccaaagtgctgggattacaggcgtgagccactgcacccagcctgcattattactattataccgtatatccttacaatcttttgggttttggtttttgttttgagacagggtctcactctgttgcccaggcaggagtacagaggtatgatcatggcccagtgcagcctcaacagggtctcactgtattgcccaggctggtcttgaactcctaagctcaagtgatcctcccacctcggcctcccaaagtgctgaggttacaggtgtgagccaccacacccaaacctgggtggcccagttttttttttttaatacaatagattatttgattattttcagaataatacacacagcaacctggaaaatacaaaaagatagaagaaaagaagatagctgtaactctcctactgaaagtcaacactgtgatgcatttctttatatttttaaattattattttattaatatattattactttctttttgagatggactctcgttctgtcacacaggctggaatgcagtggtgtgatctcagctcactgcaacctccaccgcccaggttcaagcaattctcctgtctcagtctctcaagtagctggcactacaggcacacgctaccacacctggctaattttttttttgtatttttagtagagatggggtttcaccatattggtcaggctggtctcaaactcctgacctcaggtgatccacctacctcagcctcccaaagtgctgggattacaggcatgagtcaccacacccagccccccctttttttttgtattgcacaggctagtctcgaactcctgggctcaagccatcctcccatgtcggcctttcaaagtgctgggattatgggggtcagccaccacacctggcctgtggtgtatttctttctttcttttttttttttaagatggagttttgctcttgttactcaggctagagtgcaatggcacgatctcagctcactgcaacctccacctcccagattcaagcaattctcctgcctcaccctcccgagtagctgggattacaggcatgtgccaccaccccagctaattttgtatttttaatagagacagggtttctccacgttggtcaggctggtctcgaactcccgacctcaggtgatctgcccacctcagcctcctaaagtgctgggattacaagcttgagccaccgtacccggcccgccttcaatgttatattatgtgttttgtttcttcgtttttttgagatgaggtcttgctctgtcgccctggctggagtgcagtgccgtcatcttggctcactgtaacctctgcctcttggattcaagcaattcttgtgcctcagcctcccaaatagctgggatcacaggtgcccgccaccacacctggctaatttttgtatttttgtagagacaggttttcaccatgttggccaggctggtctggaactcctgaccttaagtgatccgcccaccttggcctcccaaagtactgggattacaaacatgagccactgtgcctggcctacatgtttttttaaaattacgataatatttgcgtgtgtcaaaaaaaaacaaattgttcaaaatcaaaaagtagaggtttcctttctcccacagacagttcaccccctgaagtaacaactagaaaatgcaggaaaacggccaggcgtggtggctcacgcctgtaatcccagcactttgggaggccgaggtgggtgaatcacctgaggtcaggagttcgagaccagcctgaccaatatggtgaaacctcatctctactaaaaaaaaaaaaaaaaaaaaaaagatacaaaaattgggccaggcacagtggctcacgcctgtaatcccagcactttgggaggccgaggctggcagatcacaaggtcaggagatcacaaccatcctggctaacatggtgaaaccccgtctccactaaaaatacaaaaaactagccgggcgtggcgcagggcacctgttgttccagctactcgagaggctgaggcaggagaatggcatgaacctgggaggcggagcttgcagtgagccaagatagtgtcactgcactccagcctggatgacagagcgagactccatctcaaaaaaaaaaaaaaaaaaaaaattagctaagtgtggtggcatgtgcctgtagtcccagctactcaggaggctaagacaggagaattgcttgaacccagaaggcagaggttgcagtgagccaagattgcaccactgcactccagcctgggcgacagagtaagattctgtctcaaaaaataaaaataggctgggcgtggtggctcgcgcttgtaatcccagcactttgggaggccaaggcgggcagttcacgaggtcaggagttcgagaccagcctggccaacatagtgaaatcccatctctactaaaaatacaaaaaattagccgggcatggtggtacacgcctgtaatcccagctactcgagagcctgaggcaggacaatcgcttgaacccaggaggtggaggttgcagtgagctgagaccatgccacagcacaccagcctggacaacagagcaagactccgtctcaaaaaaaaaaaattaattaataaaaataaaaattagccgggcatggtggtgtgcacctgccttcccagctactgggaaggctgaggcaggaggatcgattgagcccaggagttcgaggctgcagtgagctaggatggcaccaccgaactccagcctgggcaaaagagtgagactctgtctcaaaaataataattgataataatgctgtgatgaatatccacttgcataaatctgggcacacatttctgatcacttggtcagacaacatcctcgctttatagatgaggacagcagacccagaggaaagatttgccagcacaggcccatcatccagggcctatatgggggatgctctgttgggacgttgtgccccccatttttatttgggtcttaccaggctcccccagcagcagcagcagcatatctcagggagcaggtgagaaggaggggaaaacagccagacacctggattctccgggcgcgatggctcatgcctgtatcccagcactttgggaggtggaggcaggcagatcacctgaggtcaggagttcaagaccaacctggccaacatggtgaaaccccgtctctactaaaaatataaaacttagccgggcatggtggcgggcgcctgtagtcccagctactcgggaggctgagacaggagaatggcgtgaacccaggaggtggaggctgcagtgagctgaaattgcgccactgcacttcagcctgggcaaccgagtgagactccatctcaaaaaaataaaggaggggaaaacctcattttctaactgccacctcatttctttctttttcagaccctttgcagaaatctgcaatgatgccaaggtgccaggtgagtcagaggtgaagaagccacccttctgctccgtggggactagagactgttccatttgaaaaaaggtagacccgggcgcagtggctcatgcctgtaatcccagcactttgggaggccgaggcaggcagatcacttgaggtcaggagttcaagaccagcctgagcaacatggtgaaaccccgtctctactaaaaatgcaacaattagctgggcgtggtcgtgggcacctgtaatcccagctactcaggggactgaggcaggagaattgcgtgaacccgggaggcagaggttgcggtgaactgagatcgcgcccctgcactccagcctgggtgacagagcaagactccatctcgaaaaaaaaaaaaaaagaaagaaagaaaaaagcagagacaccaggagttggaggctgcaatgagttatgattgtaccactgcactccagcctgagcaacggagcgagaccctgtctctaaaaaaaaaaaatttcataaaaaaattttttaaaggcagaaatagatgtggtccaggtgggcatgcaatagatggctgaccaccttgagaaaaatatagcccctctccacgctggggcctccccagggagcctgaggtctccatgaacagagccaggtatccccaagaggcctccagaaacctgcaggtgccctgcagaggggaggccttgccatagcaccagtgagtgtatgaggtcagctggaaggacaagaggcaggctgggcctcagggaggatcatggagtcctcctgggtagcagaggggtagcacgtgaccaacagtggtgaggcaggcaggcattgcccgagactggccagaccccctctgttctgctggcatctgcagggtatacagaacctttcactaggcacctgggggccgcctggcatgatggttctgattaaggtgtatgatgggacttgggagaaagtactcccgggtgactatgatgtgcacctgattaagaaacactgattgggccaggcgcagaggctcacacctgtaatcccagcactttgggaggccgaggcaggcatatcacttgagatcaggagttcaagtccagactggccaacatggtgaaaccccatctcaactgaaaatagaaaaatcagggccgggcgcggtggctcacgcgtgtaatcccagcactttggaaggctgaggtgggtggatcacctgaggtcaagagttcgagaccagcctggtcaacatgctaaaccctgtctctactaaaaatacaaaaattagccaggcatggtggcacgtgcctgtaatcccagctacttgggggctgaggtaggaggatcgcttgaacctaggagacagaggttgcagtgagccaagattatgccactgcactccagcctgggcaacagagcaagactctgtctcaaaaaaaaaaaaaaaaagaaaaagaaaaaaaaaattagcctggcatggtggtgcacgcctgcagtcccagctacttgggagtctgaggtggaagaatcactttagtccaggaggcagaggttgcagtgagtcgagatcacaccactgcactccaggctgggtgacagagcaagactctgtctcgaaaagaaaaagaaaaagaaacactgattggccaggtgtggtggctcacgcctctaatcccagcaatttgggaggcctaagtgggaggactgcttgagtccaggagtttgaaaccaacctgggcaacgtagtgagatcttgtctctacaaaaagttttttctcccatccaagtactaaccaggcccgaccctgcttcagttctgagatcaggcaagatcgggtgcattcagggtggtatggctgtggaccaaaaaggtttttctaaaaattagccaggcatggtagtaggcacttgtagtcccaggaggctgaggctggaggatcacttgagcccaagagtttaaggctgcagtgagctatgattatgccatcctgcctggatgacagaatgagaccccatctcttttttttttttccgagacagcgtctcactctgtcgcccaggctggagtgcagtggtgtgatctcggctcactgcaacctccgactcccgggttcaagtgattctcctgcctcagtttcccaagtagctgggattacaggcgcctgccaccacgcccagctatttttttgtatttttagtagagacggggtttctccatattggccaggctggtctcgaactcctgacctcatgatctacctgcctcggccccccaaagtgctgggattacaggcgtaagccactgctaccggccttttttttttttttttttctttcaagacagagtctcactctgtcactcaggctggagtcaatcttgcgatcttggctcactgcaacctccgcctcctgagttcaagcaattctcatgccttagcctcccgagtagctgggacttcaggcatgcaccaccacacccagctaattttttgtatttttagtagaagtgaggtttcaccatgttggccgggctggtctcaaacacctgacctcaagtgatcttcccaccccagcatcccaaagtgctgggattacaggcgtgagctactgtgcctggccgagaccccgtctcctaagaaataaaaaagaagaagaaagaaaaaatactgatctaatcttaccccacctcattgtacagctgggaagctgaggcacagagatgcccagggacttgcccaggccacatagtgagtcagatgctgtgtagaccctgctctcaggaccacccatctgaaccatagaccaccgtgggccacacggcccagtatggctgctcaacagggacagtgataggattcagcaagtccacgccacaaccttacctgagacccaaggccctgactcctgtcaggaccaggttcacctggaactccacagcctggggtggcacagcccagctagaagccacctccttccatcaagagctagtcacaagcctgggccataaagtgagaccctccctccgtctctgcaaaaaaattaaaaattagccaggcgtggtggcgcgtacctgttgtcccagatagtcaagaggatgaggcaggaggagtgcttgaggccggaaggtggaggctgcagtgagctatgattgtgccactgcgctccagcctgggcgacagagtgagaccctgtttccaaaaaaaaaagagccagttaaaagggtcaggtctggcactgaacacacggatctggaggcgatttggtttactctcaggtcaaaggcagagaggaggccagtcgcggtggctcacgcctgtaatcccaacactttgggaggctgaggcagggaggcaggtggatcacctgaggtcaggagttcaagaccagcctggccaacatggtgaaaccttgtctctactaaaatccaaaaaaaaaaaaattagccgggggtggtggtgggcgcctgtaatcccagccgctcaggaggctgaggcaggagaattgcttgaacccaggaagcggcggttgcagtgagctgagatcacactactgtacttcagcctggggaacacagccaggctctgtctcaaaaaaaaacaaaacaaaacatggcagagacacagaaggccacatgaaagcctcaggaggatttgggacagatgcccagagggtggatactgtcacccacatccaccactccctccaatgtggccatctctcatggtgattcaaggatggccacagcccatggaccagtctgagacagagggtggggcagcctctgacttctttttcatgtggaatctcccacaaaaatccctctgactcatagcctgggctcctcctgcctccagggtcttctctttcgcagggtctctatgcctcaccacagacccccagtttctgacttctccaccagttgaagagacatttgccccatggacccagcctgcccttactctgtgtcattaagacccttccggtgggctgagtgcagtggctcacgcctgtaatcccagcactttgggaggctgaagcaggagaattctttgagcccaagagttcaagaccagactgggcaacatacagagaccccgtctctacaaaaaattagccaggcagggtggtgtgcacctgtagggaggctgaggcaggaggatcacttgagcttgggaggtggaggttgcagtgagccaagaccacaccactgcactccagcatgggtgacagagtgagaccttgtctcaaaaagacaataaaagcccttctttattgggctgggcgaggtttccatgcagtaatccatccaatcaggacgtgctgctcaaagtcttacatcttcacctcaagttaatccagcaaccacagaacacctgctgacccctcctccgtgctgaactaggtgctgggttcttttatgcatgcggtgttttttgagtctcacatcacactggtttccccatttgactcagagaggttcatcagttttcccagattcacacagtgataatagtaagtggccacagtgaaatttgaacttaggacttctgattctaaaccagagtttctttcactggggcactgcctgtctacttggacctgtgaactctccactcaggaccaccatacattagtgataaccatagcaatacaatttttttgtattttggtagagacagggtttcaaccttcaccatgttgcccaggctggtctcgaactcctgacctcagtcaatccacccaccttggtctcccaaagtgctgggattaccagtgtgagccactgcgcctggccccaggtcctctttataccctccctggacaacctagcctgcagttccagcctccccagaactcccagagcctctcctggggtcccacatcccctcacagccttaaagagcccaggaaagaatgtggcctccggagccacgcagacttggccttggagaaagtcctttaacagccctgccccttcgggtgctcgtgagtgaaatgtgaataggatcttggagggttgctgggaggatcccagcagacaatgtgcaaagcatttagcacagtgcccagcacccagaaaatactcagaaactgagaatgcgattaatattgttgccatgagccaggcacggtggctcatgcctgtaatctcagcatttagggaagctgaggcaggaggattgcttgaggttgggaattggagaccagcctgggcaacataatgatgcagaaatacaaaaagttagccaggcatggtggcgcgcacgtatagtcccagctactcgggaacctgaggtgggaggattgcttgagcccaggacttggaagctgcagtgagctacgattgcaccatggcactccagcctgggcaacagagtgagaccctaaaaaacaatataggccaggttcgatggctcatgcctataatcccagcactttgggaggccgaggtggatggatcacttgaggtcaggagttcaagagctgcctgcccaacacggtgaaaccccatctctactcaaaatacaaaaaaattagctggacgtggtggcagacacctataaccccagctacttgggaggctcaggcactagaatcgcttgaacccagaaggcaaaggttgcagtgagccaagatcgcgccactggactccaggctgggtgacagagcgagactccatctcaaaaaaccagaaagagagaggacctagggcctaaggggtgagcttgctggggaggaggagggacacatggggatgaggatacggtgttagcaaaggcaggcaggccagcaagagcaggaggccggggagagtgggccctcgggcttgctttgggaaggaggctggacatgtgggctctggacaggtgggccctgacccccaggggatcaggagcctgaaatcctgaaagggggactcgaaaccttaagacagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaagagtgttgcctttacttttacggtcactgtttcatgttctcttttggatcgtggccgcagctgtcactggggacagggtcaggaaacgcagctcaggtggcctgccaaggccctccttcttcatcacagcagaggtagtgtccaggaagaccccagagctctctgtgctcctgggagcacgtgacctcaagaagaaaagccacggaaggaaaatgtgccacggggccgggcgtggtggctcatgcctggaatcccagcactttgggatgtcgaggtgggtggattgcttgaggtcaggagttcgacctcattggcctgtaataccgatgctttgggaggccaaggtgggaggattgcttgagaccaggagtttgagatgagcctaggcaacatagtagaaccctttctctagaaaatgttaaatgtggcttacacctgtaatcccagcactctgggaggctgaggcgggtgaatcacctgaggtcaggagtttgagactagcctgggcaacataaggagaccccgtctgtacgaaaatgcaaaaatgaggccgggcatgatggctcatgcctgtaatcccagcactttgggaggccgaggcgggtggatcacctgaggtcaggagttcgagaccagcctggccaacatggtgaaaccccatctctactaaaaatgcaaaaattagccaggtgtggtggcgggaacctgtaatcccagctactcaggaggctgaggtaggagaatcacttgaacctgggaggcagaggttgcagtgagctgagaccacgccattgcactgcagctggggcaagaagaacaaaagtccgtctcaaaaaaacaaaacaaaagcacaaaaattagccaggcgtggtggtgcacacacctggagtccagctactcaggaggctgaggcaggaggaggattgcttgagtaaagatggttgaggctgtagtgagtcatgattacaccactgcactccagcctgggcgacaaagcaagaccctgtctcaaaaaaaaaaaaaagtgttaaatatggtaaatgtcagagagggaggggcccatcccagtgaagcactgtggctggatgggaggcttcttcaaaaaggggtttggagaccaggtgcggtggctcacgcctgtaatcccagcacattgagaggccaaggtgtgcagatcgcctgaagtcaggagttcgagaccagcccagccaacatgatgaaaccctatctctactaaaaatacaaaaaaattagccaggtgtggtggcgcgcaactgtaattccagctacttggaaggcagaggcaggagaattgcttggacccaggaggcagaggttgcagtgagccgagactgtaccattgcactccagcctgggcaacaagaatgaaactccatctcaaaaaaaaaggggggtggggtgggggcaggacaagttttcttttttcagaggcaagttctttctgtgtccccaggctggaatgcagtggcacgatcatatcttcctgcagcctcaaactcctgggctcaagtaatcctcctgcctcagcctccagagtagctgggactacaggtgtgagccaccacacccagctaattttttgatttttttgtagagatggggtcttgggttatgttgcccaggctggctgcaaattcctgggctcaagccatcctcctgccccagcctcccagagtgctgggattagaggcgtgagccaccatgcccagcctgggatgattttggatagagctctggatacctgacaagcagagtgatggggtcccagctgtgtctcagaaagaccactttaggggcaggtgggaagttgaaggaagggacaagactgaaggcagaaagacaagtcacaagagcgtggcaggcgtccaaggcctggcacccagtccctgcttattgggtgacacatatttactgagccctgcccttctggctggggaggccaagcagctgagtgtcctaattggggaggcagctgccagggagtacaaaacagagtaaggctggtgcggtggctcaggcctgtaatcccagtgctttgggaggccaaggtgggaggatcgcttgaggccaggagttcaagaccagcctagacaacatagtggaaccctttctctaaaaaatgttaattagctgggtatggtggtgtgtgcgtggtcccagctactctggaggctgaggcaggaggattgtttgagaccaagagtttgacactgcagtgagccgtgattgcaccactgctcttgagcatgggcaacagagcaagaccctgcctctgaaaaaacaaagcgggggggcctcacctagtgcagaaagtaggaagagtccttgaagctgaggcttgaagagcaagtgaggctttggggggacaaagagaggagggctgaggtaggtgggtgtttaagacgagagcgatgtgggcaaaaacggagctggacagggactgggtacgttccaggaataagaaggtgtcaccagagcagacacagggtggctggaggtgacatgtcagggcaggtgtggacttagtcagggttcccgaggacgctaagcaggtgtctcctacacatggtgccgggctgaagtggtgggcagaggcagacatccagcctgggttacacctgcccagccatgcactctgggacagagctgcgtactttttctcaccgacccacgtggaaggcctcataagccgggccaaggcaatttccagaaggcaaatgagacccacagcaggaagtacctgggggagagccaggcctaggtctgcattttggaagggtgcccctgcccgctgagagatgtcggagaaggaagggaggaatacatcagaagaccacctgggaggctccaacagaagatagcagtagaggccaggcgtagtggctcatgcctgtaatcccagcactttgggaggctgaggtgggtggatcacctgaggccaggagttcgagaccagcctggccaacatggtgaaaccctgtctctactaaaaatacaaaaattagctgggcatggtggtggacacctgtaatcccaactactctggaggctgaggcagaagaatctcttgaacccaagaggcagagattggcagtgagctgagatcgcaccactgcactccagcctgggcaacagagcgagactccgtctcaaaaaaagagagagagagagagatggcagtggtttgggccaggtggagaaaataactagagggtcagccagtcgggtggacgaggggttctggagagtcaggggtcagggtggtcccaggatctggctctaaccgtccacccagggcccagaatgaggcctgtggcttggagggactgagttctgaatcagctgaggaaatggtcaaaactttagtccagggcttctgccagtcctcagggtcagtcccatccatgcccagagctgggaggaaggccccatcccagccttccagaccacacttcctcctggaaagacgctagaaaccacgtgcctggcacagccaccccctctccgctggtgcaaaccccccacccagtcagctgccagcctcaccttcctccctcccacctcctagtggctcccagtgccaccaggcgcctccactccaccctcagcccctgccctgggccgggcccactttttccactccaggatgggggcaggagtgacctcctcaactggccaccacctccaagcagaaactgcctatgaagtcaagatgatctgaagagtccttgcagctgccaccttgccttcaaccctcacgtcctgtaacccatcccccacccccgatcctgtgactctggatttaaaatctgttttgctttccttgcacccagtgcaagcatctaggtgcggcgttccaggcgcctcgcagggggtcgggtccccagccttctgtcccaccgttccgtcccccgggcccggcccacctggcgccccctcccgcccgccaccgcccgctggcgcctgtcggtcgtctagacccgccgcccccgctccaccgctcagatccgcggccagagccggaagtggctcctgccccggccgggagcggcggggctgagactgtgcccgcgggcactgccatcccgtgcatggagagggcgcagagcccgggggtagggcgggccggggaacccgatcctccttcatccgcgcaaaggcccgcgaagctcccaatctgttctctttcaggctcactgtgcagatggcgtgcaattaagtgggtcggtgcagcaaaccctcgtatcctcccgcttccctaaaagcagaggattgagccgctgcactccagcctgggcaacacagcgagaccctatgtcttaaagaaagggcagaagtggggacccctctcccacccccttcccctgctccaagccaaagcgtttgaagcaagaggttgcctcctgtgagtttcccccagtccctggaggcctgggctttgggaggtgtgtccaggcagaggacagaggtcttgtgcaaagggccgcttttcccttcgcccaccctgcgcccgcccagccccttatccgatgggaaagccttactgactcttttcctcgcagaagcgcccagatgctgtttatgcaacctctccagaatctcagtgtactgtactttttaaaaagtgatttgattcaaagcactcattctttaattaaacttcatttagctgccatctgtctcggttcgaaatggcttcgtgttttgcaactctaaatgagaattgttattggatttgtaaacacatccccaaaaaaatcacaaaacactttcaaaagtaataaatgaaggacggttaggagctgcatcttaaacgttctaattgccggggaatgtattctggtgggtacacagtcattttatatacaaatcattgtacaaaaatctggtatcaatgaaaagatcaagattatagaaaatgctggaattatatctgactgaaaacagtaataaagcaataattggcgcagggacgggccacaaaacgagacggggcacctgctcccctcgggccaccctcccgcaccgcccaggtgcctggcttggtgcactcaggggagggttggtcctgagctctcctggctggtgcttccaacggccctgcgaggtacctctttttaaggaaccaaagcgttatttatcttcattattaattattactttttttttttctaaaagacagggtctcggccggtcgagatggctcacacctgtaatcccagcactttgggaggctgaggcgggcggatcacgaggtcaagagttcaagaccagcctggccaacatagtgaaaccccgtctctactaaaaaatacaaaaattagctgggcgtggtgacggatgcctgtaatcccagctactcgggaggctgaggcaggagaatcgcttgaaaccagaaggtggaggttgcagtgagtggagatcgcaccgctgcacacgccagcctgggcaacagagcaaaactccatctcaaaaaaaaaaaaaaggccgggtgcggtggctcacacctgtaatcccagcaccttgggaggccgaggtgggtggatcacaaggtcaggagatcaagaccatactggctagcatggtaaaaccccgtctctactaaaaaacatacaaaaaattagccgggcacctgtagtcccagctactcgggaggctgaggcaggagaatggtgtgaacccaggaggcggagcttgcagtgagctgagatcgtgccactgcactccagcctgggtgagagagcaatactccatctcaaaaaaaaaaaaaaaagagacaaggtctctttgtgtggcccaggctggaatgcagtggctcgatcatagctcactgaagcctggaactcctgggctcaagtgatccccccgcctcgcctcccaactggctgggacttcaggcacatgccaccatgcccagctaatttttcttattgtaaagacagaagttcactatgttgcccaggctggtcttaaactcctggcctcaagggatcctctcacttgggactcacaaaatgctgggattacaggtgtgagccattgcacttggccactgccctgtaatttttaaatttcatcatcttcctaaaactcatggctgggcatgatggtgggcacctgtagtaccagctactaaggagaccaaggtgggaggctcacctgagcccagggattcaaggctgcagtgagctataattgtgccactgtactccagcctgggcgacagagcaagaccctatctcaagtaaataaatatcattttattaatatcaagtatcattcgttcttttttttttttttttttttttttttgaggtggagtctattctgtcacccaggctggagtgcagtatcgggatcttggctcactgcaacctccgtctcccagggtcaagtgattctcctgcgtcagacccctaagcagctgggataacaggcttgcgccaccacgcctggctaatttttgtatttttagtagagacagtgtttcaccatgttggccaggctggtcttgaactcctgacctcaagtgatccacccgtctcagccatccaaagtgctgggattacaggcgtgagccactgcacccagcctacaataacttattttttctgtcattattttctgcttctctgcctgctttatgctttatgatgtcaaggactgtgtccattttatccaccgttctatcctagcgcctacgtccaggacatacaaggtactcactaaatgtgagcgagttggtgaaagaatataaactacaccggtctcctggaaaataagagggcccttaaatctttttttttttttttttttttgagacagggtctcactctgtcacccagctggagtgcagtggcgcgctcctagctcactgcagcctccaattcccagactgaagtgatcctccttccacagcctcccaaagcactagaattacaggcacatgccactgcacccagctgccttaactctttttttttttttttgagacggagtttcactcttgttgcccaggctggagtgcaatggtgcaatcttggctcacagcaacctccacctcccaggttcaagtgattctcccgcctcagcctcccgagtagctgggattacaggtatgtgccaccacgcccggctaattttgtattttttagtagagatggggtttctccatgttggtcaggctggtctcgaactcctgacctcaggtgatctgcctgcctcagcctcccaaagtgctgtgattacaggcaagagccaccacgcccggcctgccttaactctttaaatcctcctgctccagtgattccagtaacctccttcccccaacctcagccccagaatccatctgtaggggaactatgacttgtgcctccatcagtagaatttgctttctctatttctggtcataaattggaactccatagaaatcctatatttatttatttatttatttatttatttatttattttttgagacggtgtcttgctctatcacccaggctggagtacagtggcacaatctcagctcactgcaacctccacctcccaggttcaagcgattctcctgcctcagcctcccgagtagctgggattacaggcacccgccaccacgcccggctaatttttgtatttttagtagagacagtgtttcaccatgttggccaggctggtcttgaactcctgacctcaagggatccgcccacctcagcctcccaaagtgctgggattacaggcatgagccaccatgcccggcccattacgcaagaacttttatgtgctctgttaatcctcacagccctgcaaagtaaatattatttcttcatttcacaaatgaagaatctgaggttcagaaagatgaagggctgagtccagggttacacaactagaaaagatgaagcaccaggcttggcttcagaggagaccgccagactgactcaggcggctgagcactgccccaggcgaaccccgcaacttggggctggacagagcttctctttcggtttccctaatgtgtttgaaagagagtaacagaggtacatttgaaaagaaaaacagagggccgggcgcggtggctcacgcctgtaatcccagcactttgagaggccaaggctggcagatcatgaggtcaggagattgagaccatcctggctaacatggtgaaaccccgtctctactaaaaatacaaaaaattagccgggcgtggtggcaggcgcctgtagtcccagctactcgggaggctgaggcaggagaatggtgggaacccgggaggcggagcttgcagtgagctgagatcgtgccactgcactccagcctgggcgacagagcaagattccgtctcaaaaaaaaaaaaaaagaagaagaaaagaagaacagaaatgggtcccgacgagtcaggtttgctcagaccagacctcccctgcacaggaaagggacatcaggaaagatctcagctgcaaagaccagagaaatacgcgcacacgcacacacactcacacacacacattgtgtacacacacatacacacaggcacacacactttaattttttttttttagtagagacagggtctcactatgttgcaggctggtctcaaactccttgacttaagcgatcctctcgcctcagcctcccaaaatgctgggattacaggcatgaacctctgtgctcagcctgcttttaaaaaacaaaacaggccgggtgcggtggctcacgcctgtaatcccagcacttcgggagaccaaggcgggtggatcacgaggtcaggagatcgagaccatcctggctaacagggtgaaacccccgtctctactaaaaatacaaaaaataagctgggtgtggtggcgggcacctgtagtcccagctactcgggaggctgaggcaggagaatggcgtgaacccaggaggcagagcttgcagcgagccgagatcgcgccactgcactccagcctgggtgacagagcaagactccatttcaaaaaaataaaataaaataaaaataaataaataaataaataaacaaaacaaaactgtttttgtggggatttgtttgttcatatgtttgttgttttgagacagaggtctcgccttgttgcctaggctggagtgcagtagtgcaatctccactcactgcaacctccgcctcctgggttcaagggattctcctgtctcagcctcccgagtagctgaaactacaggcacccaccaccccacctggctaatttttctatttttagtagagagagcgtttaatcatgttagccaggctggtctcgaactcctgacctcaagtgatctgcctgcctcagcctctcaaagtgttgggattacaggcgggaaccactgcacctggcaaaaaagaaccgttaattagggctgggtgccgtggctcccacttgtaatctcagcacttcaggagcccaaggtgggaaggaggattccttgaggccagcagttcaagagcagtctgggcaatgtagccaaatcccatctctacaaaaaataaatgagccaggcgtggtggtgtgtgcctgtaatcccagctactcgggaggctgaagcaggaggatcacttgagcctgggaggtcgaggccgcagtaagccatgatcgcatcattgcattccagtctggatgacagagcaagactttgtctcaaaaacacataccaaaaaaaaaaaaaacctgtcaattagaggtgttgccacaatcccaataatagcacagtgcttgactcacagatattaagaagttggcacttgaaaaataaaacgaagcagtaagaagacattctcctccccagctctgacctgcccgttcctgcttaagcacagccattcaagcctccactgcctccaggaggaaacccacaggcgtgagtctggcatcggagacctggccccaatagctcacttcttccctgtcccccagggagccttgggttccagccaaaccaggccacctcccccactcaccagtctca

SEQ ID NO: 623 - DNA, 3446 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaaga

SEQ ID NO: 624 - protein, 981 aa, Homo sapiens
VLAAGRGRGAAGRSAWGSSKATMALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 625 - DNA, 44546 bp, Mus musculus
  misc_feature (1)...(44546): n = A,T,C or G
ctgttttgtttttgagacagggtttctctgtgtagccctgactgtcctgaaactcactctgtagaccaggctggcctcctactcacagagatctgcctgtctctgcctcctaagtgctgagattaaaggcgtgcgccaccattacactatctttaatgtctctaaacccagcctcattccttctgacttaccgtgtctgtcagcagtagtctagatggtgtagtgtccagtgcagagctgggaccctgcatggtctgccagcaccgtgctgaacacgttttcctatttactgctcttgactgtcctgtgagtttaaaaaaacaagctttagtgttccttttagaagatgaatcaagtgctgggcagtggtggtgcacgcctttagtcccagcactcaggaaacagaaataagctgatctgagtttgaggccagcctggtctacagagtgggttccaggacagccagaactatgcagagaaagccaaaaaccaaaacaattaacaaagaagctagagagaatagatgacttgtttatgtcatacggctagtgatgaaatggagtttcgaacccaggacaagctgactggaaccttaactgcccttaaccacttttctaaattacctctctgccaagacctgccacaattaccatataggaattgcttcttcaagtatcactctcattacccttgtgatagcaataagtaacatatattcatagtttgtacgtcggcttccctctcacctttcttctccctccctctccccttccctccttccctctccctccttcacctcttccctctcccctttcccttgtgcatgctcatctgttctgctgccccacccccttcccaagccctgctcccttgacctccccacgagtcccagccatcatgcagtttctcataggtagcaggtatgcataatgaagcacacattcttcagtttgattgtcacaatatcttttgaggtttcagcctagtgcaggacaaaggaagacacagctcctgggtggagttgtctatgaagtttaaacattccagaagtgaccaataaaaaaacctgtgatcattttgctcttaattatgccacacccttttgtggaaggaattctctctgagtcttctgcttccatccaggtcatagaactctgtatgtgggggttcggatgccgctggggaggcagagccatcggcaccaccgcactcatggccagaagcaccggagacgaggagggcggggcaaaggagccagccagggcgaggagggcttggaagccttggcccatggtaacaccctggagggaggacagaggcccattgtggggagaggtggtgaggcgtgggaaatgcaggaggagcatagccacgtaaagtcattgtctggggtttccaaaaggaaggagtgcttctaaggattaaaaatgccttcctgaaaatttacatttcagcaccccaatcaacagtgtcagaattccttcgctagagaattagccatttctttttactgaaatttgtcagatctctagaaaactataaacacaacaccacctgtttatgtgctcaggtattttgcctacatgcatgtctgtgtgccacgtgcgtgcctagtgcccttggaggccagaagagggcgccagatcccctgggactggagttacaggtgtgagctgccatgtgggcgcttggaactgaacccaggtctctagaagaatggccagtgcttttagccaccgagccttctctccagccctggtttctaggttctcatgggacttctgcgagtggtctcagttgacagctctgctcccttgtggccatgcttccacaggagagcctttcctctaagaaaaaggaatgtttaaacctgtattcagggcatcttctatatacccccaagctgctaggcagaatgctatttttgttctgatttggaggctggtacacatgcagacgtttctctctccggttggtttcctagacaccccgtctcagcgtgttcagttcattcttggcactgaggaagatgaagaacatgtgcctcatgagctcttcacagagctggacgagatctgtatgaaagagggggaagatgctgagtggaaggagacggccaggtgagtgtggggcagacacctgcctgctgcagcaggcctctcagcaggccaggcctgcttgcctcttgtctcttcttggtaacgtggttaccagtaagcctggctccagctctccgtggtgcagggtcaatgcatgcactgttgtggacattttccgtggcagagttaaacaggccagttggcagtgagtcttccctgtttgtctccgtgggtttctgaagtcacacaaagcactgataaaaatgttgttgttttttgaatgtggtatcactgtgtcctaatgatgtagaattttaagaattatccttattatagacagttttataactaaagatttttaaggggctagagaacttggctcagtggttgggagcactgactgtacttctagaagacccaggtttgattcccagagcccacatggcatctcactgcctgacaccgtcatacggatacatgcagacaaaacaccaatgcacatacaataaaaataaatattaaaaaattttaaaacaaattaagcaaaagaaagtggcagtgtccttcaatcctactgtcccaaggataaaactaggaatgtatttgggtcttagacatatatgtgtttgtaattttatgtttgtctcagaataaaaacgggtgagatttgcactgtaccacagcttgcttttcccacttactctgtgtctgagcattagattgggagttagtgttcagcgtgacagttcaggttttgccctcttgcagaccccaccctctgtctctgacatctcatgttggcaatatttgcaggtggctgaagtttgaagaggatgtggaggacgggggagagcgctggagcaagccttacgtggccacgctctctctgcacagcctgtttgagctgaggagctgcctcatcaacggctctgtgcttctggacatgcgtgcaagtagcatagaggagatctcaggtatggggcaaacgatgggcagaggagttgggcgtaaactcggaagtatgagagccagcattctggctcacacccgtaacctgtcattaggaggctggagagcagaatgccagctttgaggtctgaactctacagtgatactttatctcaagcaaaacaaaacagaacgttgaagccagaaaggaagaaagttaaagggtcattgaggcggtgtttgccgtgccagctgggcaggcggccttagtgccatcccaggaaacggtgatggaaggaccaacttccggaagccgtgctctgacctccacgagctcaccatggcacttcctttcatcacatacacgcgcacacacgcacacagtagtggtaatggtgatagtaataataccttttaaaaagtaaagatttaaaagcacacactcttcctctagaagagatagaggaggtgagccatggcatcccgcacttcagcgtggcgtgcggggtggcccgtctggtgtgagcagatgttaagttaccatgtttggggagcagcattggaaagcacaagtgtctaggtgattctgcctctctgaggagggggacctggggaccgaggccagtcctgatggaatcctgtgtcgactcctttgaaaggtggtgcctgggtgtgccacccactgtggggaaagtgggattaaaaaaaaagttctctgtcagtgccctgttcacggctgccgaggcagcggaacctggggggattggaggccataaatgagcatcagagaggccatacagtttgtatgatgctgagggttaaagggcgtcacacgagtaaagtgtgtctcgccaagtctgagctgcacgtggcgccagctaagcctttgcaccgggcaggcaagccgcacgtagcaaaaatcgttttttgtttttttggggggttttttgtggaggcttataaacaaatagcaatagccaggtataatcgaagtgaactcagtgctgtccactacacctggcagggcgtggaagcacatccccacactgcgtttgaagaaactgaggtcacaggacatggttttttggagttttttttttttttttttttttttttttttccataagcactcagaagtctcctcacactgctccatccttgaactgtgttccaaaagggtcacaactgtctttcactgacttgtaactacatacgtgtctaagagcctgcgaagttcctaagaaagtgtgtgccgtgttttggatagaggaatccctgggaattagtgccctacagccctcaacaatgagacctcagccaagccttggcagggcagctgtaagaatgatggaggctgagttaatacgtcaggccatgggaagagaggaggcagagcgctgcctgcatggggcagtggcggaagggcactgtttccaatgcagctcgggaggtagaattgatggtaacaacctggtggcatccagatggcagtgtctgtgtgtaattggagctgccatgacacttgagagacagatctgaactgaaatgtgcccctaggtcttctaaaggtggttcaggttattgtggtcagcagtgggggtggggactccacctgtctgaagctggctcaggggtcataggttgggtgaaagaaaagtatcacccttggagactgagggccactcagcagtgtcacaaaaatcggacaacagccaccaaacctgtgttaccctcctaggactgctgggatacatctccatccgtgtggtggctcgtgcccgtgatcccagcatccagaggttaaggcaggtagatgaggttcaacactagcctgggcttgtagcaaagtcttgtctcaaaataaaaccagtgaaccaatcagtaagtttggaagtcagaaatctgaaatgagtttagtttgggctgcattcctcaaaggcccacagcaggaacgtttctccagcttccagcttccgggagctacaggtgcttttttgttttttgttttttcgagacagggtttctctgtgtagccctggctgtcctggaattcactctgtagaccaggctggcctcgaactcagaaatccgcctgcctctgcctcccaagtgctgggattaaaggcatgtgccaccacgcccggctacaggtcctttttgattgaggattttcttttctttttgggaattttaagagggaaaggaaaaataaaactagtagtagagggtggagcagcttgccgccacccactgctccttccccgagcacctgatgcgggtcctctgttcctgagtgttggttggactctctgcttttagacctgatcctggaccagcaggagctgctccgagacctgagcgacagcgtgcgggttaaagtgcgggaagccctgctgaagaagcaccaccaccagaacgagaggaggaggaacaacctcatccccatcgtccgctccttcgctgaggttggcaagaagcagtctgacccgcactccatggacagagatggtgagggggcctttgggggcgcttgcggtttgttttgttggtgctgctgctccgcactacatctctttggtgggtggtaagcagggtggcccgggactggtaccgtctcccccttgtgctctcagaaagggagcagctgtgaggagagtgcccagtgcccacactgatgctcatctggggcagaagaagcagcctttttcaattagcaaacgtcttggctcagacacagaatgctgtagcatagacaggcttctgtgcttgtgctcttggctctgccgtctgcagagtctgtggccctggacatctattacaacccttcacatgtcaagttaataaagaccatagcaggactgtccttcctttgttatgggatttccaggcattcacttaagtctaaagtctgatcccaggtgcaggtgggttgcaaactcttcagctgctaatggctacctccccgtggcttggcagagccttgtctgtattatattctagtctctgtgtttactaagttagagagtacagacctctttgggaacctgtttcttctgtaagctttctgtagaggtccacatgcacttctggctaaaggtcaccgcagctatagagaaatgagagagaggccttgactgctaaagaagatggagggagtagctaggcctcttgcttaccattaagtgcgtggggacaggtgtgaagggaccctgctccctggtgcagggtccgctcggcctctgctgtgtgggctgggctgtgtcagaggggaaagggcaagctcctagcggattctgcttgactttctcccgccagggcaaacggtgtctcctcagtcagctacaaaccttgaagtgaagaatggtgtgaactgtgagcacagccctgtggatctaagcaaggtgaggagatgtggcaagttggcctctctgtgcgatttcacagacgggtgctgcttctgtggacagggtgcccatcaccctaatcttcccccttcatacacccagcctggggaggctggctcctcagggatggccctgcagttccttctcatcttcaagttgtcaggacggtattctgcggctgcctcctgtcactcctaaagtctcagacgactcttgggggctgtgactcgtgcatctgacgaagcagtcaggtattagaaaaagaaaaataccgtgacccagagcttccgaggagcacgatgggacggaattcaggccagagttcttgcactaactttgattcttgaggtggctcagtggataaaggtgtttgctgcccgaggatctgagttccaccctgaaaccctcaccaagcaaggagagtacggactctcacagggtgttctctggcctccacatgtgtgctgctgctgcatgtgtggacacgcacgtgcacacacgctgacctacatgtatacatttctagtcaatgttccctccctggtcttagttgctttgtttgttttgtttgtttgttttgtttttaaacagtgggactgatgggttctgtgctgcctccactcagggcttttgtggaggtgaactagaacagtgagagacggttttaaccttgaacgactcgtgaagtggagctgtgaagaaggtgattggtgttgaagaccatggcccccaaatcacctgacggttcttgtgcgtttctaggtggatcttcacttcatgaaaaaaattcccacgggggcagaggcctccaatgtcctggtgggagaggtggatacgctggaccggcccatcgtggccttcgtgaggctctccccggctgtgctgctctctggcctgacggaagtgcccatcccaacgaggtaacgtggggataggctgagggcagcctactcaaagcagacttgtgtgagtgctggcgctggaaagtagttatccctaaagttagggtcagctgcatggagagacgcgtcaggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctatggtaactctaagaaatgtagccagttattgaataatgtctcataaatagctccaaatggtgtttggccataacaaggtgacatctagctacagggtagttctttccttgaaggcacagggacagtgtgttagcagggaaagagctttgctgtttggagaaggtaaaacgccagcctctgtccttgcttacagagctccttctttgtgtgttctggcaggtttttgtttatcttactgggcccagtgggaaaagggcagcagtaccatgagattggcaggtccatggccaccatcatgacggacgaggtacatgccgccgctgccctcctcattctctcgtgctcactctctcccagaaactgaatgcgttgttgggataaaatgatggttgtcacagtgtctgctgggagcagttcaaggaccgtttctgagagccaatgaagagtgaggcaagcccccgggaggtctttcttgctgttctatctctttgctttccagcttcttactgtgtagcccaggctggcctcgaacacccagtgctgggattgtaagcatttagcactatggccacttaactctccccttttcaaggaattaaagatgcagaaaatcaaagtagaatgtgtagactttgtgtttaatgtcacttgtgaaacctgagttaaccttcctgagactatggctaattaaatacattgatgtcatttgcataaggaaatacttctattccatggaaacaagacgagtctgcgtagggtcaggacatgcccttacatgtcacgtgtaagctgtggcttgctgtcccacaccgttgctctgtgctgtagagtttccctggtgcacgtctcagtgggcacaggcaagcgtgggctgtttgatctttgattctttcacagaagtgttcactagggagcccttctagattcaaacacactcccagaatctctgtgaatcttgcctctccagtggagattgtctcactctctagcccaggttggccctcagcttggcagtccccctcccctagcctctggagcgggtggctttacaggtgtacacctgcacaccgagcttgggttcctctgaaaactccacgttacttcactaagcgccaagttttatctcttagatacccatggcagggataaaaactgagaggctgtgtccctgctcattggagtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtgtgtgctaggctgaggctgggcattttacccacaggaaatttgctcttccgaggtgctcccctcccccgggcgctctgacctctagtttacaggagaattaactgaccttctagggcaagattttaaaggaggttacatcgaagcacactggaaactgcaatttaggtcagattctgttgggggagtcgtttggtttatataaatacatacatctctcccccccccccccgaagtcacctgtgtcaaatccacaaatctatttggaaatcacaaacattttaatgttgttctggcttttgtgttatcctgttgccaccaaggacaaagaggggctgactggactcattttatttccttttgtcaaaaggaaaaaaggaaaatgcccggtgttccaaacggaaacgtttgccacatagaaccagagccacatggggggcacagtgggccagaactggagcggactgggcggtaagttctgggacattgcgtcctgggtgccacgcaccggcagacacagctaaggaaagaggcgtcctctgtctctaacatcctgggtagaagtttattgaccatggttgacgttcacacgagaccatctactgtacattaacatgaatgtgtccaatatcatattcattctacttttttgaactatttgctaagttctgtctgttcccggtcctttctagatgttccctctgatgtaaactcagcacctctctccttccttgtctcctggcgttcttcttactctttgtctctgctttgatgctgtgtccttcggaaagccttctgatattctctgtggctgacgctgggcacttgtactgtagagatctttagcttcccatcacagtccacatcattcaacgttgttatcgtcgtctctcctgctggaccgttggctccaaagcctcaaagtccccactctgcctctaaaaaattatcctagcccacttaaaattatgtaaaagatgaatgtgagccttggacacagtgaaaatttctggagctctctggactgcacagtcccagaacacaccaccctgggtgtgtttttaattcttcacaccattagttgtgtagctttgaaggtagatgtgtctgtgtgtgtgtaccatgttgtggggacttgaggccaaacacacagcctttgggacagttatctatgctgggtgaggaagtatctggatatcccctggagtggaccctgaggaggagcaagaaggcagtgggaggcttttctgaccggctcagctggggcagagagagtgtggtgagcctttctgatgctgatacaggcagggtggactagcgggaaagcacctcagcagggccctctggaaaggggtttctgggatcccttatttgggatgcaaattcttgggaagagctatgaggaaagaatccagagctgctgtctcagtgacacccccctccacacacacacacacacacacacacacacacacatacgcacgcacgcacacacacacacgcacacacgcacacacacacacacacacacgcacgcacgcacgcacgcacgcacgcacacacacacacacacacacgcacgcacgcacgcacgcacgcacgcacgcacacacacacacacacacacacacacacacacatgctgtggtagttaaacggctttgtgctcctagcaggtcacgctccagtcaccctccagggccctctggattatcgaatgaaagacagacagacagacagactgacacacacacacctcagttaattttaatatgccttgactagctcaaaggctaggcagttcttatctttcccactgctagcaaacattcccctccggtccttcggagttaacatcttttcaaatctctatttcatctctgctgccccaaacacaattggggaagtggcccgtgtggcccgtcctttagacctggtctttcttctcccccagcatggcaatctctccctcctctcttctcttccagttccaaggcccccgcctcagtctccctgcccagccattggccgtatgtcagttgtcaatcaaatatagctcagggctgagtccctcagcgtttgggaatgccagcctttgggaaccgaattgaattgagacagcattagaactaatcccttacactcctccacatctccccaaacacacaggcttcaaacaggtttctgtcagaacgcaccaggcaaatggatggatggcctgttccgaaatcacgccagggacaggttctctaagccagagatccagagtgcagtggccatctacacagctaagtctttcttgcatcaagctcaaattcttatctctttgtgcctttctgcctccaaacacttgatcatcaaggacgattcaaagggggaaggaagcatcttcatctaattgatgtctgcgttagagctgggcttcactcatgaatgagatatgggctaactccaaagaaacaatcatagcagggtggtggtggtgcctgcctttggacccagcactgaggacacagaggcaggtggatgtctgtgagttccaggacagccagggcgacattttacagagaccttgtcttaaaaacaaaacaatacaaaaagaagtaatcaaagtccttccatgaagagtgagccggtgccctcttgtcttaggcaattaggtggcatcgcctgtgtcacatagctcctgtctgacattcacagactcgcctccatgaagaggctgagcactgtggtagcatcacaggagcctcagtgaggcaggtgtcagagattctttttcccaggataatattcctcagatgagggttgttggtaaagggtgacaggccttgtacaagacactgttgtaggtaggacccagaaacccttgaatactccccagactaatcactgccaccgcagaggtccagagagagaaagacagaatggtgctgtgttttaagtcagacctctggtccctcccccaggctgcctgagttgctttgccacacaggccgaggctgaggcaggtcctgaggtggggcttcctctctcctcttaagagcacagccagcctgtgacgttactggtgtaagtgcagggacagcgtcacaccagaggaaaacagtgaaggggcagtgaccccctcccagcccacctcagcctggggcttgtcttctgggctcttggagaagcagagaggggcagccatactgcctccagagcagagttagaggggatcccacatagtgacccaggtaaacaccggctctaccaacagagggagttacatgtggacccctgcgcctgtccgcgacaccaacgttttgccagttttgtttcacttatttcctctcagctgtttttatgttttctggatgactttaaaccaaatcctcgatattattttcctgtaactccgaggacataacaaacagttatcccagtctgtaatctgtaaggttagccactgccctttcagctatggagggctcagctcacactgagtttttgaagattgttaacatctttttggagtttatttgttgatgtgggttccactcagagtttgtggttggttattagttcccgcccctgttcctttctttttcattccttttcttctatgccaagatctggagtcagagctgtcttatagcttccctgtggtgaggctccattcttaagaaagggctcagctggcggcagtgctcctcctgggtgtgcatcccgctcttcattggcctctgtggaagaccctgaagcgctgctgtccaggctcctgattctccctcctgagtagccctggagcctcccctcctctcagcccatgctctcttaacacagtgacctcaagggtggccattctagagtgtgtgttgcatgctgctgctccactgtctaaactttgtcagtaacttgacatgctgctaggattaagttccaattcctcaaagccacttattgcctctgtgactcagtttctccaaccgtgtctgcaggttttgcaccttgaatgcagcacacggcttcatgctggggtgtccctctgtcttgtctggctgttgcccaggtcttcctttgagcccctgctgagatgcctgtccctggtctgtgtcaacatgcatcccctgccctcctgcacttgggtctctgagagcacgggctgtgtttgtcttgctcactgctacatctccagtggctggccaggcctggtggctggtcctaagtgtcttctactggtcaagtgcatgagtcaattgttatgcaaagactgaggcaggggggttgttcagagtgacagtttgcgcgtggagaggctttatgtctggagagccccaaaggacaggaacatctttagctgcttctcaggtcccacccaacagcttaatttgaagttgaagctaatacttgccttcttcttaatttttttgaatattgataagtgggtaatatgcaagcccaaattaactttttaaatgcttggtacatactcagttttgcaatatgttatatccttgattataacaaaacctctctgtgccaattccaaagagatatgtgcttggggtgaagttgaagctaaagtattacggagcacatttgaagtactttcaaatgtgtgctgctctgtgccctcacggaagagggactgcgttagaggcctgtctgcactgtctctgcaggctgtttgggggcttggtgctggatgtcaagcggaaggctccctggtactggagtgactaccgggatgctctcagcttacagtgtctggcctccttcctgttcctgtactgtgcctgcatgtcgcccgttatcaccttcgggggactgctgggagaagccactgaaggacgcatagtaagacctttgcatcatttctaatggtccaaaacaagatttaaatatcacgtagcacccaagttctttgggggaacattaccttgtcaaggctgggaagactggatcttctcctgcgtggttggagttgtgagttatgggggagcacggttctgcctggtgtatgtatcccttgtgtttagatatcacttcggtgcctggttgcctagttgagttgctcaccaccccaggaatggaaaatggatccactgataagaagtgagaatcagattcggtgaccgtgacagctcgtgtagtggtgggaactacatcattgtgctttttatacatctttgaataccgaattgagctgaacgatataacttagttaaggaatcatggtagatggtttggtacctgagttattaaagtggtgtctgtttgctggagtaccaggcactgtgtacccatcactcttgcttagaggaaatatgagcagatgactgtcaaggcacgatgcggctaagtcagtgtgctaaacaactcttctctgcagggctgtggactcttgttttttctcctcctcagagtgcgattgagtcgttgtttggagcgtccatgacagggattgcctactctctgtttgctgggcagcctctcaccatcctgggaagcacggggcccgtgctggtgtttgaaaagattttgttcaaattctgcaagtaagacattggttttcctgacagtatctgggcgtggctgctatgcggttgagaggaggggtgggcacccccatagctcctgtagctgcagatggcctttctctccagagcctgcaaagtgtctcctcgacattgctgaaagtcttacattaacatcagttttttaacttagatgtttttattttatgactgtgggcattttgcctgcctgcatgcatgcctgagcaccgtgtgtgtgatgcaatggacaccagaaggtggtgttggattccctgggactggagttacagatggttgtgagcccctatgagggtgctgggaataaaacccatgtcctctggaagagcagccagtgctcttaaccattgagccacttctccaactctttttatgttcaactaaggtctctgtgtagtttaggctgtcctggaactaactgtagcacaggctagccttgcattcacagttttcttactttggtctcctgacgctgggtggttgcacccctagggccagaccgactgcttgattttcttctttttcttttcttttcttttttttttttttttttggacaggagttttctctgtgtaccctgggctatcttggaactcactctgtaggtggcctcaaagtcacagagatcctcctgcctctgcctcctgaatgatggaattaaaagcatgtaccatcactgggctggctttttttaaaaaatattttttagatttatttattttatatatttgagtacactgtagctgtcttcagacacaccagaagggggcatcggatcccattgcagatggttgtgagccaccatgtgactgctgggaactgaactcaggacctctggaagagcagtcagtgctcttaaccactgagccatctctccagccctgactttttaattttgaagaaaaatatcttaactgatgcagattccctcctatttacattttaggacactccctcctcaatattcggtctgtgaatggtagtgaggcctagcgatgttgtaatttcaaagttttctttgaagatcctttcccactttgtattggaagcagaaacccacaggactggagtcgaccccatctccttgctgcgcgaccaggcgcgaccaccctgggcagtaatgttggaaatactgcacaggcgatgctttcctcctgttccattttctgtatctttaccctgtgaacgccctgtgaggctcttgcacacactgtccccgggctttactgaggagttcagtgtgtgccgtcttcagggacagcaggtctcaggctggagtggataagctgggagtgatgggccacactgccctgctgcttctgagccgtggtgtctttcagggactatgccctttcgtacctgtccctgcgggctctcatcgggctgtggactgccttcctgtgcatcgtcctggtggccacggatgccagctccctcgtctgctacattacccgcttcaccgaggaagcgtttgcctccctgatttgtatcatcttcatctatgaagccatagaaaagctgatccacctggcagagacctaccccatccacatgcacagccagctggaccacctgagcctctattagtaagcgcgctcgctctctgcctctccctgcctttcttttatttcatttacttagagaattaggagctttctccttcctcaggcgtgggaatcaagcaattcacaccgcagtgtgctacagggatttaagtatacaatgtatcttgatagtgttcaccccaattactttcccttgtatctccactgcgctggctgtccttctcttctggggtgtgtgtgtgtgtgtgtgtgtgtgtgtgtgtgtgtacatgtgcatgtacctatatacatacacgtgtgtgcatgtgtacagtggccactgtttggaggtcaaaggacaacttgagaggagttagttctcttctttcaccatgtgggccccagggattgcactcaggtcatctagcttggtggcaaatggctttatccagtgagccatctcactggccctcatcttagaagtccgtgcgttccacctacctgaccccaggaatcctgtcttaacctcatttctggcttgtctgtaggcctcacccacaagtggcatttttacgtggctctgaggcgagcctgaacacaggcattttaactgagtcatctcagcctttttacttgatgtttttgggacagggtatgtacgttgtttaagctgactttaaactgacttcaaatggtgcttctaccttcatctcccaagtacctgggacttcaggggcatagcagcatgctaagcttatttttaaattagcatatagtagttgaagatatttacggagtacaaatgtgatatttcaacacgtgcatatgatatgtaatgatcagatcagaataattggcatattttatggaatggatttttcgagtgcatgtgtgcatgtgtgcatggcacagtttatctgtggaggtcaggggataacctcaggcactggtctttgcccaccatcttgttcagcagaggctcacagttgtttgacactgtatgttcccagctagctgactctgtctccagctcgctcttcatcataggcgtgatgggtggcagatgtccacagcatccctaagcatctagagacttaaacttgggttctcatgcttgtatggccagcgctttgcacatggagccacccttcccagccctgggtggagtatttaaacactaagtatatttgatgcttctcgctctcaagagctgaaacttaattctgttatgaaaggcctggctgctaaatgtacaggtgaagctaaagtaggaatggctgtcagcctacggtgctgccggcgtgctgactgtacctcagcccttaggacccatctttgagaactgaagttatgagaacgaaagctcttaggctccagcctagtcgtggctgagaacacttggtagccagctggctgcttccctcagggccggcttcctctttccctagctgcaggtgtgtgctcccggagaatccaaacaaccacaccttacagtattggaaggaccacaacatcctggctgccgaagtgaactgggcaaacctgacagtcagcgtaagtctgggcgtggccggaggccctccgatgaccgatgaccgccccgtctaaggaggacttaggtagaggcggggcagcactctgccggaccctggcacttaagcttaagcggacgtagtggctcacctgtaatcctagcacttaggagaccaaggttagaaacctttaagtttgaggccatccagggctatacggtgaggcctgtctggggtctaaaatgggctactttgatcaaataaccagtaacaatgtgtgggcttgttactggttaactctgctaaatcatcttgatatacttatagatttccttgctgttttcacgctaaaattgctacattttatttattgatctctgtagcatccttggtgggagcagttagctgatgcacatttctgtcagatattcaaatattcaaagcatgaatatttaagttctaaggttctctctaataaaaatgacagcaacttctaagttctttccagagcctagggaggaatgtttgttccagagagttctaactttgtgtccaagtgtcttggttaggaccacacagtcttcttgacaaggacctgctagcgagggccgcagcctgtgtggtggtcaagtggataatgtgggcctgtgctccccagcaggggatggcagtgcggggtgaactcagaaggcagcagccggttgttatgtgtgcccgactcttgtcacccagagtgctttttgctccaggaatgccaggagatgcacggggagttcatgggatctgcctgcggtcaccacggaccctacacgcccgacgtgctcttttggtcctgcattctgttcttcgccaccttcatcgtctccagcaccttaaagacatttaagacaagccgctacttcccaaccagggtaggcagcatgcttatgctttgcctgtgtttggttcagctgtctgtcagaatcctttctctgccccacgctggggcaggcttctctagcactgggcagcttcttccacagctctgtcaggtgcaaggaggaggctttaaacctttgcggtttaaagggaccaggtaagttaaggcgctggaaagctctctagaggtaatgttggccttccagaatagtgctaagtttcatgtctcagatcctccagatccttgggaagtaaggccagagcaggcatgttgaaaacagtcagttggagagattatcttgcccagtctaaaggaccccagagcccctccccacccatggttgctaccgtagtttatgaacttcctggctgctgccccgcctgccgcctgccgcctgccgcgcctgccgcctgcctgcggctcggattctctccttgatgatctgaagcctcaagatgcatcgtgtgtgtcaagagcaaaggtctgttcaggcagagttagagcctgagtctgagcagctgtgtggccactgagtcattgcttctgtgcggtttctcacccagctacatgcgagtgagaaccagagtacatgagggtgcgggtgggggctctgtggattaaaacccaccttagacctccatgacctgcagagtcgttgagcctattagcgaagtttgcgacctgttttctgtcaggacaaatagctgtcaagtggctactagatgctctcactgttgctcaagcctgggcaagtgccacggggaacacaaagatctctgcagggccagcgagagggctcagtgggtgaagacgcttgctgccaagcctgatgacctgagttcagtccctgagacccacacggtagagagagaacaacttgctcaggttgtcctatgtgtgcacatgtacacagagtaagtaaatcaattctttaaaactaattcagaaatatcgtccagtggccatgaagggaaagtacagggacaggcagtcccaggtccatcagcccgggagtcagtgctgtagggattcagagcagagaaagagggaccatggcgttgtttcatggcacaggtatgaagcttcatggaatgcatggggcagtcagggatgatcagaactatggaggacacgctgcaaaccttaggcatcgaagcaaagtgatgttgcatgtgcgtgcacatgtgtgtgcgttgggacactgaggttacggcaggtgtcatttcctatcttttattaaagcaccctaagttctaacatggggcaggcctcttgggataggccttaaaatggataggaatacacacatgtacatgtacacttacacatatacacacatacatagtgcacacaccacattcatacacatgtaccatacacacacatgcacacacaccacatgtgcacacacactacacatgcaccacatatacaaaataaacactattgaaaaagtgaagcaggtactggggggcgaggggctgagtgtgaattttaagtaggtccataacagggtgtcagcagtgctggggagactctgtccaacgtagaggagtctcggctaaagattcttgaccacggcacagaaaaggatttccacaagccacagggaaacaaaattggtgagtgtctttaaagtatgtgacagagtcgcacagggaaaggacacagaagactctgaaagtcttctccagtgcagagtgagtctgtttttctgagtttccgtgctcatgaggcgtaacttacaacagggcttaaagttgaagcttaaaattaagcaaaacctgttagctctctgagagattgcttgtttcatcagtaaagtgcttgcacatggctgtgacagttaaaaaaaaaaaaagagcccaggtaaaaagtctgggtattatggcgcctactcgtgaatccgttctcaggaggtagagaccgatccaggtggttcctggcaggtgtggagactggtgggagtgagcagggctggcttcacagccatcagggggagggagcagacaccagcaggacagcaatgcaagcttggaggagctcacagggaggagagctttggggtttgaacaaggagacctctgggggttagtagaggaagatgtgattcaactcgggcttgtttttaatttattcatgtatttatatcccatatgccaccccctccctgtccttccatcacaggggtcctcccctctgcccctctccttcacctgtgacccttactcctgaagactgtttcaggagcactggagggcaaaggtgaagcgggtcacccagtgagagaaggcagtggcttgctgagtgtggggacatgctcaggttctggacacattcggaatatcagctgaggtccgtgtggatgctgggtgtgggaggacttgaacatgctgctgcagaggtttgggctagcacacagtaaaccttggctggtctcagaaatctgaacgtgggcctgggtaccccaaactgcactctttagagactggtctcggctacgttagactgtgtcagaggcttggttttcccgtattgtagcccttgtaatgtgggcattactttgagtatcctaaaataatcttgtttaaggattttcatgttagttcaggcgctaactttctgtgctgtgtttaactgctgcgattgttcgccacgccaggtccgctccatggtgagtgacttcgccgtgttcctcaccatcttcaccatggtggtccttgactttctgattggcgtcccgtcgccaaagcttcaggttcccaatgtgttcaaggtgagtggacctcggtgatcttcaagcctgagggtacactgatctcaagttgctctcggaggctcagaaggaaagggtaacatttgttgccatgaagagttttctgctaagctttaggagaacagaaagtgcctactgacttacagatgcggtggcgtggagaggcggtccgtggagggagtctggcagactggcaagccgtagaaatgatctcagacctcggaaggtcgggtttggagtcgagggctttcctgaaccatcaggagatttcttcagcactattttgtgtttgcctgtcaaattcttgataatccatagtagttacaaatcttacatacaaactgacatactgtccaacccctgggatcccaaatgtaattcagggcaagagttacaagtggaggggaccgaccggaaagctgagctcagctccacagaccctcactgggtggagaggccggggagcccacacatgctcagccacctcagaggactctggaataggacagtgtactgacatttttgacagttttggaggttttggtttggtttagtttttttgtttttgttttgtttttgtttttgttttgttttgttttgtttgtttgtttttggttttcgagacagggtttctctgtgtagccctggctgtcctgaaactcactctgtagcctaggctggcctcgaactcgtgatcctcctgcctctgcctccttcagcaaatcctaccggcatggtttctttaaaaaacacagaaacaatgataagaatgtgctttggggggctgtggctgctgcagcagccgacatgatttacctcgtgctctggcagaagagcggttttgtcagctgcataacagtttgtgctgttatgtgatgttttaattctgggaacttctcaaatcgtacatagtttcgagggctccgagaggccagtgggtggttgttggtcgtttagggaggttggtgaggtttgttagtagctgtggtcaaacaagaaacaaaaggaaaggaatgaggcccagggcctcctccgctgccttgctcccctctgtccttgctcctcccctatctcgtgttagagggtgaaactggggggacaaagggtgggaagaggaagaacccacaaaacaacaaggacagctacaggaagggctcagggcggcaggaagacaaagtgcgagcctttagacccaacacacaggaggcagaggcaggcagatcttggtgaatctgatgccagcctggtctatgtggcaggttcctggccagccacggctactccatggtgaggtattttgctatctttttcactatcttcacagtgattacatggacagactactggtattatttttttctattttgtctgtttaattctgttaaacttactaaaatgcaaaataggttaaacgcccttcatctatataacacagctcagagccccgggtcttagccccgtgtgaataaaaaacattcagctctctccctggtacctagctgactgcaggacaaagggatttctgtataaaaataggagatttggagcatccagtccttgggaaagtcgtgtgatatgcgagcttaagatgtgagttgatttctggaacctctgggaggcagggagagacaggcctgagagacgggaccttagaaaaactgtggcttctgaagcagaggacgctgcctcctgtctttctcctgaagcagccagtttgccgttccctcggccggtctgaaagcaggagtgctcccctctccatagccacgggtgggcagctccatgacccttcaggccctccacagtaggaaggaaatgtatttgcgtgcaccccatctacaagctcctctgtgctttaaaccacgtctcgactgcctctaatcccgacagcagtgtaaacggtgtcagactctgtagtgtttggagaacagtgacaacatctgtatgtgcctaacagaggcgtctcccccggaacctttagtctgcagtttgtggacttggctatgactacttataatattgttaatactttagtacattttgtgttggtctgagaatgttaactactacctagaatgctcgtagttcagaaacataagttctaaagcttttaaaatgattttaacctgttcagaatccaggacttggcaggattgttgagtttttgaacccaagtattgtaacccatgtatcaacaagatagaacagtctctcccatatttgctgagttttgggtcgttctgggtggtagatgttcatccttcagcgccgggtgtttttcctagagtgcactagggcggggtcaggagttgaagcaaatggcctataaagtcactgaggaaagagggtcccagatcagacaggtccctaagctttgggcctcctaaagcctccagttcctgggcccctgtttcaccactgatgagagtggctcatgggatagtctactctcagcccaagaaatctgagcctgtttgcctttcctctgtacatcagagacagactgcatggctttctgtgaggagtgtcgagggttatctgtgttatttagtctttggaaggcagtttttaaacaacagattagttgctaattacgttttacttgtcccaagactgagataaagttgctttctctgtactcagagaataaatggaagacagtgtcgaattaatgtgtattccacaagaagctcagagaggattcactgccaagggggatctggaaaaaaggtcggagatttccttaggggccattacagttcatgctttgttttgtgtttctaaagcctttccttcaaaggagaacaaaagggaaagtggaatagtgttaagtgtggtttggtttgtgctcgtcttcagagttaagatacagaaaccacgcttgttttctctcctagccaacaagggacgatcgaggatggtttattaatcccattggccccaatccctggtggactgtgatagccgcaattatcccagctctcctgtgcactatcctgatattcatggaccagcagatcaccgctgtcatcattaacaggaaggaacacaagctcaaggtgagcaggggctctgacctgggaggctgagatcgcagtcggttaattaatgttttatattaggataagcccatctgtaccaggagctatagagaagaataaagtctccgaagggcttttcattgcttgcccattaacagcaaaggttggttggaggtgagactggagtggagcatggcgctaagatgtgggaggagcttgcactcctgtcactctcctggcaagctgtaccgtggtggatgggcagcggccctgctgatccctaaatagctgcgattctgaatcaacagctatacagtttttcctcccaaggtctggcgtagggctgtgagcctgcttcccagaggcaggaattcttcctctaggtttatcctgacattcagaatggactctgagcttgcggctcactcagactgttagtgaggtgccgcgcgccttcatctccaaggcaaggacgagcggtggtgtccaggaacgcgacagaagcattcctctgtgctatctagaacggtcaggatgtggttcccttctgggttccttccagagaaggctggtttgggagattcacgcagagtaagctaagggcaaatggaaaaagactggatattggcatatataggacaagctaaagtttctgtttttcctctattccctccccctgggagggttgtaagaattctctggacaccctcctcctcatctccccactagctgtgagcctgaagcctttcgcttagtgttatatggcctactcccgccagctcactgagggtgactctctccccacagaaaggctgtggctaccacctggacctgctcatggtggccgtcatgctgggagtttgctccatcatgggcctgccttggtttgtggccgcgaccgtcctgtccattacccatgtgaacagcctcaagctggaatccgaatgctctgcccccggggagcagcccaagttcttgggcatccgggaacagagagtcacagggcttatgatcttcgtgctgatgggctgctcagtcttcatgacagctgtcttaaaggtattccttcactggtatgccaagcaaacatggggggggggtgttgtctctgccaggaatgcagtggctccaggatatatacacacacagatgcatgccctggaagaagttattcttgtagacagttaaatgtgcttaagaaaaggaacatggcagtgatagaatagaacacgtgatccaaaggaccacctggcctgcggccttgctgctttcctttctgtctctagctcctttatgctggggatccaccggggtcttctacttgtaaagcaggcagtgccaggctgagctctgccccagcccttctttcccaggggttttgtttttgagacgtcttactcggttctggctggctttgaacctttgccaaccatactgtctctacatcttgattgctaggatcataaatattgttctggtttgggtttggttttgtgataaagactatgaccaaaaggagcctggggaggaaagggttacttcaccatgtactttcagggaacaacaaacagtccatcctgaaggaaagtcagggcagggcctcagcagggcctggggcacctgctcagctaactttgttatccaaggcaggcccacctgcctgtggagggcgctgccctgggagctgggtgctcccacgttgatcaggacagtgctccacagacagttcttcactggagtgtcctctttccaggcgactcccaagttgggtcacattgataacgaagaatcagcagcacacttactgcccaacagtgctgcaaacccgtcaccaaacggaaatgtcactctagggtcagggcagcaaagtccagtgtggcctttcaaactctgagaggaagtgtgctgtccttagccacggatggaagcagactgaggggctaggcgcttgggacgcggtggggcagcaccaggctctgggttgggccctcagaattgtagcagcctggcagttggcgcatgtggatggaggtagggagatgagaagtttaaggacatcgctggaccttgtgtacacgacgagttcgaggacagcctggagaacaacagaaactgagctcagccttgagctgtgactctcgccccccacccccacccccctgctgtggaggcctgtttctccagctcacacttgcatgaagatttctctaagttgaacagatgtgacagaaaagccctgttcacatgccgtgtggacgctttaaaaagcgcagtgaacaacatgttctcaacccgtttcctctcctctgccctcaagtcttaggtcagaaggcatgaatttatttttagtctgtgtcaaaatacacaaagttcctggggatgtgatggctatagaaagatttaaattacatccgtgatgtctgtgtgcgtgtgtgtgtgtgcacgtgaccatgagcatgtgcacatgactaggaatgtgaccacaagtacatgcatgtgtatgcgtgtgcgtgtccccgatgtctactcataacctagggaggagacatgaggcctatgacttaccgtataggtaataacttcatttcagaacaaaatggttttaatgttaccagcgcatgctttctttccacaccagctgaaagagaggcagcagaaacaaagacaatgtttatgagactctccgtggctttgtttcatttttggaatctaacatttatatagatgggacatggtggtgttcacctttgtcccagcacttgggtggcagagacggacaggtgtccgtgagttcgagacaagcctggtctatatcgagttctaagcaagaccccgagtcgttattgctgcccttcagtgctgccgggatgccacagctcttgccttgtgcctttctccgcagtttatcccgatgccagtgctctacggagttttcctctacatgggagtctcttcgctacaaggaatccaggtatcgtgtggctcagcggcagccatgtctcttactcttgtgttcacttgtcctgaccagagaggcacagtgccccaagggaggcctagccagttcctgagaaattagttccccttcttgccttttggccaaggaatgtcttcagatatgaggtgcaaaatatggtcatgttgaaacaggagtattggctcccagaatggcttggcttgttgtcatagcgcaatcacttttaatcagtgtttttttcggtattaaactagggatgctttgccagattcctgtagacctgaacctgaaacattagtcagtaaccagagcagtaaactggggcatcgagatgcctctgcgggaaaggagcttactcccaagccggacgacctgagttccatccttggggacctgtggtggaagagaaccagctggaacaagtagtcctccgacctccacatgcatgccatggcgtggtggtgctggggtgtgcgcgcgcgagtgtgtgagatgggtgtggaaggcacgtacgcttcagcgtgcatgttgtggtcaaaggacaactttgtggagttgtttttctccttccacctttatgtggaccccaggatttgaactcggatcatcaggtttgtgcctcagcaagcttctattcctgagccatattgctggctccagcctgtcataagtcctctatctagaattttaagaggtctcatttgatcctgtcgacatacttatccatcacatacttcagagaacaagcaagagagttggggtttcaggacttgggggtttggggggaagggatttgttgaaacagtgtcttcttctgtagcttagtttgggttggaagtcactgtgtagcccaggctgtccttgccttagcctatctgtaactactgtatgtgtgaccactgctggatggaagcggttttgatagtaagcacaaagatgcagttggcttggggtcacttccctgggagcttgctctctgaagctgcagtgcaggagaggagaaagcagcctgtgcgtggagttatcaaaggtggtttcaccaagtcatgtgacttccactaactgccatgaccagactgcctgttgtttcgcaactctgttcccatttctctccagtggaacagtattggctgctgttgagcagtcggtaaactgctatgtctgggcttaaggaggcttccggcctgagaccacccagacaccaatgctagtccttccttccagttcttcgaccgtctgaagcttttcgggatgcctgcaaaacaccagccagacttcatctacctgcggcacgtgccgctgcgcaaggtgcacctgttcacgctagtgcagctcacctgcctcgtcctgctctgggtcatcaaggcgtcgccggccgccattgttttcccaatgatggtaaggtcaggctcctggtccccgaccacgcctctgcctctcgagtgctgagattaaaggtgtgcagccaggctgctaagtgtggctcttattattaaagattattaatgcagttcttgaggatgtggtaactgtaacagcacaggttttcctgtgtccaccatttttaagggtgggtcactgggatcagcacacggctgtgggatccccagcagcatccatttctagacctttatcctgcagaacaaactccagaccctgtgaactgccccttctccttctccctccctgcaagcacgtaggcaaccacagtccggcgttgtctctgtggctcccgttatcctgggtgcatcacacggcaccgggttattcccgttgcccacgttgtctcatgtgtcagaatttccttaagtttgaaaaatggatattctgctcatttatgttattgattaaatgtcagttcctggggacctgaccccatctctgacctccataggccccaggcatacacatagtacatacacagacatacatatgaaataaaacatatttttaaaagtatatggaaacagaaaaatgaataaaataatgtaatgcatgaataacgtaaaaagcctcagtgctgggtgccgagtgctaatgacgtgcagtaagcggctaccgttgtgatcctcacgagcccggtgttgcttggatgtcccaggctgctcagagaatcattttgctttcgttctgtgggggaggctcactctccagcctgcttccttctcctcaggtgctggccttggtcttcgtcaggaaagtcatggatctctgcttctccaagcgtgagctaagctggctggacgacctcatgcctgagagcaaaaagaagaagctggacgatgcgaagaagaaggaggaggaggtagagtctggtctggctcccgccttgtagttcagggtctctttagagggagggcaggctgggtgggaagggggcaggcgtgtctgggatcccgagggtcgcactgagggcttctttccttcgggaggatccgacttgtcgagagtataaaatccatcatttctgagagggttggttgtgcacctgttgcggatggtgctgtggctggcttcgtgcaaacacagcttgcacaggactttctgtccttcaccgccctcggcagttggcctggagcctatggcctgagtgtgcacagaaaggccatgcagcaagatgaaaaccccaggccaagaagaaagggctgggagtgtcccgaggcagctgctgcctgaagagcggccttccagctctctcagtactggcggggtttatgtcagctcgataaaatctagagtcatcagagagaaataagcctcagttgaggaaatgcctctaagagatctagctatagggcagtttctcaattgtggaagagggcccagcccattgtgggcggtgccttccctgggctgctggtactgggttctatgagcaagccatggggagcaaggcagtaagcagcatccatccctccatggcctctgcatcagccgctgcctccaggttcctgcccagtttaagctccttccttgacttccttcagtgatgaacagcagtgtggaagtgtaagccaaataaaccctttcctccccaacttgctttttgttcatggtgttttatcgccatgatagtctctctctctctctctttctcatacacacacacacacacacacacacacacacacacacacacacacggcctccttgtcgtcaggtagtcctaacgttcttttttggcaacactggcatgctcttgtgccccgtgttcctgtacctggtcgttggctctaaggatgccctcacatttgggttcttaccgtttctcagtgctgttccattctgttatttgaggccttgagcccatggaagggacctaattatatgagtgggaatgaaaactgcctgacaccttggtggtaaaaactaggcgggaagactcttggtttacttggtagaagatatagttgtaagccagggtgcagtaaagaaaccaccaaaatggtcactctgaagaggccagagccgagagaaaagggaaaccttgctgtaactcagagcaggtgcctgtggggagggaagcctgggcgctagcatccacaggtgtaccccctggaaacggcctcctcagggctgaggtgttcctggaaacgctgtctgtgggcttttagcaatccttgtatagtccagcttgagcttgttctagacacatgctctgtcctttggaatttggggagtaggagtttcctttggacctgatgatgcccccccttcttccaggaggccgagaagatgttggacattgggggtgacaagtttcccctggaaagcaggaagctgctaagtagtcctggcaagagcagcagcttcaggtaaagcgccaggtaccagccagcttgcgccagggttcctgcgagacactgccctgcggagcggtgcagccggccccacctccatccatccattccactgtgtaggaacgaacgcctgtggtgtgccctgctctgagagcctggtcccatgtcagggtgtactggagggggtgcctttgtccccgtccacttcctcctgttgcagttagctaatacaccagggtcacagcactgctaacacacggccagactccaggtgggatctctccacttctccaccccaagttgttgttttccactttactgagtccaagagtgtgagaagtgcatttccagtagttttcagctggtgggtttgagatgcctggacccaggcctgactctgggaacaggcaggaggtctctcccgtgtgggttacagcattttaattcagggagccaaggagaggctgacctcgaagcccaggcagtcctcgttctttaccaaggctgttgctcaccacaaagcacagggtctgagagccctgtatgtggttcagccctgacctcgatgtctgctgggaggctgcacacccagtctgaagaagcccagaggtgaggagagctagagtggagcccagcgggtcatggggagttagctgatgagttatgggactcaatgtagtttataccatggataaatcaggcaatcttttctgtggtctctgaggaggtgtccgtgggctgtgaggaacctttgaagtctctggcagtgaagcaggatcggctccttttcctgtgggtgcaggagtctctctgcatttcaggagaccgtcgggcctataggtggctctcgtgttttctgggaccaaggatcctggttggagtcccgacactgccactgtttgagtcttgatgggcactcagccctgaagacttcgggcttagcaccttcaaaatgaggattatgagcgatctcttttgctatgagtgctaagctaatagaccatgaaattcttttgtaaactataaatgggagagattcagttatgtaaacgtggatgtaaaagagcgccctccacatagcagcactggtgccagcatccctgggaagctcgccatgacctggggcatcggccagcctacagccttagcgcggctcaaaggctgccttgcctcttcagagctggacccctccatcctctggcctctctcccttctggtggggtggtgtcagggctgtgcatgccctcccttctgtgtttgaagttcactgcctgagctttgatttcagatgtgacccttctgagattaatatatcagatgaaatgcctaaaaccacggtctggaaggctctcagcataaattctggaaatacaaaagaaaaaaggtaaggagagctcttgtttgtctttcattttcttctgtcttttggaaattggcgatactgttgaaggtaaaatgtatgttgcttgtagaactgaatttgtctagtaagtaacagaactgttgctaaccttacagtaaggcaaataaaaataaaaagtttccagatatttggagacaggctgttctgagccgtccctcactccggtcccaagggcaggctgtaattattttgggatatgaatttgctttaccgtttgactcctttaatccacttggaggatctttctcaattcagaatttttgtctcttgttactgcaacaacaaaaactggaaagctgctaaaaacctggatcaatactgttaacactaataaacaatatgatagtattggcccagactttaacctacttagcttagattctgaaaagagagttttgttaaacatgacagttttcttattctgcaaagaaatttctctgtataataacagcatagatcagttataatcagattattaaagaaaattggaggtggctttgcctacattaaaggaatgcagtgcataagttactgattttggcccaaacactacttacatttaaatcatcagagaaatgaaggcaaaactccaatgtcttgatactgataacagtttttgttaaaaaacaagcaagtcaggaaccaggaaagctggcccgccctgcttttatctccgcacataaccgggcaggctgctgctcctggtgttcagctcagctgcaggatgggggtactatcaaggttgttccaggagcagagagctcctcggagtcgtgcccaccagcacatggtgtggcagcttcttcactgaatgggttaaaatagatctgagctgaacatgagtgaacacagaatcttgcttccctcagaggaaaatccaggcagctgtggggatgtataacacatgtggttatttttagttgagaattagtctacttgtaaatgaacttaaaatacagccagatccaagtagcatcttcggagtgctgagagaaagagcgcgcactttgtctcactgtgacgttgtttctcagccccttcaactgagagtctctgctgagtggaagatttggaccatgaggtgcctcggagaagttctgggttttaacaaaatggcgagtctctccggaaagaagccgagctgagtctggccccgttcttggtcatctcaaagccatgccacatggaagcattcagtcactcccggtgtgcgtttggaggacatccagctacccacataccagcagccaggcgccagtcgggtcatggtggggccgcctcccgctgcctcctttcctcttccttctctctcttcagagctgccatcattaaagagccagcttccattttcagacattttctctgatactctgctggcctgtaagccacacgagtccattctgtcacagaggattccctcttccgaacgatagcctggggtagtggcagaggcaggacaagggcaggctctccagcagcctgtgccttggtttcctttctgcctgggaaggggatgttggacaggcagacacagtagcaggtctgctgcctgagctccaccatccaggcatcaacagcaaccaccacagtgagctgcctctggcctggggtcatctgcatcacctccagaagcagtgggcataacgttgtgagtccttggaagatgcggggacagcatgagagcaggagtttagctgatgtcaggaaaggcctaggggaagccagcagcgctcggagtgtgagcatctttccctggaacgagagaaagaggagcctaacttgctatggaagcacttaggtttccaggcctggagatctgttccaggtctgtttttttaagtctaggaaagtcttgctgacagctgtttgtaggaaggaaggtggatcggggctgctgcggctgctctgtgtgaactgtttgacttgatgctgctacctctcgtggtgacattgttataacaccctggagagacccgagtgctcatggatgtcccttagctgccttagtcgggagaaccatcatcatccactcggtggacccaaaccgccatcagccatgtgacttcctaatcatgggtttcttttggttgacaagttctggctcaggtgtaaaagccacacgaagaaatgagctgtaagcggtggcatcactttggatacttagtttaaaagtatatgtgtgattttctatgttccaaaactatcatgagttttttggcccgagcaagtgtagacctccccttcctttgtgcccagactgtgactagtgagctgggacagtctctgtccagagaccacacacacacagtgagctctcttcctctcctggctgaagaggctctacatcattcgatcacagtttgctccccctcagactcgctgaaacatctagtccttctctgaaggtcttaggtgtcgggggccaccccgtgttgcccgttcctccctacctgtcaggaccactgccatattgatgcaagatatttgacaattgatacaggacagacacgagccacacagagccggtgtcttctgtagaatagtggtgggcactgctgttcagggcctgtgggatgaacgtgaccctgcttccgatcccagaatggcctctggaatgtgggtttgtctggtctttactcatgggagatgtgcgttccatctgagcagccaccctggcttgctctcaggtagcacatactgcaacaggtgggtttcctagaaatcagtggacattcaagtctctgttagccaaacagcccaagcatgtcacttgaggacagatttaataagcatagccttgcccaccttggattaggagccggcctgtcagtgggaaaggtttttgatgccttcctggccctcctcacacttctggaactcgagtcttttctcactgcttgcattctctgggaacacccctctcttcccggactggtttctcctctgtttttcctgccaccttctgtgtagggaaactgatgactgcttcaccctgccctggcctcagtgcacttgagagacataatggtgaggaccctgacgtgtgagggagccagtgacttgtcactgaaacttactcttcccacacgatgacacttgtgcagcctcctgtgagctatgccctgggctggagggtggaggctgctctcgcccgccctgagcaatgcacttgtggagcctcatgcccatgtttgcactggtcatctcttctatgacaagggtcgctctcagacacgtcttgaatgtggccagctaatgtcatgacttgctggtaatgtcagctggtggtgtgagtggagttggggggctgggactcaagaacacgttaattgaagccttggctctgagggaaaagatggagggttcctaagtggccagttgcttcccgatgaccatcagggaagggttgctgtagagaaaggtgaagagctggagagacggaatgtgcaagtgccaagtgtgtttggttgcataacacatgcaacttgggaagctttgtcaggaggctccggactttcccactcccagccccatgttgggtctccttaaccatgaaaacctgtcttcccgatagagggaaagtgaaccatctctctccaaaagacagttgcggtttctcattgtcggtgatggagcagacttttaaattactcactaatgttggatgaaaatgtggtattcactaagttcccagcctgcccagactctgcagagtctgtggtttatgatcgtccagaaaaggacagttcctaactccacttttccttgacctgctcagctcagcagacctgctccttagtggggaggcaggggttctccttgtatcctgtgtagtaggtgcagtgtctgtcctgcctctccacttgtcctgggttgtagtgagtagcagacacactgtctcctgtgtgtctcccaccactgggccgctcgatgtccctgaagatcttttgatgtaatttaatcgtatgggtgttttaccttcacacaggcctttgcaccacatgtcccccatgcttcaggagatcagaaggaatccgatcctcctggagctggagttacaaatagctgtgtgcttccatgtggatgctggggatttaattgaacctgggtgtagctggtctttgctactttgtgggttattttctcaccctttgctccctctcccagtttcactcccttgacactagataggacaaaaacgggggggggggggcgagagggagagggagagagagagagagatcaagagagacacccctgtatctaaattcctttcttctttgaacactacgaagaaaccacaaccaaccacacacaactcccaaacaaccaacaaccacccatcctgctttttgggagcctagcatttatagactttctgaaaagttcctagaattccaaaacttgacacaatgccagagactgtctgcagctggcaaaaccacacttctgctagagcactaggcaaatcatgtcagctgctgccgacactccaaagcagccccacatcccccacacctggggactaaaatgataacatattcttatatttgttttttaaagaaaccagaattccagagttctcaccacgattccccacttctgttttaagtcattaattgtgctgtgtatatcaggaaattataaacagacattttcaaggaactgagtgttcaggttagtgccaaggtgttgaggagacctctcctgctcggtcctaatctttatcagttttgatggtatccacagcttttcgtttcctgtggaagtataaacaattccccatccccaatgcaaaacttttctgttctaatattaacacatctttattctatattgtaaaaaattcagtttttcctctcggcccctgctccaggaatgaccactccaagactccttattattaaatgccttggccagaagccttgcctcatccatgactggctcgtaacctattcaacccattcaaactcttctatgtcatcctcatggttacttctcctcagtcccggcttgcttcatccttctcactacctcctccttgtctcactatctcccagaatcctctcttcctgccattgtcccacctcctatttcttgcttcagctcattggccattggtggtttttattgacaagagatgctaataagagattctacagtacataggctgatgtaattccacagttttttttctaaaacccagagtatctcaactgctgctgttcctttctcattaatattcagaaaatttaaagttagcagagagtaattgtctctttttttctctttgctttataagcatttcctttaggtaaaatgagatctttctacaactgcctgtcctgtaggattgcatgaatattaatctgagcactgcacagttgtagaagagcccttccccatagactgatgggtcggtcagagtccttccccatagactgatgggtcggtcagagcccttccccatagactgatgggtagatcagccacatcaggtcttagctttcctgttagaccttctggtcccacacatttcacccattgcacactttgttttatctgagataaatttccgattcctagaaactgtataaaccttccaaagtggccattctgaattccaagatttttttgtgaactgatagttacatcagcgcctgtatccacaaatttgtctacttcagtaccttttatgtgaaattttaatatttgcctctgatcattaacaactgtttgccggaacacatgcttttcagtcctttcagaccctcctgttctctctactggagcagctttgtctctgggacagggaaacagtagcagccgaacaagcctctatcacctgcattaatttgcatctctctccctctccctcacacacacacatgccataactttaatttctcctttgaaatcttcatgtatgattcctgggtgcacagtgaatccttggggaatcaatccatctattctcaagatcatcccactgtctctgcaggcaaaggagcacgaactctctcgaagttttggatatagagtaatgcttttctgtggccgagtctagagcagcactgcctgcagaggtgttagatctccagtgctgagtgcaggttttagtctgcgtgttatggcttgactggaacagctcacagtctttgcttggtggggagctaagctaggcccccaaggctgtttccttgaatatctcttttggatctgcattccggaatccagtggctgcctttgccaaagtgcatacacattgcaggaagcctacgagtcctgtttcagattcaggaaaaccattgcctctagaaatgactgattcactcttctgctgcaaagtactgtctttctcccagttaacgcactgggtgggtattttgaggtcagagatttttagctctagcttggcctgttctattagcgtggtacacattagaaccaatatcgatcacatcccttatccattctgccatagacgcttgctcgagcctttaacgtttcgataacttttttgcatttggttattcgccttttcaacaactaaggcctctatcaacacctgccttcatcttgatctggtacggcttccttcacagctgagactaatctttgtaatcagtgaaggcttctcagaagccctgtataatctttataaatgaggtggtctttttcctgggcccctcaaatttgtcccaagttttaaagccaccaagcaacattgttcagtagtaatattatgtgattgaacctgttcttgtatatcagagccctgcccttcacccagcaatggtggagctgatgggattcggctcagagagctgccgctggagctgctgcttgtggtgctaaggactagagaatgatgggaaaatcctacactgagtggctgaagcaaggcaagctccaacaactttgttttctccttcagctcgtttgtacccaaaagtggtcaccacaaaacacttttgaaaaacatgttaaaatcactacacaaactgaaattacaacaggattactgcttgcatatccttcttttggaactttgacctaactctacattcctcatctgtctttctctccacaagttcactgccaccccaaagcaataattctcttgtcatagactaacaaagcttaagcagaccaagtagagagtagtatgtttctcccagtgcttagatggtgacaatcttgtttgctaaggaacaggtcatctgtcttgcatcttgtttttgaagtcttggtcagctagactggctagtcctctctctctgttcttacatacacagtgaagtcccctgctcttcgttcatgaccttccttctcatggtgcacacagaaaccagtgccacacctctggatcacaagatcaaggaacttagacccaacctggaatgaatgtcttgtttgataattaacttgtccccagcctgtttttcttgctcctacaatcgcgcgcttgcaacgctgagggctcactggcgccctcacctgtgccagtctatgagaaagggccacactctgttctcgattcgaactttgaactttctatcaaatactcttaacttccccaaaattttaaattaaactaacttccccaaactactttaaattgggaattccataaaatcattaattcatgtaagcagcattatctcaggaatgttcatcttcaggttgatcttcaggaaacttgccccacagagtgggctaccacccagaagtggtcactccaggctacggaggcagtgagtgtctcactatgtcaagtacatgagggatatagcagtgacaaacatgagaaggcacagcagtagcaagaagcatccctgggacgaagcccctagggctggacatctccagggcacacccacccatcacagccaagcagagctgcaggctccagggcacacccacccatcacagccaagcagagctgcaggctccagggcacacccacccatcactgccaagcagagctgcaggctccagggcacacccacccatcactgccaagcagagctgcaggctccagggcacacccacccatcacagccaagcagagctgcaggctggctccaggaagctcacttgcccactgcagctccccctgcatggcgttcaccgtcccttggaggaaagaatcccactcggagctcctcactgtgccacagctaaggcggccgctgatgctcccaggagagggactggatggctatgttctgacgtgacaagttgagggactgagaatccttaagctcccatgctcacctgtattgatctccattcaccgtaaacagaaaaacacgtccagaggccaaatagaggcaaactttctactgtagataaaaatgactcttggtatctgcctccaacagccttggtttttcaaggcagggtctcactgtgtagagcaagctagccttgaccttgctgtaactttcttgcctcccagccgctgggtcaagcatgcacaaccatacctggctttgcccttggtctctcttaggcggactcagttcttcttcagtacctttttctttgtggccagaaaggagaattcgtgaagtaatgcggtttggagtgcatgagaggaatgccgtcttctcattcacaggcataaattgtcttaggttctgtgctcagtgggaatggattggtttgcgcgcgggggagcgggggggggggcccgaagagaagaggaacagcgtcccccactccagagctaacccaccctgaggatcagaggatagagttttccactaagcggggtttcctgagcaacagggaggccctccatccctcacacccacaaaccttttctaagcccagaagcagtcttgacgtggacatcgctttcagggtttatgggtgacttcagcgtgcatggtttcacttgtgcaacagtgcgaggcaccagcctgagtgtgcaacctctccttttgtgaaagaaaccaaaattcttcctgtgtctcctcctctctggtctctgtgtgttgattggttagaagtggctgatggtgtcccttggagagcagagcaaccttcccatggaaggggacactttgaggtgctggtgtgtctccctcattttctatgttcttctctctagtaggtctcaagtagagacagatatttttgttttagagattccaaagtctatatttttagtgtaagaaatgtaccctctccacacttcatgtcgtaaatagaactgggaataagatgtgcaattgtgatcaccctgtaacaatgtatggtagacatgaggccccggggcaggtgacttggtgtgtctctgagccctcctctctgcctgcccacacacatgtgtgctcagctctttgagtgacaaataaagcccatgttataaactgattgcttctgtgctggttttcccatctgagttcagattgtgtggagaagaatcgtgaacatgggcaaaacagggtgggtgtctgctgaggaagtgcagaaaggctcttagctccttcgaacctggctggaacctggctggcgcagtcctgagcagagtccctgctgagtcgtggcacaggctcagcagaaaagtaaagtgaccatttcgaagatactcctggactgtggagaccatttgccaatatccaagcactacccattgcctcaaatcacagatgttagaatctggcccttggaagctgcttctggaagagtcggggtgtacttgattactttaactcttaaacttcaccgttcaagggtcagcaactgagtaagaacagagctactgaggggatgaaagaaaagggtacgcgcagagccaggcaggcctcctgaccagaagcatcctgagcccagtggcccagggcggacattgagagaagcaagagagcgagcgagcgtcaggtgaactgggcctgccttgggctggttttctaacccctcagcagtgtgcgcatgccctctgcctcacagggagacagactgcgtctggttttgagtacaggggacgctgcacttgcaggatgcagccagctctgaagagcgagccatgcaaggctccggacactggtgctcccgagggcagggcagcatccttgccacgcccagggttaggagtctcttgataaaatgtccttgggaagcacctggctcacagtgtagtagtagctcacacaagacaagcgttcctggggagatggtcagtttctgtgctgtctcccctttttagcctcaccattccaagatggctcccgaaactctagtgtaagttaaattagccaagataactttcacgtgcaggagtggtggcaatgtctccctcttgccctctcttaccaccccctccatctttcatctaaatagtggggagagtctcagaagcagcctccataccctgagtcagacctgggtcacacacccatctcctgagatggaaaagaaggacagatggtcacggcccattaggcttcgtcctctggaacaggaactcacttccctggtcacaccctaacacccgtgcagaatcagagttctgagtaaaggctaagtgagcccagggggatgctgacccgcggagcctcctgcagacctggaccccctgaagagaacggcaggagctccctgtgccaaggtcaggttgcccccccccccccccgagattcctcttctcccaagatccactcgatgctccccctcaaacaaacagaagctccagagggtgcacggagagggagtgcacgggtggagcgcgcgcgcgcgcacaggtaccgtgtgcacgcacaggtgcggctctcctcagacactgcagatgcaggcaggcttgcaggcaggcgggcggggctgagcatcagctgctggagcgcctcacttgccaggcctcccctccagctagcacgttcccacccggttctagaacgctcccctgcacgtgagctcttgcccaggctctctcagcttcgccacctccagattcatccagcttcagcccccacagctcccggctttgccttctctgcgcttccaaaccctgatcctcaagcctgcagtgagtcctgctcgtcttcgtaggccacagtacagggagggccctgacaactcaggggccagggaagaggggagtactggggccgggaggggggggggagaagaagagtgtggtgaggcagtaaagtctaaagtccatggctacggggctggaaacttgcttcaacagttaggagcagtggctgctctccctggaacccacatggcagctcacagcgatctgtaactgcagtctcaggacatccgaagcctacccctgtcccccacaggcacacaagaggtgcacagacatacacccaagcacaac

SEQ ID NO: 626 - DNA, 2324 bp, Mus musculus
aggaaaaaaggaaaatgcccggtgttccaaacggaaacgtttgccacatagaaccagagccacatggggggcacagtgggccagaactggagcggactgggcggctgtttgggggcttggtgctggatgtcaagcggaaggctccctggtactggagtgactaccgggatgctctcagcttacagtgtctggcctccttcctgttcctgtactgtgcctgcatgtcgcccgttatcaccttcgggggactgctgggagaagccactgaaggacgcataagtgcgattgagtcgttgtttggagcgtccatgacagggattgcctactctctgtttgctgggcagcctctcaccatcctgggaagcacggggcccgtgctggtgtttgaaaagattttgttcaaattctgcaaggactatgccctttcgtacctgtccctgcgggctctcatcgggctgtggactgccttcctgtgcatcgtcctggtggccacggatgccagctccctcgtctgctacattacccgcttcaccgaggaagcgtttgcctccctgatttgtatcatcttcatctatgaagccatagaaaagctgatccacctggcagagacctaccccatccacatgcacagccagctggaccacctgagcctctattactgcaggtgtgtgctcccggagaatccaaacaaccacaccttacagtattggaaggaccacaacatcctggctgccgaagtgaactgggcaaacctgacagtcagcgaatgccaggagatgcacggggagttcatgggatctgcctgcggtcaccacggaccctacacgcccgacgtgctcttttggtcctgcattctgttcttcgccaccttcatcgtctccagcaccttaaagacatttaagacaagccgctacttcccaaccagggtccgctccatggtgagtgacttcgccgtgttcctcaccatcttcaccatggtggtccttgactttctgattggcgtcccgtcgccaaagcttcaggttcccaatgtgttcaagccaacaagggacgatcgaggatggtttattaatcccattggccccaatccctggtggactgtgatagccgcaattatcccagctctcctgtgcactatcctgatattcatggaccagcagatcaccgctgtcatcattaacaggaaggaacacaagctcaagaaaggctgtggctaccacctggacctgctcatggtggccgtcatgctgggagtttgctccatcatgggcctgccttggtttgtggccgcgaccgtcctgtccattacccatgtgaacagcctcaagctggaatccgaatgctctgcccccggggagcagcccaagttcttgggcatccgggaacagagagtcacagggcttatgatcttcgtgctgatgggctgctcagtcttcatgacagctgtcttaaagtttatcccgatgccagtgctctacggagttttcctctacatgggagtctcttcgctacaaggaatccagttcttcgaccgtctgaagcttttcgggatgcctgcaaaacaccagccagacttcatctacctgcggcacgtgccgctgcgcaaggtgcacctgttcacgctagtgcagctcacctgcctcgtcctgctctgggtcatcaaggcgtcgccggccgccattgttttcccaatgatggtgctggccttggtcttcgtcaggaaagtcatggatctctgcttctccaagcgtgagctaagctggctggacgacctcatgcctgagagcaaaaagaagaagctggacgatgcgaagaagaaggaggaggaggaggccgagaagatgttggacattgggggtgacaagtttcccctggaaagcaggaagctgctaagtagtcctggcaagagcagcagcttcagatgtgacccttctgagattaatatatcagatgaaatgcctaaaaccacggtctggaaggctctcagcataaattctggaaatacaaaagaaaaaagccccttcaactgagagtctctgctgagtggaagatttggaccatgaggtgcctcggagaagttctgggttttaacaaaatggcgagtctctccggaaagaagccgagctgagtctggccccgttcttggtcatctcaaagccatgccacatggaagcattcagtcactcccggtgtgcgtttggaggacatccagctacccacataccagcagccaggcgccagtcgggtcatggtggggccgcctcccgctgcctcctttcctcttccttctctctcttcagagctgccatcattaaagagccagc

SEQ ID NO: 627 - protein, 675 aa, Mus musculus
EKRKMPGVPNGNVCHIEPEPHGGHSGPELERTGRLFGGLVLDVKRKAPWYWSDYRDALSLQCLASFLFLYCACMSPVITFGGLLGEATEGRISAIESLFGASMTGIAYSLFAGQPLTILGSTGPVLVFEKILFKFCKDYALSYLSLRALIGLWTAFLCIVLVATDASSLVCYITRFTEEAFASLICIIFIYEAIEKLIHLAETYPIHMHSQLDHLSLYYCRCVLPENPNNHTLQYWKDHNILAAEVNWANLTVSECQEMHGEFMGSACGHHGPYTPDVLFWSCILFFATFIVSSTLKTFKTSRYFPTRVRSMVSDFAVFLTIFTMVVLDFLIGVPSPKLQVPNVFKPTRDDRGWFINPIGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFVLMGCSVFMTAVLKFIPMPVLYGVFLYMGVSSLQGIQFFDRLKLFGMPAKHQPDFIYLRHVPLRKVHLFTLVQLTCLVLLWVIKASPAAIVFPMMVLALVFVRKVMDLCFSKRELSWLDDLMPESKKKKLDDAKKKEEEEAEKMLDIGGDKFPLESRKLLSSPGKSSSFRCDPSEINISDEMPKTTVWKALSINSGNTKEKSPFN

SEQ ID NO: 628 - DNA, 92247 bp, Homo sapiens
  misc_feature (1)...(92247): n = A,T,C or G
tagcatctatggaaataatcatatggtttttggtccttcattctgttaatgtgatgtatattgatttgcatatgttcagccattcttgcatccctgcgataaatcccacttgattatgatgcagtatcttcttgatgtgctgttggacttggtttgattttgttgagggttttttgcctgtatattcatcaggaatattggcctgtagttttcttttttgttgttgttatatccttgtctattaggttggtgcaaaagtaattgtggtttttaccattggaaaaaaaaaaagtcaaataccgcaattacttttgcaccaacctaattttgatatcacagtaatgctggcctcatggaatgagttagagagaattccctgctctttgattttttggaatagtttgagaagaactgatgttagttcttcttaagtgtttgatagaattcagcaggaaagctatccagttctgggtttttctttgttgggagatattttattactgattcaatcctggtatctgttactgctctgttcaggtgttctgtgtcttcccggttcaatcttggtaggtggtaggtgttcaggaatttatccatttcctctaggttttccaattgtgagctttacttatgttttgtcttgctctgtcacaggctgacagaggtaaaataagctcttctcagaataatgtgtgttgattctttcttgtatgtccagtaaactttgttttatatctttgttgctatgttatttgtttactcagatatttattatatcttcattgtaatgtaaacctttattgttataaagtgcctatcttggacacaaatatggaaattacagacactggggactccaaaaggggagagagtgggagggaggcgagcattgaaaatttacctatcaggtacagtgttcaccagttgggtaatgggcctactagatgcccagtccccagcattacacaatataaccacataaaaaatatgcaaatgtacccccgaatctaaaataaaattaaatataataatatagtgcctatatttgtctagtttaataattttccccttgaaatcactattaccaaaaggtaagagtacgacctctactctcttccttttttttaaatttacttggtatacctttgctcattcttttatctttcaaactttctgagttaccttgctttagccatgattcataggctgggaataatctgtacctttggcattttgccagcttaggactagagctgtcctaattagtacccactggcctggggaatttgcctgtttgatggaggtcttttgtttttttttttttttttttttgagaatttgtgtttttgaaaatgtctctatttcactttcattctctcccaccttttctggccctttatttcccaacttttaattgtgaaaattttgaaacaaagagatgctaaaacataaggacaataggctgggcacggcggctcttgcctgtaatcccagcactttgggaggacgtgacaggcagattgcttgaagccaggagtttgagaccagcctggtcaacaaggtgaaaccccatctctactaaaaatacaaaaattatctgggtgtggtggcgtacgcttgtaatttcagctactcgggaggctgaggtacgagaatcacttgaacccaggaggcagatgttgtggtgagccaaaatagtgccgctgcactccagcctgagtgacagagtgagactctgtctcaaaacaaaacaaaacaaaacaaggacaatgaacatctgtaaagcttccacaattgttaacattttgtcatatttgctttatttctccttatatagctatctaggcatatctatctgtttctgtatctgtagtgctgtatcattcaaaagtaagttgtagacatcatggtactctaccttaacactgcagcatgcatctcctaagagtaagaactgctcatgcctataatcccagcacattgggaggccaaggtgggtggattgcttgagctcaggagttcaaaaccagcctgggtaacatggtgaaatcctgtctctacaaaaaatacaaaagttagctggccacgagtgtgcctgtagtgtcagctactcaggaggctgaggtgggaggatcacttgcatccaggagtttgaggcaagatcttatcaacttggacgacagagtgagaccccctgtctcaaaaaaaaaaagagaaagaattgtcttctacataaccacattaccatcatcacacatgaaaattaaccatggtgtaagtcttttcatttttttatatttgagacagggtctccctttgtcacccagtgcagtggcacgatcacagctcgctgcagcctcgacctcccttgctcaagtgaccctcctgcctcagccttctgagtagctgagactacaagtgtgcaacaccacggctggctagtttttgaattttttttttttttgagatggagtcttgctctgttgcccaggttggagtgcaatggcatgatcttggctcactggaacctctgcctcctgggttcaagcgattctcccacgtcagcctcccgagtagctgggattacaggcatgcgccaccatgcccagctaatttttgtattttttttttttttgagacgaagtctcacactgtcgcccaggctggtgtgcagtggggcgatctcggctcgctgcagcctccacctcccgggttcaagcgattctcctgcctcagcctcccgagtggctgggactacaggcatgcgccaccacacccagctaatttttgtatttttagtagagacggggtttcactatgttggccaggctggtctcgaactcctgacctcgtgatctgcccacctcagcctcccaaagtgctgggattacaggcgtgagccactgcacccggcctaatttttgtatttttagtagagacagggttttgccacgttggccaagctgatctctaactcctgacctcaggtgatctgcccgccttggcctcccaaagtgctgggattagaggcgtgagccaccatatctggctgtaagtctttttaaactgtgcattccattgctaaattccagactcctggcagtctggaattataagggtgcaagtggtttactggagacagtaatcctatcctgatcatgccctgtctcagaaagataagaacgagggaagagatcataatgggctacaagaatttgaagggctgtcatgtagaagagtgagcagactttgcctttggagttacagaggagagcatttggaatgaagagtgaaagtttcaaggaggcaaattgaacctggaatggggctgccagcctcattcgatggtgagtactctgtgactagagatatccagggaaaatcagatggctccttctctgggatggagtggaggggaattgtgttggataggaactggtctataggacatttaagtttcttccaagaattcttagggggcagggacaagttccggagagacccaaaacaatatacaagttatagtctaattataatggctctagtccattttgtctaccccaaacaaagctgattatccttacatgtgttttaagattgtattttttcctctgctatttgttggctaaccatctcatagctctggtttttggtaaatctagcaaatactctttcttatattttctgttggtttgtagaaagggctaaagaactctgccttctttaaggagggggccggccctttcaatttggtaaaatgttagagatagaaaaaagataagtgaaataaattcgcattctatctctattcctttttgccccagtcctaatgtctgactgggtatcttttttaaaatatatatataactgcaaaataaaaggcctcaggggaaatatcactggaagtaagagtagcttggattgaatttatatctatgtcagataatgtgcttcagtaatagttattttcagaactccatgggagttttttcagtaaactaatgaatgggtgtcactgacaagctttccaaagcggaaattatgtgaaaactcccatcttatgggaaaggctaaacagaggagaaaccctgggcttttgctggtgggggaggggttaatgtcagttctaaagaagattcacattttcattgtttcattgaagccaattcaattttatgcaggaaatggctgaatggaattatatttctaggaagccatacaattaagtagaaagcattagtagttcttgacccagctctgctattaactgccctgggcaagtccctatacctagctacatttccacttcctagacttcaaatgttctatgtacatttaccaatccattgaagataaatgagatagcagtgattacaaatgtcgggtattgaatttgctgccaccttaaagctgtcccaggcctatgggctaaaagtgaaataagaacttccctacttagtataatacttagtataaaaagctcaggaggtcttatccctaaatagataagatgtggagtgaaatcactttaaatagacctgatttataagcagggttaggtttggttagacatggataagataaatgtattgactatgaatgtgttcagctcttgtatcaaggacttggcaagtagtccttggttaacacctgctgctttcaaatttctgaatggcttcccatctgaatctggaagtcctacagcttttctcctccagggcctattcttgacttgcggatgacaaccgttttttttacagccagcttttctgttttgttctgctccctctagaggtcccttcccctacctctgcctctgtccaaatatcttaatagtgatatcaaagaaggcagaagtcaggttttgccatttcacttgaattctgccccagagcctctctcagtttggagcaaagtgtaactgagtgtggtgtaacgaagttctgtggatgatgttgatgatgacgaatagtggggagcgattttcacagccaggagcttggctctcagcttttgtggcgcctcagactcttccctgggatgtgtagtgttccatgctggcagcatgctgtgaacaatgaaaattgtattctgtagtctctttcaatatgctgtgacttggcaagggctgaaagcaaatcatgcacctgcataaccttttcagcttgacaaagaatctctctcactccccctctcgcccctcccttccacaggaaatgctcccagacgacagcacgaacaagccctaattaagtctttcctcagatcccgacgtcttttcctccaaccacatcttgggtttagatgtgtaagtaagaggaaagtggagaaataaaaatcaggtataagacgcagctggaaattgggacctatttaattgcaagtaaagcctaagaccccggccctggtggctctttggacagttcacatagaacaagagacagagtaaactgatggaggagttaagatgcttttgatgaaaaaactggttgcaaattatttaagaacattttctcagactttttgcgtttcttatatttgtgtctgtctctgaatagaagaatctcaatgtctttcaggatatttaaggatcatatacgtaaggtgcctcatgcttccttgagaagtctatgaacacatccttacaattatatgcaaaattttgggctttgtttacttatctgaaaaagagaatccacagattttataacgtctccagggagttcaagacccaccgctttccccaaagtttaagaaccactggtattatagaagagaaagaataggtctaaaacaaaatctggaaggatggccacgtcaggaagccacaaagaaagagtggagcctatgaaagttagagaaggatgaaattcccaggcatccccatgggagacagtagggtggtgaagctcatgcactgtggaatcatttcatctgagctcacagtctagtgtctccatctattaactgtgctggctgtgtgccctggggaagttacctctccaagcctcagttttctaatctatacaatgggatgatagtgcctacctcagagttgttgcaaggatgaagtgaggctatccatgtagcatgcctctctgcctccctattggtatgatgtgtgtgtgtgtgtgtgcatgtgttgtctctgcctctacacatgtattttccattttcttgtccacattatgcctctttctgggctgactgaagattcaagaaggctctgaattctgttctgctgtttttttctgatttctttagaaaaataatcagtgtgaggtgatgtccttggctgaatacccccagctccactaggacttgtcttccagccaggctgagagccatgtgtttgagcttttccaaccagggtaaggagcagtagatgttaggagcctcgtgcttagagccaagtgaaccagctttttctgggaaggagagaccaaatcatccctgggaggatagagcctgtcttctgcagtgccccagatagcagcagccttagctgctgcctctgtggcctacttccttttgtaatttgcacaataggccagaagatggggctcttgaccctggagtcaagggccagaggctctgactttttccacatttgtactggagagaagtcagatccaccagtcctcccaggaatcaccactacttctcaattcctttccctaccctacctactccacttctgccatggctgggacttgccttccaggggagtgggggatgtgggcacatctttcctttggccaccatcctcggctcctgaattaccacgttgctagagtcagtctttctgacgccctgcctcaggtttccccctctaatccattctcccctaagggcagattttggagatggtacaatttttataggccaatacaacatagtggtcaagaactctagaatcagagagcttgttcttgactcgtctcctcaggtgaatctttccccacctcctcagagaagctctccctatcccatgccagttactcttgatcacataaccctttatttacttaacagtagtgattataactagcggttatcttgtttgatgacttgtttactttctcccacttgattgtaaggcttatgaggccaaggacactgtcttaattgctgttttcccaacacctaacatagggcacgatacataggttctcagcaaaagtgttttgaattaatagatgaatgatggaatcccagcttcatgactgcctgaccttgagtaagttgcttaacttcactgagcctcagttttttacctgtgaaatagaaaaagagtagagacattatgactattaaatgacacaatgcatttataccactaaacccaggttctggtgtgtggaagttttccctaaagccttcagcgtcctgctttttatcatttaagaaaaataaagtctgaatgaattagccagatctccacaatttgatcacggccttttattttatttattttttatttttttgagacagggtctcactctgtcacctcggctggagtggagtggtatactgaagcctctcctgggctcaggtgatcctcccacttcagcttcctgaggggctgggactgcaggtgcatgccaccatgcctggctaatttttttgtattttaaaaatagagatggaatttctacatgttggcccaagttggtcttgaactgttgggttcaagggatccatctgtcttggcctcccaaagtgctgggattacaagtgtgagccaccatgcccagcccacagcctttctctatcacaactattacctcccactgctcttctcaataactttctgctttggcccaaattgtggctaccctgaatgggccatgtgcattattattcttaagtctttgcctaagacttgagatgcttgctcttcttaccttgggtcagctaaatcttacccatgttttcagacttagctcgaatccatgtcctctgtgaaaccttcctgaagatcattttctcttctgaatttttgcaatcttcatggtttatataatattactcattaacatatatcctgtttccctgataagcctgttaagctcccttggagatatatattttagatttctctgcctctacagtgttacttgggcctgttcattagtaggtgttcaatacattttttattagattgaattaaaagcattcatatttactaagtactttctatgtgcctgggattggttgaggctctgttgagtatacagaagggcataagaaaaataatcattgctttcaaagaacttataatattttagtaagctaaagtcaacatataaagtacttaaataaccacagcatgacaactgctataagaaaggtatgaagtgccttgagaattctggggagggtgagatgacatctgttaggggtatcagggacagtagaataaagaaaggcttcttggaagagggtggcttttgagattaactttgaaggatggttaagattttgatggacaaaaatggggatgagggtaggatgtgaattccagattcaagatgacaggattagtaaagagattgatggagtgtgtggcaatgaacactaaaacgcagagactagacaggaggcttatacaggacatcagaaatacaattctgcttcagggatactgaagcccaaccttgtttccaatttcaggaccaacacaaaggatggtaagcaggggtggaaagttttaacatgtatcagactaccttccccaactgtagcttctttaggggctgagaattatttgcaacaattcttcccctgaccccaatttggacctacctgaagtctggtatgatagtgcatataaaacaaaaggccccatggccgggtgccatggctcacgcctgtaatcccagcaccttgggtggctgaggcgggcagatcacctgaggtcaggagttccagaccagcctggccaacatggtgaaaccccgtctctactacaaatacaaaaaaatcagccgggcgtggtggtggggacctgtaatcccagctactcaggaggctgaggcaggagaatcgcttgaactggataggcggaggttgcagtgatccaagaacacgccattgcactccagcctgggcaacaagagtgaaacttcgtctccaaaaaaaaaaaaaaaacaaaaaaaacaacaaaaaaaaaaacaaaaaaaacccaaaaggtacctttctttttcttgaggagagagggttgcttcgattttagccagcctctcttttcttataaatccaaatcaaatttaatgcattattcatgatattctaaccttgtgttaggtcagtagttctgttgctaaataatagtttgccttagatcatttcctggaaaagttcgaagcctttttgtggaattgcttcaacagtcatccttagctcaaccctgtccgtgtgttttgcttctgacttgagactcaagaagaagacctaagtcatagtgagactgtgagggagcctgacactgcctgccttcttcaatttaatgctctttaatctggccattagctcaaggaaaaacaattaattttagaaggccctctcccctcatccgcaattacctcctcctgcaatcgcgaaggatgtttgcccggaatttaaacatcatctcccaaggaatgaaatcagaataggcaaaaccgacactttcccagttttcaagggtcaggtgcagctgcaaatagaagcagagattttctagcaagcagttggaaggaccttcacgcccagaggcccctgaagggagggaggcggtttccaaggcaaccgggcccgggagcggttggctccccggctcctccccctccccgcggtagcccagggtaccgccggacagcgtcctcccgtgctccgcgccctgattggctgcgcaggcctctcgctgattggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcaggtagggccccgcctcccgcgcctcccgctcctccccggggcgcagcctcctcatcctctgcccaccctccttccttctgcccccgagcccaggcttcccaggccgctccctgagggcgaggggaggccagcccgggacaccagggggcgctccgggcggttggggaccaggccagggctgcgagagagtgaccttgggccgaacctgggatctggcccatctctgccgcatcccttgcgccgcccgcccaggagccctgacagccggcgggcggcgacctcttgttctcctcgcgtctttctgttggaaggggccggcgtctggcctcgcgttgtcctgccagaacgtgggcagaaagggtagcagggaccttgctctggtggggcacgtcttctctttgtgtttttatttctgggggtttctggttcctcagtggttcagaggaaaagccagaaaagactctggaggctgggaccaatccctgatagggtgacccggtttgtgactccctctgccccattgaacagacacctgaaaacttctgggtagggactgcaaactgggctgaggatgtgtggaggggtcaggaacaggtgcttatttaagggaattaaaaaaccaaggttaagtaactggtattggaactgttggggcggctaatgtaaggaaaagcattggactaagtgttagagtctgtagtttgaaatcctacctctgcctcacacaaactttgtgaccttgagtaagtcacttgcctctttgaacctcagtttccccagctattaaaatgggaatagttatgtctgctttgcatgcttcacagggttgttttgaggatcagacgaagtgctgtttgtgaaagggctttgtggagtaatgtttattgtgtgacactcagtgaatgagtggcagcccattgaattctcactccccgtttcctgtgcaatcagatggtgtggtttctgccttggaaagagggttggaagaggaggcaagtctgaagtacagggctctgaagagggtaatgggccatctcaggaaggatgacacgtcttggaaacaagtgccatgttgacctcagggatggtttccccgaggaggcagggaaaatatcctgagtttgcaacaaaatgaatatcagacactgactctctcctcttcttcctggttaatagtttgctacaattaatagaagatacatccttctttccttgctctgtctgaaaagaacaatatctaagattttggaaaatgcatatctaacccccttaaagcctattaaatgtattcaatctctgtttgggatacaatggtaagaaaaaataggcaatgttcttgccctcctggagcgtatcatttagtgggggaggggagaagtactatttttaatcaaatatcacacaaataaatatcataaactgtgataaatgctttgaagaaagataggcagtgccataagcgtgtataacagtggttccagacatggtctcagagaagattttgctaaggaagaaaatctgggcaaagagctaaaggatgaataaatgttaactgagggaagagggggatcacagggcctgagaggcaaagagaacagctacacaaaagacctgtggcagagggggacacacctggttagagacctgaaatgaggccagtgtggtgcagcaacaaggagcgatgaggggaatggtatatgagatgtgttctggggttataacacacagggccatttggagcccatgctgaggaagttgacatttatctgaggaacaaggggaagccactgaaggggtttaagtagaggggaaaggggagagagggggtctctcctaaccgggagagagagagagggcatgagagagtaaatgagatcatgaacagattttcttttttttttcttttctttttttttttttttgagatggagtcttgctctgtcgcccaggctggagtgcagtggtgcgatctccactcactacaagctccgtctcccaggttcacgccattctcctgcctcggtctccggagtagctgcgactacaggcgccttccaccacgcccggctaattttttgtatttttagtagagacagggtttcaccgtgttagctaggatggtcttgatctcctgacctcgtgatctgcccgcctcggcctcccaaagtgctgggattacagacgtgagccaccgtgcccggcccagattttcctactgaaagatttctttggctgcagtggggagaataggttggaatggatgtgaggatacagtgtccttaacatgcagaatgtttacaggttatattattgagggcatcatgacccttaggtttctgttagtgttctgtgaaattagtaattcttgagtacttctggagtaggatagaaaatatctcctttatatctagtttgtgaaactttcttgggtggtagggtgaggagaagaaaaggaatacaatgggaacagtaggacctcatgaaggctggagtcaggtaataggcaaatggaaatttgagagatagggaggaaaagagaatgagggtagaaggaggaaaggaaatggggatgacttgggggagagacagtcaactgactggcaatgaccaattaaaccttctatgtgctaactaggctgtgtggagatgggccttgtaaagtgagcagattgtgtaacttgatgtaaacagagaggttccagacatcacctctaaatatcataaggctgtgctgttttggaagatgtgagctactgtcctagccttctaacagttccctctgctttctttcttgcccttctgtaagactactctccacatggcagccacagggagcttttaaaaacacaaatcagatcatgtcacatcttatcttgaaacccttcagtggcttcctggtgccttttagaataaaatccaaactctttatcatggcctaccaagcctgaatacaatcaggctcttgtccaccctcccaggactgcctctcctccactctctttcttgcacctcctctggctttctgtttcttcaatacagtaagtcttgcatacctcaggtgggtcttgtgcctgtcattccctctgcccaggatgctgttttacccaggccttctcatgattcaactagaatgtcacttccttagagtggctttctctgaaccttcatcccagtcactctctttaagatggtcctgttttattttcttataacatatgacttacctgaaatattcttcttttggtttcttgtttattatcatctcagttagaagcttcttgagggcaggggacaagcagaaaatcttctcacctagcacagtgcctggtataaaattggtgctcaattgcataagtgaatgagcagctctcccgtatccaaagccagatgcctccccttaaggagctcaaggtctagtcaggattggcacagagtgacagatggccattacttcattacacaacatctcttccctctatgttgtgcctttgctcaggcgttgaagctggaaaatctttcccctcctctccgccaagaatattccattttaaccttcaaggtctggctccatatcattctattatattcgtcactcactctcccctgctcacaacacctaccaagtactatcttccgtgaaccctgacttgtggaatatacatattcatctctgctgctcacctgacagctccatttgctgttactgttaacttttattgaatgcttgccatgtgccaggcactatgctaagtgtttttcatgcattatctcacttaatgctctctataaccctgagaattatggaactttattattgttttccaaatgagaaaacaaagataataaagaggttaagtaattcttttatttttatttttattttttattttttgagatggagtttcactcttgttgcccaggctggagtgcaatggcatgatctcggctcactgcaacctccaactcccaggttcaagtgattctcctgcctcagcatcccgagtagctgggattacaggcgcctgccaccacccctagctaatttttttgtatttttagtagagatggggtttcaccatgttggccaggctggtctcaaactcctgacttcaggtgatccacctgcctcggcctcccaaagtgctgggattacaggcatgagctactctgccaggcatagagaggttaagtaattctaagtgccagggttgcttgtggccctgccagacccagggctgcatctctgcaaaggatgtgcccttaatcactgtgcattactgtggctgtgtctttgttgcctataacagtacctgtctctgaataagcactcactaagtgtttgggaaggcaggatgggaagagactgcaatgagggaggccagctaggaggccattggtataattcaggatgagttaatgaagacctacattagtcatcattttgatgagatctctgaaggtgtttatggaatttttatttatttttgagacagggtctcactctgttgcccaggctggagtgcagtggtgtgatctcagctcactgcagcgtcgacctcctgggctcaagtgatccttccacttcagcctccctagtagctggaactacagacatgaaccactatgtccagctatttttttttattttaatttttatagagacagagtctcactatgttgcctgggctggtcttgaatccctggtctcaagcgatcctcacccctcggcctcctgaagtgctgggattataggcatgaccaccacgcccagccggttattgaaattttaagagtcaatgagcttttcatagggggtagtaatagaggaaggaagtcagaaagctttaaggaaagcccctactttggattggaactggggacacctggtatcttcacagttctcctgataagcactttcagaacaagcagaaggaagtgttgaaagagaaaactggtgagattggaactctcagcatttgagccaagtggtgctggggactgaaggaaagttcagggagggtgaaaatggtggatggggaagcaagtgaatttgggcaattaccaaggcttttatgtggatcaggcctgctcagaatggaaaattttgcagaaatcttcacaataataaaccctggtaagtgggtgataattgagaaacatggctgataggagtagagttacaccccatgtcttatgatggacctgaaaaagctctaagacaagagttctgaaggagacctggattctagtgcccagtgactgtggcacatgttggagctcagtaaatatttgctgagcgaatgaatgaatggctctacagggagtgcgtcaacttttctgagggtcatagccagtttatggtaagcagtcagtaaatatttgctcatattatttaacaaaagtatcaactgtagatagcagtttctcctctcactacattgcacatacccctccaccctctcctcacacatactaggtattctttccatgtgagagaattggggaacctgtgggcattctttttatctggttttcccagatctgctagggagcttcagtaggagagatgtgggcagacttgtcaagcagagacttgagcagagaattggggacaattcagactgcaaatttacttccttcaaaatctgtagataatcgtcttagctcatggtttgccttggcagggtagacagggtcatggtagtaatcaggacacagaaaagcaattgtgtctattctaaatctgctgccaggtaacagcaacagatcttagataatggagaggttggttgtttcccataggtagtaacaagtttactggtcctggtcttggtagtcaggaagtcataatatatgtattggttttcaatttctgccataacaaagtaccacatatttgatggcttaaaaaacacaaatttatcctacagttctatagttcagaaatctgatacaggtctcactggactaaaatcaaagtgttggcgggactgtttctttctggaggttctgggagaggatctgtttcctcgccttttccatcttctagagactgcctgcattccttggctcatagttcccttcctccatctccaaagccagaaacatagcatctctcagaacctgcttttgtcatcacatttttctctgactctagtcttctgtctctctctttcacgttaaggatccttgttattacactgagattacataatggttttcataatttaggatgatctccttattgtaagatcagctgattagcaaccttacctccgtctccaaccttaattcctctttgccattataagggaacatattcacaaactctagggattaggatgtgcatctctttagaggactattaatctatcacagtgtaacctatactgaacaggagtgactccaagtggggttcagcaaaagaatcactgagaagccagagccattttggaattttaggcccctagcaggctgctgaagggttagaatgggaagctcatgggtattcaggagctcatggccactgagaagaggaagtctggaacagctgcatgagtccttgtggaattttttttttgtggctatagggtgttttcattcagtaagaaagtatttgagggcattggagagttggggacccgtgggtcagatttggtgatggactccccaaagggccagcattctgaggctctgctggatgaagaggaagatggaagtgaataaggagatgaagaactattggaggtctggtcagtaaagggcagtttggggtgcagggttctggagcgccaaggatttaagaaggtaataatgtggatcttaagctattcttactgtgggcattaatccatgattagtccatctgactaaatggtgaggttctttgcttttggcaatcttagcatactgacttactaatgttagtaaggaacacagacttgattagagttcttatctcacttagcttttgtgagatcttagcctcaatttagaactgttttgaggattaagtgaggcaacatatgtaaaacacaatgtgaggtatataagtgtattacctcggtttgctgattagaaaccttggaaatgggccaggcgcggtggctcacgcctgtaatcccagcactttgggaggccgaggtgggaggatcacaaggtcaggagatcgagaccatcctggctaacaaggtgaaaccccatctctactaaaaatacaaaaaaaaattagccgggtgtggtggcgggcgcctgtagtcccacctactcgggaggctgaggcaggagaatggcatgaacctgggaggcagagcttgtagtgagccaagatggcgccactgcactccagcctgggcgacagagcgagactccgcctcaaaaaaaaaaaaaaaaaaagaaaccctggaaatggctgggtgtggtggctcacacctgtaatcccagcaccttgggaggccgaggtgggtggatcacgaggtcaggagatagagaccatcctagcgaacatggcgaaacccagtctctactaaaaatacaaaaattagctgggcgtggtggtgcgtgcttgtagtcccagctactcggcaggctgaagcaggacaattgtttgaacccaggagacagaggttgcgatgagctgagatggcgcctctgcactccagcctggtgacagagcgagactctgtctcaaaacaaacaaacaaacaaaaaactctggaaatcatctctatatttattgattttgaaatggttgaatgtattagaactcaataaacacttgacttttttggggggggtcttggcagggatagtggtgggagtgaagtagaatgttaatgtatgtactctctgaaaacactgaaaaagatgaaagggttctttgaggtaaaaagtctgagacctactgcaggaaaggaggtgggattcatttgggcaggtccaccaccacgcaggtccagagaggagcctcaggggaagtgtgttaagagagagagcttgaggtgggctctgctccccaccttccctgttccctgtagcctctgtggctgcttccaggagctggggccattatgtaagactgagctctgcccgtgccttttaatttccatttactgtaagtgagaatctggtctgctactcagttataattcattcatttttcaaggctcatgacaatgctttctttctcaagccttgccttgcaatttcagcattttaatgtgtatttaaccctcttagttctttttatctatctagtccttgaggtaggcactcaagtcaattcacatttacgtagtgggttattatcagtgaactaagaggaagttcagaaaagaggatactcagaaatagggctttttccttcctttcttccttccttcctttcctttttcttaagcttatataatgtgtttctcaggattctaatcttttctgagtcacaagcccctgtgagagaatctgatgaaagttatggaccctctcccaagaaaaagtgcacattcacacatattcccacagatcctctgaagcccatttacaagcaccctagaaatccatggaccacaattgagagatcttttttgccataaataaatgatactatcagaggaaataatagccaattggtgaggaatctgcagcaagcacaggccaaagagacctgatgttcctttcttttcatttttaatgatttcaaacaaactttgtatgtgcctgaaatttatggaacatttcaagcatatagcaaagtagagagattttgcatagtgaatcatcatgtacccatgacttggcgtcaacaatgaacacaccatctgttttttttttgttttgttttgttttttttttgagacagggtctttctccgttggccatgctggagttcagcgtacaaacacggctcattagagcctccaactcctgggctcgagcaattcttccacctgagcctccagagtagctgggactacaagcccataccaccacacccagctaatttttgaatttgttgtagggacgaggtttcactatgttgcccaggctggtctcgaactcccagcctcaaacgatcctcccacctcagccttccaaagctctggggttataggcatgagttgcagagcctggccacacaatcttgtttcatctatgttcatctattctccaaatctcagacatattatttcatgagtaaaaatttcagtgtgtagccctaaagattaaagactcttttaaaacaacgacataactgccaaaacacacgagattattatactgaaaaaatagtttcctaatataatcaaattttcatttagttgtttacatttatgtgagtaccttgtagttttttaaaaaatacttgttttatttgaatcaggattcaaacaaagtccacacattcacattcaagcctgacctttcaaatgcttttgctaatggttattgacagtggctctgttttctttggcaagacaaagaaaatggatgaacaattattcagtgaatttaggctgtggttaaccaatctaaattaaggaaactaacaaacagcaagaaagtttttcaacctgaatttttcagatgattgaccttgctctttatattttgcagttacaattttaaagaaatcaatcatctctcctaccctccctccctctgtttctctagattcccactgtgttctctgtggtgtcaggtgtctgaagacagtaccaagtattataattaattgattcctatcctctggatattaaaaaccagtaggggagccaacatgaataattattcatatatctaattatttatttatatagttttatgagaaaacatctgatcaattatcaaagagtttataaaactaataaacattcattgaaatgtatgggatacttaccatgtactggacattgtactgggtgctgggtagatattgatgaatataagacccagtacctatcctcctagaacttttgaggggacagaatctggattttgctgattgtattcccatggtgttgtttttcaaggaactctgttttattgtactttcagtaaattggtatttggatttagaggcttgatcagattcagggacaatttatttggtaagattacctcatgggtggtgatatggtctcccattaggaggcatacaatgtctgattgtctctcctttgtgatgttagtggctgttgaaaatcagtacaatccattggggattgcaaaatgattttgttccatcattcccttttcatttagtctctcccataatgagaagcttttctcatctactctgtggtaccactctatggtataatttatctaggaaagcccagataaattatttgccagttttcaaagtaatgagttggtttattagtgttatcctccaaatgtgaccaattagttaattttaaaagtgaccttgtgaagccaggcgtggtggctcgcgcctgtaatcctagcactttgggaggctgaggagggaggatcacttgagcttaggagttcgagaccagcctgggcaacatagtgagaccgcccgccccaactccgccacctctctattttaaaaataaataaataaacaaataaaataaaagtgaccttatgaagtgaactcatcaatcttaacatattgacatggtcaatctgttgtaggcattaccctactgatgctcaaattgtcctattttttggcaagagacccctttaaattggctcctgagtcctttggacacaatcctagttgtcttcgagtgcttccttactatctaacataataagatgttttagacttaccttgtacatttcctggctgggacctatgaccagccatttctccagggagctctgattccttttattacaaaatggtattttaagagactataatgtaggtactaattatactcattgctactgattgatcattttttctaagcctttgagtgggcagagctagaaaatataaatttgtaaatttaaaaacattaaaaataaaaacgcattgtatattattgttgatacttccaattcaatttaggactgcatggctcttatttaccttttgtcttaaaactgtatctcctttctctcttgccgagaatcccagtcctcagccgcactgggagtgacagaataaattcacatagctactcatttgttttatctcacaacacacaacaagcctcagaataccaacaccaaccctacaaccaacaataggataaccaaaaaacagtttcagatcttttaaaattcttctttgtccttagagtatatgccactgaggatgttcagtcaggttactatgttttaatgttacttagaataatttctcttggaatttataccatcaatttgacctttgttttcattttgtttttgattttggggaattactttaaaatttttaattttacattatgtaaattatttacaaaataaggcatattcaaaaaagtctagtttctatctttgtctcttccatcttattccctccctcctctctaggtaactatttaaaaaaatcttttgtgactttttcttcttttatttgttatttatttatttatttagttagttagttagttatttgagatggagtctcactctgtcatccaggctggagtgcaatggcgtaatcttggctcactgcaatctctgcctcctaggttcaagtgattctcctgcctcagcctcccaagtagctgggattataggcgtgcaccaccacacccggctaatttttgtatttttagtagagatggggtttcaccatgttggccaggctggtctcgaactcctgacctcaagtgatccacctgccttgggctcccaaagtgctgggattataggcatgagccactgcagtcatcctatttgttttaaaatgtaagcaaacacttatgttccaacaccctttgttagataaaaggtagcaaattatacagttttctccatcttgctttttaaacttaatattatattttggagatttttccatggtagtaataatatataattttaaatgtctataaagctaatttaatacataaaaatcctaagtagatattagactattttatttacttccctaaaagtttgtttattccagttggcctcaaaaactttatttcaatcttcccattgggaaaatgaattgccttatgttcagagttgtcttatttgggagcatagatgataactacaaaatagtaactttggaacagtaagctggaaacttgagcaggatctagaaggaaggtgatatcgtttggctatttgtccccaccaaatatgttgaaatgtaatccccaatgttggagatggggtctggtgggagatgtttgggtcatggaggcagatgcctcatgaatgtcttggtgccatcctcacagtaatgagtgagttcttgctctgagttcacccaagatctggttgtttaaaagagtctgggccctcccctctctcttgcccccatcttgccatattatacaccagcttcccttttgccttctgccatgattgtgagcttcctgactctcttaccagaagcagatgctagcaccacacttcctgtacagcctgcagaactgtgagccaagataaacctattttcttaataaattacccagtctcaggtattccattatagcaatgcaaatggactaatacaggagacgtggggatttaatgtgctggagagtttggggaaatggcatgttagatgactagatgacctgacaatatgagcaaagacataaaggtgggaatgtgcacagtgctctcgggatcagtcagcttggctggagttgcaggtttgagaagggaaatagattgccagggaaatcagctaagagtttttttgaaataattcagggtcttgtgattcagggtattgataggataggtgccattatattcattcttttaaaacgtttaatttttattttgaaattgacaagtaatatttaagtaatattgtacatattcattggggtgcatagtgatgtttcaatacatgtaatgtatagtgatcagatcagagtaattagcatatctatcatttaaaacatttattatttctttgtgttgagattactcaatatcttccttctagctgtttgaaactctatattatagtcatcctactatagtatagaacactagaacttattcttcctatatagttgtaattttttatcctttagcaaatctctccctacacttctcccccttgccttcctagcctctaatattctctcttatacttcttacttctctgagatcaactttttttagcttccacatatgagtgagaacatgcagtgtttaactttctgttcctggcttatttcacttaacataatgtccttcagttccatccatattgccacaaatgacaagatttcatactttttatggctgaatagtattctgctgtgtatatatgccatattttctttatccattcatctgttgttggacacctaggatgattccatatcttggctattatgaatagtgctgcgataaacgtggggatgcagatgtctctttaatatagtgatttcctttcctttggataaatgcccagtagtgagattactggattatatggtggttctgtttgtagttttttgaggaacctccactgttctccacagtggctgtactagtttatattcccaccaacagtgtataagggttctttcttcttcatatccttgccagcatttgttatattttgtctttttgataatagccatcctaactggagtgagatgatacctcattttggttttgatttgcatttccctgatgattagtgatgttgagcattttttcatatatttgttgactatttgtttgtcttttgagaattgtgtattcattcttttaacaaagatttatagagcactgttatgtgaaaagtctgtgctgggtgctaggatacagtggtgaggaagatggacatagttccttcttcctcaaggaacagaggagactttttttattttttttgagacagagtctcgctctgttgcccatgctggagtacaatggtgcgatctcagctcactgcaacctctgcctcccaggttcaagtgattctcctgcctcagcctcctgagtagctggcactacaggcacgcaccaccacacccagataatttttttatttttagtagagatggggtttcaccatgttggtcaggccagtcttgaactcctgacctcaggtgatcacctgccttggcctcccaaagtgttgggattacaggtgtgagccaccatgcccggccaagacattttattactaagagaattgcagtgtgctatgagggtatataaatggtggacctagcttagtttggaagtcggagtgggtaatcaggaaaggcttccaagtaagtgtgttgaggctgagatcaaagagatcatcatctctttgatcatcatcaaaggtgggggcaggtggtgggagtggcagggagagaatggtagttccaggaagagacagcagcactaagtaaagaaggtgggtgtggttccagaactaaaaaaaaaaagaaagaaatgcctaatatgatttaaagggttggagcatgtagggaagagtggatgagagatgaaaattaattttttagagaaattgcaaaggaagaaagacttggtaagaaaagggaactagctacctgaaggcatatggtaggcactcatacatgtggaatggatgaataagtaactttgaaatttcacctgtgggctaataaatgatggtgccattggtaggaataaacaaatgagcacagggtgttagttttggaaggaaagttagttgggttttagacacatggttcttgaggtgtggcatcctagtggcttatcaattactgaaccacagtttcagactgcagttgaaattgtaagtcttaagtgaggaaaacaaagagtagagagctctttcttggaaattatggttagaggaagaaaaagactaaggatgagacagaggaggcctgataagaggagcaggatggaaaatttcaaggacagcgtgtggtaaacaggcccaaatgctgcaaagaggccaaggagaccaatctacaccaaatgggacaacttgcttcacagcacttgcaaaatgccaaaatgttatacagaggtatagatggagtggggaggtggaaaaggcatgagatttacagccacaagacctgggctcatgacacgtcctagtaatcccagctgctctggaggctgaggtaggagaattgtttgagcccaggagttcaaggctgcagtgagctatgattgtatcactgcaatatagcctgggtgacccattctctctctgtttttttttttttttaaaagacctaggctcagtcctagctccgccttttatgacatttgtgaccctgggccatcattacttaatgttctctgagtgtcagtctgctcatttataaaatgagaaagataatggctaccatatttgcatctaaaaggtattgtgaagttcacatgtaaaaatacaggtaaacaattgtgtttcccccgtaagtatctcaaaaggatctggcatacacaaggtttgtatatttgaacgaggtatgtgtattactgtgactacttatttgtgtttaaacagagaccagatgaagaagctgtggtggatcagggtgggaccagtacaattctcaacattcactatgaaaaagaagagctggaaggtaagaactgccatgctgtgtgatcagggaaattggtgaggggcagcctggtgtgggaagacctggctctgtgtcctaactctctcactagctgtcagaccttggggaaaatcacttgatttcctttagcctcactttcctcatctggtaaataaaagtggggatactaatacttgtcctaccttacagggatatcattaggatctaattgcctacatgggagatagtgctttgaacacggtgaagtccaatataaatattaacaagtaacctgttctttgagaatgtgatgtactcagttcagtgcgttaattcttgacaactgcctggaaatacaaataaatacaaaacttaaagagaaaataaaatacaaatagttttaaaaactcattttggctacaaaaccctatttttaccccatttccaatatttactgtttctattctatttatacccatttctgcctggtggtttcatctaaacaagagggaaaacaggaacacacctgtgacatactcttgagttcataacatcaaagttatataaaagcccagctgaaggggaaaggaaagaagaggcattttggatgacccactctgtccagtttaccttatttcagctcttcctttctctgcacctcacccccagctccccacataaccgttatgtggtgtcctgctttccttcttcccctggggactagttggtgtgttaggagttggacccacacctggccatggttttctaattagtgttgatgctcagtttcattagaggaaggctcatgtccagtatccaatatagctttaatgagaagccacatttggctcaaaagcctttgtgaaatctctgcagcatcccctgcaatgttgaaggctatgatacagcaactttctgatgcctgagacagcatgtgaaatgttctctctgtactgcctgttcccgtgacagttttttcatcaaagttgtacaacctccagagaaaacttgtccttttgatggggagaacggaagctgtagaggctgactcagcctctgggtctgttaccatgagaactgacgtgggtggctctgtggaggtcagtggtgtttgggtataccaaggtgaagttttccaagttattttgaccagatggaagaagagaacatgtgagttgcagcagttgggagggagtgggagaaggaaagggtgtggaatggaaggctaacatttgttgaatgccccttgtgtgttaggcattagattaggcaccttatacaagttgtccttttcatcttcatagcaccccaggcaggtaggtatcattatccctattttacacatgaggaaactgctcaaggtcatcgagcctaattgcaggtgaggctggggagagaatcctgctcttttcattctgccacacagcctgcaagagaggacagtaactgtcattaaccacccaacctcaatatcttgctccatcaaataaaatttttgtatgttgctcttgcctcttcttctgttctgataatcatgtggtctctctaccctctcattgcatcctgggggcatgttgctgtcagtttagttgttctatagcaagcaccactggacctttgccctcagcaaggaggtaaccatttatgaacactcttgtctacttgggagtagaataagaaacctgagcaagctctcttgaatcttaacaactggttccgtccacggagatcagctgagtaactggcggtgggagcagcttctccagatgacatcatctgttctttatgcatgttctactttgctaaaaaagaatgctgtctgtgatgacagccttactagtgcatagtgtgttgggagatggtcctttgtacatagacttttttgaaaactagaatcttatttatgttaacacttaaaaaaaaagcattacacgcaaatggtggacaaactagaaccagatctcaggcctgatgtggtttctagaccagctctggagaagagaagagagagttgggatttgctatagggttggctgtgctgtgggttccactcagactcactccgaagggcagccctaggactcaatgaggctgtactcagggtagtgttatctcttgaaggcatagaataaaacgagtaccattttgatggaacacagaagcaaattgtgttcagattcaatatgcatgccatgatatcaggttctgtggctgcaaaaaaaatctccaggtcttttttcccctttatgtcataacttctgcccacatgacataaactataaatcattgccttaccacattttatttatttatattaaacaacaacctctagtccaagaatatgagttttttgtttttgtttgattgttttttgaggcagtcttgctctgtcacacaggctggagtgcagtgacccagtcttagcccactgtagccttgacctcctgggctcaagtgatcctcccaccccagcctcccaagtagctggggctacaggcacgtgccaccatgcctggctatccttaccccattttaagaactatttctgagatttagtctgtgtacattgttagaaactttgtaagtgtgggtcttttgcataaattaattctatcagtaagagaagttgcattaagccattatgttgctttttttttaatatgtgagaagagtcaaaagccaacatcagaacacgttccaaagatgaactcaagaagagcaatagtccatgatgtgcttcagtggactttcccagtcccagaggaacaagaggcagttgctttagttagagggatggctttttccattttttcctggcagatcattattcctgattaactactagattaatgaactctggagtgagtttaaggccttctaatacgtttttaacagaggtaagagccatttggtcatatttataacttctaaaaaggcttacatctgctcgacatgtgagattcacctctgcagttattgactttgagttaacctgtaagcccagaggagccgagcaccctgttgtatgtgctaatgagctctgtgtgagtgctgggtaagcagtgtgcgtgtactgcattgtaccttagtaggcccaatctccatctgcagggtacgtcaaacctatggttcctgtcctgcttcacatgattcattgccagttcactaaagattgctctctgcatgtgtatatgtacttattttttaaactatagactaaaattacatctttcccataatttttactaaattagaatactttatttgcacacagatagttccaaaagactaggtttgaccttttttggaaaaaagaatgacgagttagatgggaaaaaaatgggatttgtgcgagttggtaggtagaagacgggggcaaagagcggttgaatggccaacaaagtgaccacagaattagtttaatgaagtcactgggtggccagaatccagttagatggactggattttattggtgctatattcatttcctagtgtctgtttgtcatcttttctgccaatttttctcagaaaatccaaatccttgctttagaactcccagactagaaactgatgcctgattttctgacagccgcttggtccttcttagctctgaccccctgccgaacttgatttcatttctgcctgtctctctgatattttcaaaagacaggcattgcgattggctaatgttcgtgataattgattgtactaaagtaagatttaccttacttcctacagaaccattcaaggcatctataggatgtcttcaccattatgcctcaaacctacatagtgggaatttagataccaagcaaaaccatatattattcactcagcaaacatttactaagccccttctgtagtccctttctgcagtaataagtcaggacagtgagaacaattgaaccatcgtgtcttttctgaagaataacctagcctgaaactttcataggactcgaacattagaacctggactagccatcatctggacaagcctgggaagtcatttggtctggcctccttgttttactttaatagtgacagtgagtaatttaaaccaataacatgaaatctaataatgcagtttctaatatccaatcactgcctcctcaatttctcctttaaaattaaataatactagcagtataccagcatgagcccagtggaagtatttggaatgggctcaaggagcaaggagaagtagaggttctagcctggctagtaatcctttgcggggtttgtagggaagaggaaacccatggttgggatggctgtattgaagaactgaaagtcacctctcactgaggctgttcttaacctaagtccagctctatctagctgtactagattttacaacaccaggtcatcattttagaggccaaagtggttgtttagttttaaattttgttttgttttgttttgaggcagggtctcactctgtcgcccagactgagtgcagtagtgcgatcatggctcaccacagcctccacctcctgggctcaagtgacctcccacctcagcctcccaatagctgggactacaggcatgcaccaccatgcctggctaattttttattttttatagaggtggaatcttgctgtgttgctcaggctggtttcaaactactgaatgcaagtgatcctccttccttagcctcccagagtgttgagataacaggtgtgggccgctgtgcctggccagaagtggttgttcaggatcgaattatgctttttacagcacatagattcttcatgacctgcccctgcctgtttttctgtccttgtacatctcctttccttcccttttctaccctgccctggccctactggccatccttttgccccagaaccagctctgcacattcccaccttaggacctgtgcacttgatcttcccccttcttggaatactcttctcccaggtcttctcatggcctctccttcttatcacttagatgtcccctctaatcatcttaaagtctcccttctccatcctaccccttaccctagacacgctagcattttaccttatttggttcatagtaataatcaatatttaaatgatatatttttgttttcatttctgaccccccccaagcagaatatgtgtcctgaagactttgttctgttcactattgtatccccagcccttgggacaggatctggcacaattacttgactctagtctgctgctaatgccacctgggttggtctcagtagtgtgctacagggatttcattaacatactataatggaacataatgagttaacaaattgtattttattaagatggtattcaatttagtattttcacgctatatgctttttatagtttatactgataatgtcagggtctggaatcccacatcttagcagatgacctcctctggctctatatttctgtttctatgaagttgcaagatgactacattatgttcagagatctgcctgttaaaaatgacctgagatatacacgaggcaacagagaactctcctgagacaggagggtaagaagtgcgattccaccagatactaaacattttatcctcctgcctcttaacattctagcagatctctgatcatcttatcctctaatccttactgtttgttttttattttgctttatcactttggaatttggaaaacagagagggcaaataaaaggagagacaaatagagaaaggtgttagaatggcatccaaggcactttaacctgacttggaagtggagggcactatcaaggaagttgagtgcagccttaggaaaccccattgctgggaaaagaagaagataaagagttggcaactcttcccaccaagtctccttctcggggaagtcttcctgatgaagctctccattctcaggtcagttaggactttatcaacctccccatgccctggtgagtactttatttgtcctaaacacattcactttggttacatgttctttttgtggcccctttcaggtcagagtcagaggccctcttaggtgagattatgtactcctgaggaggtcctaagggcttatgctcttcagggaggtacttaggaggtattttatttgctgaacatttatggaacaatgaccatgtgtgaaacactgtgcttgattatgtaggcattctgagagaaacgtctaacttgggacaccaaggagattgcaagagaagagtgcagaataagagagatagctgcttaactttaacgcaaaatagaaaaataagtacatgagaacagcactaaccaagggtgctgggaatctgcctgcctgcctgtctgtctgtctgtctatctatctgtctatctatctatctatctatctatctatctatctagagatagggtctcattctgtcacccaggctggagtgcagtggtaatgatcatagctcataagctcatgcagctttgaactcctgggctcaggcaatcctaccacttcagccttccaaatagctaggactataggtgcacaccaccacacctgtctaattttttttttttttacaccttttgtggagatgaggtctcactaagttgcccaagctggtctcaaactcctggccttaaacagtcttcctgccttggcctcccaaagtgttgggattacaggtttgagccactgtgcctggcctggcactgggaatttaaaggaatgaggcagcacatctgatgggggaaatcagaaaaaataccaagaaggaagatgcatctgcagtgcatcttgaataagtgagccaagccagtgtccagaaagcactggcacatttgtggaatggcagtttgattctggtagagaaaagagtatgaggtgatggtgggtacagcagtcaaggccatgaagaggagatggagtcaaaaccaggccatttggttgctgaggtacatggcagttatacatctctagatatttcccccccagaatgttgattctctgtgagcatgtgggatttccacttttttttttttttttttttgagtcagagtctcgctctgtcacccaggctggagtgcagtggcgcgatctctgctcactgcaacctccgccgcccaggttcatgccattctcctgcctcagcctcctaagtagctgggactacaggcacccaccaccatgcccagctaattttttgtattttttttagtggagacggggtttcaccatgttagccaggattgtcttgatctcctgaccttgtgatccgcctgcctcggcctcccaaagtgctgggactacaggcgtgagccaccacgtccggctgggatttccactttttatttctcttgaacttgttattcagttcttgagaggtctttcattttattttcccactgaatgtataattggtattaaaagaagaaaagattaaaaaggagattgagtactgagcatgaaggtcctgaattcatatgggtgagccatgatcagagctgtaactaggaggatttgtttgcagggttaatttaatgtgagaggcaggaaggggcccctgctttgttaaagtgggagttttgatggccctaatctatagaaagtacggtgagggagaaagggaatggagttgaaaatctaaggtaacgctcggtttcaagcctaggaaattgagagaatgacaaggccatgaacagaaacatggaatgagtataagaccgatttgagatggaggatggtgagtttgctttgtgacatgttcaatcattgtagatagagatttgaaggtcatttgtagaagtgaattttgaaaacagaagagtgtttagcactaaaaaggaagaaaagggccaaggacagaaacttgaggagctttcctttggtggcttgttgggggatggagcagcacagtcagagtagtgcaagtgaaccaggggagggcagtggcaccggagctcagggagcccagagcacccaagtggtttggatactgcctgcaacgtggtgggctctcaagaaagtcttttgaactaagctgagagagatgtaagatgatagagatttggtgaatgagtggtgtggtgtccctaatgagggaagcttcagcagagactggggtcagaagccatatgcagaggctgtggaacaaggaagtggtgaggaaagggagttaggttgtgactgtttttggaagtggtttgataaagaaggaaagaggaaacagcagaagcttgggtgggtagcactgcttgggaaggtttctttttaagaagtcaggagaaacctatggcagggatggatggaaaggagagactgaggataacagaagcaacaggataccagaggggtgggagacaatgggatagagtcatactcattaacatacccagcttggcagaggagagcaagccagactgaggaagagaagaacttcttccatctcttctcaggaaaaactgaagtgagggctgggtgcagtgattcacacctgtaatcccagtactttgggaggccaaggcaggagaatcgcttgagctcaggagtttgaaacaagcctgggcaacatggcaggacttgtctctactaaaaatcaaaaaaattagctgggcgtggtggtacacgcctgtggtcccagctacatgggaggatcacttgaacttgggaattcaaggctaccatgagtggtgatcataacaccacactccagcctgggcaacagagtgagaccctatctaaaaaagaaaggaaaaaaaaaaaaactgatgcaaagtcacctgctctcagcaggaaggaatgtggataaggttgtggatttgaagacagtggctaaggattagaacagctcctttggtggaagatgtggggaatgggtctgagatctagagtgctgagcagcagtaaccaggcagaaatgggagaagaccaaggcatggtgcattgggcatgggagcatcagcagccccaaattctgggctccaggtttggcaggaaggcaagggaaagccaggtagaggtgacagagatctggaaatctggatcaaaacaaaagcaggcttatagaaggaatgaggccagatgtggtgactcatgcctgtaaacccagtgctttcgaggtggagacagtaggattgcttggggcaatcagcttgggcaacgtggcgagaccccatctctacaaaaaattgaaaaattagctgggtgtggtggtgcacacatgtattcctagctacttgggagactgaggtgggaggattgcttgagcccaggagttcaaggctacagtaagatatgaccaggctactgccctctagcctgggtgacagagtgagatactgtctcaagaagaaaaagaagaaataggagcagaggaactagggagggaacactattgggtcacttattttctcatgttcccctctctttgtacagtatttaatgtctttttttaaccttagcctcaccctcctcatgacttacaactagtctcttttagtactgttctagattgtgtatgctacaatgtagaaaataaaataatggaagctgatcctaggatgaatacatcctaggctgctacaatttattccaggcatgtgttaagcattttgcatgcataaccttatttactgcttatgaaaactctgagtttaaatactaagcttttaatatttcttcttaaagatgagtcacagagagattagataaattgttcaaggtcacatggcaagtgaatgatggaattgagttttggacccaggtgggctgatttgagccttacctgtgctcttaacgacttttctaaactgcctccctgccaagacctgccacacttgtcatagagcaactgtattgccttttaaaaaaatcactcagtcaaattgtcattgtcattgtcataacaataacatctgaatcagcctttacagtttggaaatcacattatttctttcagtcttcacaagatccctgtgaagtttgcaggcatgtgcaggacaaaggaagagaccttcaactccaaaatctctatatctttactcctggaagtctttgaagttttgttgttccagagctgtgaccagaccaaagaactgtgatatttttttctcttaactatgctaggctttttgttgttgttgttttttaaaactaaaggagttctctccacagaccttctgcttctttccaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacggtaagggccttgggagacagggcgggtgtccatggcccaggggaatggggaggctgaggggacatgtgactgacattagcagctggtcttgattcttgagcctttttgtaggatttccaaagcttgcttctaagaagaaatgcctctaagagtcaaaaatattttcgtgaaaacttcacagttccgggcggctgggactacaggcgcccgccaccacgccgggctaattttttgtatttttggtagagaccgggtttcactgtgttagcctggacggtctggatctcctgaccttgtgatccggtctcgatatcctgacctcgtgatccgcctgccttgacctcccaaggtactgggattgcaggcgtgagccaccgcacccggccactgtttttaaattttaaaatatacaattaaattgttatttactatagggttatttttatggtcataatacaaattatatgtgagtataaataaaattcatttctaaactcttaatattttttcaaaattgttatatatttttgtttgaacatgtggcctgtctgcctgcaaacacacagactttttgattcacatagagttaaatatatattagtctaaagacaaactttaggtgtaagaaaattatggaataagtgtgtgtgtgtgagtatgagtttgtacctattttcagaagaaaagaacaatatgggaatgaaaatcattttaataaggtggctactataaaaccaaaaacctaaaaactgaaagcaaatgtaaaaaaaaaaaagaaaagaaaacttcacagttctgaccccctaaaatcaatactataataggtaaaaccccttgctagagaattagccaatctttttgatcaaattcatcagttttccagtttcttgtgggttttcttcaagtggtcttcattcataaatttttcctcccatgaaactacttctacagagtagctttttctctgagaataaagaaatctttttcttctgcattcgtggttgtctatatatatttctaaagttgttaggtaaggaagaatgctatttctgttctaagtgtgaggctagagcagacctttctctttggttgatttcctagacacaccatctcagcgtgttcagttcattcttggcaccgaggaagatgaagagcatgtgcctcatgagctgtttacagagctggatgagatctgtatgaaagagggagaagatgctgagtggaaggaaacagccaggtgaggccctaaaatggcctgcatcaagatctgcttgggtaggcaagtgtgtacccttcagcaagtgacaggcctgcctgccttatttcttcttgggagaagctgtgactgacatggggactgacattccagtgtctcctgtggagaattttggtgttggcatctttatgatgtctttggtgttacctatgccagttgacctggagcatgggattggtgaaataacatgggatattcaggggggcccctctcatttgtttggggctcagagtaagtttatgggctatcttggtattattataggtctgacttagaagatgtagacagggccaccttggtggggacctagtttagcagacatagcataggtccagacttcttctgcaggtgaaccacagggttcaaattcaccagcagtcacagagtttttgagactttaacttcctctgggacaattcaagctatctagagacccttgggattatatccagcctgactgtaggcttccggaagtggttgtagaataattatgcttctctgagactcaaatcccagaagagccctcaggataaccaaggacatgtctagggtcctctagtaactgaccagtgaaccttacggatgatgcctgagctttggggaaggagcgagatgggtaattagcaaagcatggcttcagctctcactgaaacagctcttgctgggtgcctgctgtattgtgaatgttatgggctgagagattcaaacaggccaattgacctggtaccaagtgaaaaggcaattagtcttttgttattccatcttggcaaacttctaaaggtcacacaggacaatgataaaaagaaaaatatcattttattaatgtggtttgtcagtgtatccaaatgatatagattaaatctatttttttaattgtacaggtaatgcatgctcattatagaaagtttaagaataaagataagcaaaaagaagaaaaaaattatctgtaattccacaactgcagggttaatgaggaatataatatttggtgtcttatacatgtatgtatttgacttttagaattttctttaaataagaatggaattaaactatactcaatcttgcagtgttctattacctgcttttttcacttatcaatgtaccctgaacatacagattagattttacaatgttcagtatgactatccagatatcttcctctgtggctcacatcgaagattctctcttaaaaattcctcattttctatctttggcatctagttatttgtaatgctttcaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcaggtaaggttggggaagggaaaacagagcaactttcttataaatttaagaagtgtgggaaaaaaggagtgtggcgtgacagaaagaatacagtgggttgtgtgtccttgggcaagccacaaccttcctggcctcaatgtccttggctgtgggaagggtttcaggctaataaacgactctacctacttcacaggtgtattatggtattcaaatgacatggtgttaagtttccatttgtctgtttattcagcaaatgttttattttgtatctgctatatacttgataatgtgctaggcatggggttatgaataaagttccctcgggtgcagtggctcacacctgtaatcccagcacttcgggatgccaaggtgggtggataacttgagctcaggagttccaggccagcctggtcaacatggtgaaaccctgtctctacaaaaaatacaaaaattagccaggcatggtggctcatacctgtagtcccaattattcaagaggctcaggcacgaggatcacttgagcctggcaggtcaaggctgcggtgagtcaagattgtgccactgcactccagcctaggtagcagagtgagtgtaggggtgggttgcccctacacacctgtgggtgtttctcataaggtgggacgagagatttggaaaagaaaaagacacagagacaaagtatagagaaagaaataaggggacccggggaaccagcgttcagcatatggaggagcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagttttgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcaggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccatttaactctgagttgacacagcacacgtttcagagagcacggggttgggggtaaggttatagattaacagaatctcaaggcagaagaatttttcttagcacataacaaaatggagtctcctatgtctacttctttctacacagacacagtaacaatctgatctctcttgcttttccccacagtgagaccctgtctcttaaaaaaaaaaaaaaagtaaaagaaagaaacggttcctaccttcaaggagctcgccttcaagtgggggaaatagccatggaaataacaattaaaaaaagtgcaacgacagagacatgcttgataataattagagaaaggggcaactggaagttgtgtggaaaaaaggagtaaagagaattaaagactttaaaatatagcatctagggcagatattcaggaacttgagccaaagtgcccctacctcttcagtaagatgtgaaggggagatatctgattgttcttcctgatgtgattgagtgttaagttattatgtttggggcctgaatggagaaacacctggatgcatgggggagttttctcttgaattggttctgtttggctggacaggttaagaaatatttctccaaatctttctctatttcaagtatccaagtcattctgtctctctgggatcataggaggacccaggggaggggtaagcactgatgggacattgggcccccctctttttcagggaggtaccccagaagtatcactctgactgcctgggaaaaatgaaattctcatgttcatcattggagtcacattttgctaacttttgactatttgtctgaaatcccatgaatgttccttaaaaggttgtttgttagggagaagaatccctgggagctattgaagctgtttaaaactctttgtaaacaacagcagtcacgggagagttttggacagggtaatgatcaatcagattttgcatattagaaagataatgatggcagcaatatggagggtgagttgatgggagaaatgcattaggctattgcagtagttcaggtgagatcacctgcactgtgggcagtgtcagtaagggatggataatttttcttctgataactttaagtgataagagagacaggaggtgatagatagagggagacatgaggtggatgttcttttttttcccccaagatgaagggtcctgaagcatgattataatatagggggaaggaaacaatgaatataaaggttaaaaatacagaaatatggctcttcagcttgaatattaaatagattttcctcatttatttcttctagtacttgaatagtcatgaatagaattagaaattgaggataggttcagatttttgggaggcttttgaagaagtgcataggactgaagtaaaagtgctatgattcttcacatcaggtacctaatatgttcataatattttagggatactgataggtaaagtgcctaaaaggaaatcagcactgtatatcatctcatttaatttcctgtaacaaccttttaacagataatatgagctccatgttacagatgaagaactgaggtatagagagattatataccttgctcaagatcacacagctaaaaagtggtagaacagggaaacaatgtgggcctttaactccagaactcatactgataactgctatgtttactgccacttaacactaggtattgagatttttttcctcctcaaatctgttgggcttgataggtttaaatgtgatgcttggtggtaattgtctggggtgagtggttagttaacttaatttttcttatagatttctcttctaaatagccctttggagttctacagttatagttcttcttgacaattacagcaatgttaaaatcttggaggaagggaatgtaggggaaatttggcagatgacagaacaaagcaggtaataatgtgagctttcaaattatacagtcctcaatttgaatcccagctgtgcaaactgctagatgtaagaccttggagaattttctagcatttgggccttaatttcctcatttgtaaaaattgttgtactagtgctcaatagtttctatgcccaataagaataatttgttacatgaataaagtataacttttcacagtcactatcatcaaatggcactttcagacaggaagctgaaattgcacctcaatgaccctagtggagctgcttccccctactccatgccctttaccccactccacctgatgttggccttcttgggttcattaaccctcaatctgagtgttcatgtgagtgcctactttccagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtaagattattaggtgatttttctctctttattaataagacattgggaactagttggagatgctgacttactaggggtgggggctgtatttgtctaatatgtttccatgtccacttaggcacttagtactttttggagactggtaagattggtggctgggactggtgctcatctctctctcacggcattcctcagataggtctcagcggacccaaggtgagggacttatgccccagggtggcctcagaactgatgtagcttttgagagatagccacattggggacaatttgagacccgagaaggtaaactggagctttttaggagcaaacaaatatcttagattagggaggcaaaatacagtagagtaggctctggagtcagacttgtaggcttgtgattgtggctttaccactcacaaaatgtatgactttgggcactctactaagcctctttaagtctcactttcttacctataaagtaagagtaataataggacctactccacctactccatttattgtgaacttcaatgagttaatccatgtgaggcccttagccagatgcatggtggattataatcactcagaattttggctactgattggttccttttcctgtggccaggaagggtctcatctacatttatttcctggtctctactcatagtgaatcaccatgtgcaggggatatgcctgggaatctatatttttgaaaagttttccataggggtctctcatatgcatgtctggtgaaggattactgccttaatagagaaataaaagagggtcataaatgtgttcagaaagaaggtgcagaagtagcaagagctctgtcctttccttaccactaactagtagataaggagaaagatgtgtgtgggtcttgacttcgtagtcatcttaacctcttttctagataggctttgcaggagaaggcagaaccaactgatgatgggtgggatgtgtcagaaggggaaaagggcagggactcaggattttgttttattttctccaaataggtcaaaccgtgtctcctcagtctgttccaactacaaatcttgaagtaaaaaatggagtgaattgtgaacatagtcctgtggatttaagcaaggtgagcagagtggtgggaagttggcttcaaggcctaaggttccttttagtggaatccagagtttaattgctggaatttgggtaaggtttagtgtttcaagactctttccctaagactagagccctttctgcataaaagggggcccatctctgcatgtcttttcccttctccttcagcctggatgaagctgactcaacagtttctttctccagattcaacatactgaaaactgggactagctgcttagaatcttccctaaaacagatctcttgatttttcaattatttttttggtacctgctctccagcagttccttctcacccccaggggttttgccaaaacaatattttggatatctatttagagacagatgtctcctaaaactaactcttggttgaagctctccttgaggactgtgactttggtatctgaggccttctgtagcagcagtgtctcactgcagcttatggtccaagccttggtctccctgcctccagcctctccttgctctggtctatctttgacactgtgtttctaaaacacagatagtgtcatatcacttcctctgctcataaggcttcccattttatttggaaaacctgaaacccccgacaaaacatttgagtgtttaaaaagggaaagaatgtgacccagagcttcagaaacatttctcttggaggaagcttgggggaatgggattgaaatcagaatacctgattttaaaatccgaacctataccttaaaagctctgtggtcccgggcaagtcaacttcacctctctgggtttcagatacttcattttttttttttctttaagtgggacgaatacaatctgtcatatcctccttctggggtttttgtaaggatcaaataaaataagaaaacatttgctaaccataaaatgacatatgagtgtaagatatattttaggtgatggggccaggtgcagtggctaacgcctgtaatctcagcacttttggaggctgaggcgggtggatcacatgaggccaggagtttgagactagactggcgaaaatggcaagaccccatctctactaaaaatacagaaaaattagctggacatggtggtgcatgcctgtaattccagctactagggagcctgaaacacaagaattgcttgaacctggcagcagagagctgtgagctgagattgcgccactgcactccagagtgggtgatgtagtgagactctgtctcaaaaaaaagtaaataaaaaatttaaaaacgatatttaaggtggtggttcccaagttgtcagatgtttcttttggactttcaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaaggtaaaggcaaagataaaactcatgcattctatccaaaattcaaatttatgtagtgctggtagaagaaaccacttaatactgaaatttagaattaattaattttaggaatggtgtttacaattcagcagaaaagccagatgtgctggtgtgtgcctctaattccagctactagagaggctgaggtgggggattacttgagcccaggagtttgagcctgcagtgagctagaatcctaggatagcaccatggcaccccagtgtgggtgacagagtgagaccctgtctttttaaaaaaaaaatcagcagtaatctcagaaaattgaggtatatttgattaaccaccatgaagaggaattctgagatttatttctaaggctatgactgcacagtatctatagccttggaaatagagaattgaagaccattcaaaggacatagcaagggccaataacttgttaaaataggaagccaagtcttatcttctcagttctgtagagccatattccaggggaacgtctctgaataaaggtatttgtttccctttgcacaattctggcatggtttgtatggtttgcagatatgcaaacatttgttcaaaaggctattcatgcgctctgaaggtggtgatgctggtgattcagagccctgctacttacagagagtattcagatgtccagaacacatttagactcctctgtaaggcttgatcatttcaacttccttatccctctcctctccccatcattttctgattagaacaataagtggaattcagacaaccttgaatttgcaccacagtgccatgttttgaaaaagcatcttttctacagctaggaattgtgtctatggaaaccctaagaaatgtaatcacattattgaatgatgccgcacaatagcttccaatgcccatagtggagctattattaggtcaaggcaactcaaagtgctccttcattactgtcttcttttttttttttgaaggtacagtgatgatttatgtacgataagagagagaaatcttatactgtttagagaggactaatggcacttctttatatttacttacataatttcctcctctgtgtgttttgccagatttttgtttatcttattgggtccagtagggaaaggtcagcagtaccatgagattggcagatccatggccaccatcatgacagatgaggtatgtgcaacttttgcttcagtcttccatctcataaatatttattgaatatttactctgtgccaggcaatatgctagttattggggataaaatactttccattgcaatatctgctgggaagtagttcagggtacttctctgagagcccagtgtggaaggaccaagctctagaggatttttcttcctatgttatctctccttttttgagtaatcaagaatgcagagaaatctttttctggggaaactattattgccaagtaggatatatagagaaatatattaaggttggcttaactttcaagagaagatggttaattaaatacattcaagctatttacataaagaaacctcactcctgttccactaaatgagaccagtttgtataaggtcatgggtgtgacctcaggcagtgtagtgtgaatgtcttgactagtctgtaccaaaacaaccagatattttgacattttgacattgaacccacagtgcatactctggtaaggactgcactgctcggtaagctgcaaagtagggctttcaaggcatatgccttaggcggcagagggaggtgtggcctgttttttatcagctttctttgattgagaggcttaattcaggaaggaccttcattagtaattccatccagtgtttccaacctttaagatcaagaaaatttccctctcaacgtgggaaagctgattaaaattttttttttcatatatcttgcctttccttccatcctttgtggagataacataattgtacaactttagactcatgtcttatctcttcttatactagcagacatgtatttagttcttttaatgcatctcatttccacgcttgttttttaaatccttttatccttgcacttctctaagtgctaaagttttctgcatctcagatccccgtgacagagataaaaatcaacaggttgtattcatttttcaccatatccattggtgattgtttcatgtaaagttacttttaactttcctgagggttttctcttctctgtagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggtaatgtatgcacatcagccaatgtggctattgtcacttactgactgcccaccatggacaaagcaaagaccatgtgggtatatgctaaatatatcaagatgcagctctgttttggtgcacctagaatatcaaaacaataataaaaatgaatctgggctgggtgtggtggctcacacctgtaatctcagcactttgggacgccgaggcaggtagatcacctgaggtcaggagtttgagaccagcctggccaacatggtgaaaccccatctctactaaaaatacaaaaattagctgggcgtggtggtgggtgcctataatcccagctacttgggaggctgaggcaggagaatcgcttgaacccgggaggcggaggatgtagtaagctgagatggtgtcactgcattccagcttgggtgacagagcgagactccacctcaaaaaaaaaaaaaaaaagaatttgcatagcataaattggctcaggtgtgatggggtcagtcaggattacctgggaatgaattttaagccaaattttgaaggaataatgtgaaatagaagagagaagggagaacatttcttgtgactacattgtatacaagtcatcaaatgaaaaaagcaagttatatagagagagcagatagaatgtctgatatttttctgacatattagagatgggaaaggaactcctactgtgtattagacagcagccaggtgctttatatatgcaaattcagccttcccaggaacatccctcaaaagatattgttatctctagttttacaaaatgaggaataaaactgtcttctagggcaagattttaaggtaaagtaagattacacagaggcagatatgaaactggaacttaggtcatatctaatgccaaagccccatttttctctttctaggcaaggcttagttaggagtcaggtactatggaacaggaagagaaattatggggtgtgtgtgtgtgtgtgtgtgtgtgtgtgtgtgtgtgtgtttcggtaaagtcaataaactgcatcaagtcagtaagtgtatttgaaagctacaaacacgggcatttttggttgcttttgggttatcccattcccactccctgctgatagcaggacgaaaagatagatgttacctttactaattttgtggtcttctgttaaaaggagaaaaggaaaatgcctggagttccaaatggaaatgtttgccacatagaacaggaaccacatgggggtcacagtgggccagaacttcagcgcactgggcggtaagtcctgggacgtttcacagcgatgctgcttattgggtagaagttatgcaaaggaatgaggcatcttctttctttcagcctacttctctgtggtgggaatttattggctgaagaatgacttttcaaatggaaccactgactagaagtattatgaatatatcaaatatcgtattcattcattcaagtttctcaaatcacctaccatgttttgtctcacctccagtccttcctaccattgttccctctgatttgaacactcttccctttcctcatctcctggctaactcctacgtacccttagtctcggttcttgtgtcacttcctttggaaagccttctaggactctctctggatgaggttaggtgttcctgctatgtaatatcacagtattgagctctgaccctcccttccccacattacagcctttatcatacttcattattattggttgatctattgtcttttctgctaggctgtttattccaaaagggcagaggctctattatattcctaggacccagcacagtgccctgaacagagtaggctctcaatgtctgccaaatgaatgaatatttttagaataatgtctgttctgtagcatggaatggactaggtatgataaatgttgagtgatcattttaggttaagaaactcccttagggtaggaagataggtactattttaggtgtgtgtgcctcagaataggcaatctactcttctaggccaacattttaaggacagatgtccaaggaggaggtaagtgagggaagcaggtccccagagtaggaggttttattccctaggtcagaaggtggtaaacgagaatgatattttgggttagtgtgatatccaggggtgtccccagagaaggttgagactatggctctgtctctgttaagctgtgctgtgtctaagaaggttctgctgggtagagattctcagggcaggactgagatcatggaaattagcttttatgtcctctaaccccttgctttcttcttttctgcctccttgcttgaggttgctttccttactcttctatcctcagcactctacccagtggaaactcagagttgttttggaattgtggaaagcattttatttttccaatcttggaaattcagggagaaaccaggagaggagacagaaacaggagagaatggcacttgactagcagtgtcctgcagagaagcatgttttctggtaggaagaatgtattggagggtaggggaagatagctgtgctctgggagggagcattggtggaaagaaggagtccttgcaatggaagggccactgaaaaggggaagcagccttccctttttaaaaaacattttctttaaagttgggagagatctgaattgggtggggaggcctggtattgagaggcagttcaagggaagcatatgtcctcagaaggggttccaggattgagactgtcctagaggaggtggtaatttttttcaggaaaaggttttgagtatggatttgatatttcaaaattataatttatcttttggatataaagggtgtccacactttaggaacttagaatttgaaagtagtagaatttagggcaacaaggttttcctcaaaccaatatctgtgcagagatgagattttaggttgctctttgtgccaaagaaaacaaatagattagcatcccaggctttgtgagaggtggtcacttataatcaattccacctgagggtttgggagaccattatattggatctcaacagttataagatcttggtaatggtgtctgatgtccccaagaaaatcccatattgccaggatcatcatattcttattcacaaaccgcaagtatcttaactcacaaattcaaatggagtttgaaggagttctcccataatgtcatgtcaggaacttctggaattgacaaagctaaaaggaagctctgggctcagagcttagctctgcttgatatgggagatgcttcctctttctgagcttctgtcatttttcttagagcccttagtaaagggcctcaagccatatgaccttcctcccattgtagccccttaggcaaggtgacataatggctgcatagagaatcacatttccaggccagctctggcctctttctcagtctcaaattatgtgggaggtaaatgtgagtcttttttgtatatggacatcctataagtttctgtactttcctggactgcacaaactaaaaccacattagtctgggttttataatttttcggactattagttgtgtttcttggagatgcaaaactgctttatgcttgtcatgttgcacaaccttggagcaagacttggataacatcttacggaatgttatccttgttggatggagaagtatttgaaggcagggtgaagtagactctaagaagatgggaaaggagacaaaattgaaatggtactctgagttctgtatgatctgaccctccaagccagggttaagacagatcttaaacctccctgatattgactaaggcagggatgccataagtaacaaagaaggaaatatgactagagtgttcctaggccggaagctccacagcaaggagggtgctctggaaaggggtttttcagggtatatttctgtcccttattggggatgccacttttgggaagggttaatggaaaaaagaatcaggagctgctatctcgatgatccccccacacttcaaacaggtttcttccaaagtataccagacaaatggatggctggcctgtttctaaagccctccagggaagggctccttaagtcaatgctccagagcctagtgaccctctacgcgggtaagtcctctcttgcatcaaacttattaaactcatatccctgtgtgcctcctgccccagaaaacttgaatgtgaagggcagtgttgaaagggaaaggaaatcccaagtacagaaagaagcatccatgcctgatgaatatctgttgtagatgtgcaatcatagtctgattttatgcatgaatgaggtatgaggctgactccataaagtgttcagaaattattttattaatttatagttataccatccatatgagcctcagatctttccccgccttttaataactgctagactgacagatgtcttccctttctatggcttcttagaaatccatttcacataaatcttttgtctgttgctcacagacactcctgtcctcctgtgtctaggggctgagtattcattgcagcatctcaggtagcctcagagtatgtgtgtgtgtgtgtgtgtgtgtatgtgtgtatgtgtgtgtagggggtcactattatgcagggatattttctcacagaattatgctttccagaggaaggtgactggtaatgaagaggtaataatcgcatggtaataagatgctatgttagctaagaacccaggaatacttgagtcttgccccagataaattattgctgcctgcaaggttattgaggggctatttacctagaggagaaagcaagacaaagtgacactttattactaactgaagcattggtcccaaaccctgaagcagaattcatgatttaggctagaccatgtagatagcttctttacctgagctaggtttgccagataggctaaaactaaggcaggtcacaaggctggctttgcttctcttccctaagcccagacccagattatgatgttactgctgtaagctgaggaaaggtgaatcccaactatacccaccagaaccagaggaaaagagcaggtgggtgtctgtcctgtgtccacctggatacccattatactagctagatgagagagagtgttccaggagaaagagctggctggatcttctcccctagcatacagatcccaggcctcctcatactcctccaggcttctaggtgacagaaggaaagaaagagcttgccaagcctccttccgtgagagagtagcttgtgtgttttttaaaaatagctttttattatagaaaatttcaaacatataaaaaaaagggagaatagtttaatgaacccccatgtacccatcaactattaccaacattttgccaatcttgtttcatctatttcttctcacttaattttatttttatgttttctagattattttaaaccaaatcaccgacatacattttacctgtaaatacttcagtatgcatctctttaattaggacattaaaaaaattatcatgccattatcaaatctaacaaaattaacaatcattctttacattgtctaatgctcagttcttattaaactttttatgattgtgttagcaacatctttttagagttcatttgtttgacataggagtcaaagtttgcatttggttattatgttcccattctgtaatagtcccttttcctttttttctatgccatttattggtagaagaagccaggtgatttgtgctataaaatgccgagtggctctttttgttattcacctgacagccctcaccctggtgcagtgactccactcttagaaaaagtgattgaattgggaacacatctcctccttagggatattttggtcttggtctgtctcatctttgagaagaggagaggggccctgaagtcctgccaccaagtcctgttgattctacctcctgattagctcttgaatccatccacttctcatcctaatctatgctccattcattatactaccacagagtggtccttccagaatgtatgtttgattatgtcactcttctgtttatagttcttcagtaacttgacatgctattaggataaagttttaattccttaaaaccatttctggccgggtgtggtggctcatgcctgtaatcccagcactttgggaggccaaggcgagcagatcatgaggtcaggaggtcgagaccatcctggctaacacggtgaaaccccgactctactaaaactacaaaaaaattagccgggcatggtggcaggtgcctgcagtcccagctactcgggaggctgaggcaggagaatggtgtgaacccaggaggcggagcttgcagtgaccagagatggcgccactgcactccaacctgggcaacagagtgagactccgtctcaaaaaaatatataaaaataatgaataaaaccattttttaaggcctttttgacttagcttctccagccttgtctattggcattcacccttcacactgtattatccactcatatctctcagcaccttgatccaccaagcactctcacctctaagtgtcacccatgttggcccctctgcctcatctgcttaactcccagtccctgcctgaagtcatggctgaaatgcccctccctgctctatgccaccatagcaccctcacaatactgcctgtctcctgcactagacttggtcctggagagcagggctgttcatgtcttgctcattgccgcatctccagtacctggcacagtgcttggcaccaagtatctgctgctacttgtcaattgcatgaatgaattattatatacatttctcacaagtaaggggggtagttgttcagagtaagaaagtacatgtgataggggcttttttatctagaaaacatttaataaaactagtaattttaataccttaagttggttttgcacatttcctcctaacagctcagaatttaaagtctgaagctaatacttgctttcgtgttaatttttttgaactttttattgaatggataatacgcatatctaaattaattctttgtatgtttaggatattcattcaaatttacctaagtcatacccttggttgcaaagagactctctgctgacctaagagagttatctgtactggggtcaaactgaagccaaagtcttaccgctgaacagagcacatttgaaatgctttcaaatgtgtgctgtttacatgcttttagggaagacggactgtgttagaagcctgtctgttgtgtttccacaggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcatagtaaggacttttaaccacttctaatgatcccaaacaagacctaaaatattgtggcggcagccaggtccaccgtgggggaaattacttggtctaggactgaagagattggatttttcctctgaattaccatggtcttctgacatcacaccaaagagcaacacagtcctctctttagaacagactcttctgcttgaacatcagcttcagtagctggttgcccagttgaattttctgttgcctcagtgatggaaaatggatatattgatgccatttcaaaataagatttaaaatgactctgtatgtgagcttgtagtgtgaatggtatcactgtgctttctgtatattttcaaatactgaattgagtcactgaagaataggagttagttaaggaatcatgtgtcaatggagctgggcacctgaattattaaagtagtatctgtttacaggagtattacatggtgtgtacacatcactcttgctaagatgaaatacaagcaaatggccatcaaggcacacaggagagcaaagtcaggaatgtagctaagccaacattactctgtactgatgggctatggactcagtgatgactttttttcctctcagagtgcaattgaatccttgtttggagcttccatgactgggattgcttattccttgtttgcgggacaggctctcaccatcctgggaagtactggaccagtgcttgtgtttgaaaagattttgttcaaattctgcaagtaagacatttgtttttctgaaaactctaaccagatttagtgattatgctgccaggattaaatgtcagggttctactcagtacagacaggcaatatcattttggattgtaagaaacctgaaaggagaccatcatttggtctgttgtcctgcccccgggtagcaccatacccaaaatagcagatctcctattgttaaagagcttgattaatattcctcagccattattgaagtcttgactttttatctttaaaaagactttccctagctaattcaaacttctccatttccattgtgagtcaatttttaatttggcctaatatcctccccctgctgtttttttttgttttgttttgtttttttgctattgatagtggggcacaagagtgctctggtttccctaattttcctatacaatcttttcttttttccttttatatttcaagtagcagctcatgggactatggccagcccctttttttcttaactgcaagaataagatcataattacattaggtagtaatggcaggaatgtatatgagacaatttctttttttagttttcgtatccttgcgcatatcctgtgaggcaaatctgtatcataactgtgccagagcactatttagaaggaaaatacaatcagaattagggataaactgggttccagtgctcgtttagatgaaatgaattaaccacatttctgactccttgtctcttaatgccatccatccatgcgttctgatgaactttggtcttgtttcagagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattagtaagtgtgctttctgcttatttttaaaaattgagcaaagggcctgagtttaattgctgatgtagagtgctaggcagtgcttacagcttctggtcaagaagtgtcttgccctttaggaaacggatctcagatacagacaaggagtattggagggctgccagaggagaacaatcaaaagtgttgacagagaagatcgactagaagtgaaacacgaaggggactcaagaaatgctttccagaccatgtcttttggttctaggcactgaaacaaaaatgggctgcaaatgtagcagggagaatttgagttagttatggggaggaacttctttttgcaaggactttgtgagcctctggactatgttatcaagtgagagaatggactctgtcctttgttgaaatgaaggactctctttctctgaaagtatgtacaggcaactcttaggaattattaggtgaagatatattaatcattcctttcagatccagaagtgtctcacactgtatcataaagatccaggagcctacttacttcctagatttcaacttaagagattatgatttctttatgtgttcaatatggtttggatcacttggaaaagaaacacggtacctggctgtgttttcaaccatctaggacactctggtcctataaacatttcttctctggaatagtattctccaaattatgactaaagatcctcttcccttagctctgtacatcaagttctggctgtacagttctgatgtggaggatctggttgtgaaatgaacaacttcagtctgaaactgtctcagaagagagagtacactttctggaggcatctgcggaccagcgacagatacactttcatctattctagttattcactcattaaccttttaaaaatcagaattaataaaaaatttattagaactttattttactagaaagtaacaatgattagggagtatcatcttcaaagcctagtgaattggctcctattggcattagagttctcatttctgtaaggttgattctttgacctctttttatcattattttctttgtttaacaaatatttattgagcacctattatgtaccaagcaccattttaggccttggaaacgcagtggcaaacatgacaaaggatctgtctttatgaggcttatatctgagaagacaggcaaagtgaccagccccggattgagtagactttggttccagaaacaaattctttgttaataaagctcaagatgatatttttttttagttgcattctactgttatttcatatggtgctgatgtgaagctagaactccttaactctttaaatgattttatgttaatatgtatgtaattgatttttaaaaaatagagtttattttttaaagcagttttaggttcacagcaaagttgaacagcaagtacagagagttagcatataccccctaccccagcacacacacagtctcccccaatatcaatatcccacaccggagtggtaagtttgttacaatcagtgaacctacacagacacatcattgccacccaaagtccatagattacattagagttgactcttggtgttgtacattctatggattttgataaatgtataatgacatgtatcctccattataatatcatacagaatactttcacttccttaaaaatctcctgtgctctgccagttgctctctccctacccccaactcctaacaactactgacctttttatgtccttatagttttgaattttccagaatatcatagttggaatcatacagtacgtagccttttcagattggcttctttcactttgtaatatgcatttaaggtcctctgttttttcatggcttggtggttcatttcttcttagtactgaataatattccattgtctggatgtaccacagtttaattatttggaattgatttttttaaacctaagtatagggctttatagctttccctattacttttcgttttgtcaatttcttcctattattctaacctgtcgagagctttttgaattttaattcagtcatgccgtatcttagaaggcatgcttattaaattcacagaccatacaaagttagtggtgttggctgtgtcagttgaccatattgggagccaggtcaggcatgaagcatgctgggactgggaggcaacatggtggccaatggcacaggtgtggtctggtctggtctggtttggctggagtaggaggcctggggaagctaatggagtttctaggtctggctctaccatgagcggccagggaatggccaaggtagtggggtattaccaaagataactcagtgtcagaaagtgcttacatcacgattccaggagactctgacttttagaacaagagcatgacgaagggtatagagaataagatattcaggcttggaagaagttattgagaagtaagtgggatatcgagacctccttgctatgtagactaaatttcatagcaagagcctaagagatagaaatcgggcaaaaacaaaaacaaaaacaaaacaaaaacaaaaacaaaaaacaaaacaaccaatcaagactcattctgggcacatcagatgccaaatgtggttatcagcacagtttaatccaagacccatgggctgatttgagtcaaacttttgtaatgactgactgaaaaattagaatgtgatggggcctacagaggggcctcagctcctcaggtctgaagtatgcaaagaagcagcaaggcagctcctgacagcctttaaaccagttgttctaaaaacatttaactgagtatttggctgttttcctcaggaatctttttaatttttcccctcagctgcaggtgtactctgccagagaatccaaacaatcacaccctccagtactggaaggaccacaacatcgtgacagcagaagtccactgggctaacctgactgtcagtgtaagtctgggagctgccagatgtcctagcattgtgaccacaggtttaggagggacttctaagtgaaggggaggagtagccctttggccaaactctggcatttaccgaaataaagctttttaaaaaacaattcttactcactttcttttatcctttcagaatttttcttgtatgttaagggagaagattacccttctcttttctcccccctacatcctacccagtgaccctgcactaaggataggtggggatgaaaccatgcaggacagggggcagatccagacatgtagggttgaagaatgttcaagtttggaggtcctctgtgataagaaaaatataagttgccagggtccttccagagccttggaagtagtattgttcagaacagttctatgtcttaggaccataagtaaccaccctacttgaaagtggcctgtgcaagacagcaccccgcaactgcataaaggtcaaggggatgctgcttgcagcctctgctcccaacaaccatgggatgacaatgagtggtggactcagtaggaaacagctatttatttggttgtgtctgcctttcatcacccagaatgcttattcctccaggaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtaggtagcatgttcatgcatttctttcacgttagaatcaaatataacagaaccttttctcagccttcatgctgcttatggggttgattggccaggtggagaactccagatgtcctgatgagccacactggcattctctcctagtgtctggcagcctctttcatagatctgtggttgggaatgaagggttaatacttaaaacctttttggtttacaagtgccagttaaggttaaggtggtagtgatggttttttaaaagttattaagtcttatttccagaatgctgttacgtttcatttccagaattctgagacacttaacacacaatagctacagctggctcctgaatacagtaaattgtcattgtgaccttggatactttaggggacccaaaaatcttctcccagggatggcttttttaatagcttatgaaatcactggcgacactgactgcagcaaccagcatgctcctgacttagtttgtatgactgtttgaaacctcagcaacctttccatgatgcagatagcattgtttgtattatgagcaaggcttttgccagttttggcagggcaagattagaggctgagtgtggagtagctacatgggccatttctttgaaagggaacttgagaaggtggagaatggctactgggacctcatcacagaaagttaacactgaaaagaataagtgcatgaattatttacatccttcagtcacatggaaacatctataataaatgaccattacatttgccatatcaaaaatataaaaggaaggtgggtgatctacagtgaccacaaagtttgtgccacagaagggccccctgaaggcctgggttacatgtacttttaccacagtataccaagctaaacctcaaacatacgaatcagtgagaagaagccacatacctttttaatttgccaaaaagttagaacagccagatatgaagaaatacattgtgtatttgtagtttatttaaagaatacactcatgctgggcgtggtggctcacacctgtaatcccagcactttgggaggcccaggcgggtggatcatctgaggtcaggagtttgataccagcctggccaacatgctgaaacccatctctactaaaaaaacaaaagttagttgggcatggtagcacatgcctgtaatcccagctactcgggaggctgaggcatgagaatcaattgaacccagaaggtggaggttgtagtgagctgtgattgcaccactgcactccagcctgggcgacagagtgagactctgtctcaaaaataaaaaagttaaaaaaaaaaagagcacagtcatttgatgccttctgatatagaactgagaagaaattcatattagtgatgatacactattgtagatagttttaataaatgtttaaggagaagataatataaaaaagggtgttcattttgctggcgagagatctaccatcagtacatcaaaaatggggatgtgctcccagtcctctattgggggataggtgctagtggccttcagagaaacctatttatgtggccagtggtgtggccttacctgcagtaaataaaaaaccttcttggtgtttcatatagaaaatcagccattgggcggggcattatttacggcatttttttttcattgcacacaataatttctgacctatacatgtataatacagcattttcttgtttttctttttcttttctttttttttttttttttctgagatggagtcttgctatgttccccaggctggagtgcgatggtacaatcttggctcaccacaacctctgcctcccgggttcaagtggttcttctgcctcagcctccaaagtagctgggattgcaggcacttaccatgcctggctaattttgtatttttagtagagacggggtttctccatgttggttaggctggtctcgaactcccaacctcaggtgatccgcctgcctcagcctcccaaagtgctgggattataggggtgagccaccatgcccaaccaatacagcattttccataaaatatatttttaatttaaatcatacaaaaattcataatatgattttgtgaatgtgtgtgaaagtgtgagacctttacatttcactacaaaacctgtgatggtttggtttttaaaggctaaacggttggtattaagcaagtaaatattttaatgaaactataactcaggaacagtttaaaatattagtttcccacttagatttcaaggcataaaaagggctgagtttatccctttaagtgctgtcaagaattcacttgggtttgtgatatttggtggtacaatgccaaatgcccacagcagcattatattgtactttgccaaaggtagacagaggaattctctatttctcagcagtcgtttccccaaaaagtataatgtttatttttagttaaaatagtcttgttttaccataccacatgatgactccctggaagttatcatgtgaagttccccaaattagtattttctcatctctgagctctttgcctgactccatttctacatttttcaggggccagaggctcatctctgccatttttccatgtatcgcctcctgatttgacttcactgattatctgctgtgactagcagtgttattttggatactttaagaatttcagatatggccaggcatggtggcttacatctgtaatcccagcattttaagggaggccgaggtaggtggatcaccggaggtcaggagtttgagaccagcctggctaacatggcaaaacgctttctctactaaaaatacaaaaattagctgggcatgggccgggcgcagtggctcacgcctgtaatcccagaacttgggaggccgagatgggcagatcacgaggtcaggagatcgagaccatcctggctaacatggtgaaaccctgtctctactaaaaatacaaaaaattagctgggcatggtggcgggcgcctctagtcccagctactcgggaggctgaggcaggagaatggcatgaacctgagaggcggaggttgcagtgagccaagatcgtgccactgcactccagcctgggggacagagcgaaactccgtctcaaaaaaaaaaaaaaaattagctgggcatgctggcaggtgcctgtaatcccatctactttggaggctgaggcaggagaatcacttgaactcgggaggtggaggttacagtgagccgagatcactctactgcactccagcctgggcaacagagcgagactccatcttaaaaaaaaaaaatttcagacgcaaagaaactttatatgatattataaaagacagtcctttccattttggtttatttcagtattttagttgcaacctgggattaaattggagtttcaaatgtgatgaaaagtagaatgataacattctgtaattttcctactgctctgcaccaaattccagagtctctggagtttgtatttcaaattactcagtcgaatgaaacaggatttattgctgtctgcttaacatatatttgtttggttgaaaggatttttccagaaactgtaggaaaatgaagcagaatcaactgggtgaaatatagtacaaacattggattaggatgtggtgaattgtgaacaatcaggattctggttgtgactggggcccctgtctcataggagcttaataccatgtgagccagggacgcagtgtccaaggcccatggcctggagacctggatgctggctgtggaccttgggcaagtccctcatcttccctgtgcctcacctcatctgcacaatgatgtgatgacacctgccatctctttccaattatgcttcaaggatgcagtgagatttgatatgatgacccaagagtagaaggtggtgtgccatggtgtgtcctagtttagcatgctccctgccttctcttctctgacattttattcaatttgggaacagatgggattggcaggaggggagctcatggtgtagtaatactctactaaagtgtgcctattggtattaccttctaatgttgagttggatttcctaaagcagcccactttgttactgaagttgctgactcctgtggaaatccccatactaagcagccttacaaaatccagtccccatagaataatgactccacacaggcgtcaaaaatggattgtcttcaattatgttacaaagcaaacacctttttgggggatggaggatgattgggtgtttggattgaaatgtagacaaaggggctgggtgcggtggctcatggctataatcccagcactttgggaggccaaggtgggtggattgcttgaagccaggagttccagaccagtctggccaacatggtgaaaccccatctctactaaaaatacaaaaattagctgggcgtggtggtgcatgactgtaatccccactactgggttgaggcacgagaattgcttgagcccaggaggtggaggttgcagtgagctgagatcgtgccactgcattccagcctgggcgacagagtgagacttggtctcaaaaaaaaaaaaaaaaagaaatgtggacaaatatagctagcaagtgtattttgagcaaaatacatattttataataaaattttataaataaactttgtaaaatcaatggtataaaatcaatatttaagattataggctatatgttacttaatttcattaaatagaaaaagaaattcagcccttctgatgcnnnnnnnnnnnnnnnnnnnnagggctgtttctacaaggccaagttttgtataaatggaatttttttttttttttttttcagatggagtcttgctctgtcgcctggctggagtgcggtggtgtgatcttggctcactgcaacctccgcctcctcccgagtagctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaactggagcaaataatggatttctttcttgcttaaaatgtatttatatgtatgtcttattatatacaaggcagatttccctggaataaaagtctagaatgtactgcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccatttgtatggaatcccaatgaatgtatctttggaaaacataatgtgtcaaaatttgtattttgttcattgatctaaatgcccgtgtaactaatcagaaatccaatttggctcagattgggaattttcttttaaaggaaaaaaatttacagaaaagactactggaagaatcatgttcaaatgacatttcacatcaatgtttcttcaatattttggagttgacttggttgttttctcctacctacaatagaatgtgcctgctgtttctctgtcgctcactttgggcttgcaggaagtacaacgggaatagcctgagcttcttgctccctgtataatttattcactttacctgaactgccttacctgcagttcatagtgagaacacctgggcttgtaacttgcctccacttttaagtgtgatagggccaagttgctttacctctctgggcgtttttctttaaaacgaatgggttaaactagatgagctcagaagtcccttcctgccctaacattatcttctatttttattttcctgtggttactactattagggtcagacatgtgaaatgtgagggaccatttagagatttagatgttatatttttggattattacagagtatacacccaagtttaggacctgtgtcatttttagtgtccccaccccgtttctatttctgttccatttgtctttactttctttgtaatcatctcattttttttccactcttgaaactcacaactttccagtccatgagcaactttgctaccatccccctcaaaaacaaatctatttaaaacaccctcctagaaaagcctctgaaccaccttcagctaaatctgtaacgtttatagaatattttaaaatcttaattcagctagagttatgatccccaaacaagtgctgacgaagctatcacagaaatgatgtctttttcaccttgtaggtatcattgttgctaaatcacatcagtacaggccttctgtggggagacagcagggggcaggggcaggactaggggatgggagtagataaaactgtgattctatcctttactttaggtaaaaaatcctaggttatgaaacaaggttctgggccaagcacagtggctcaggcctgtaatcccagcactttgggaagttgaggcgggcagatcgcttgagcccaggaatttgagaccagcctgggcaacatggcaaaaccctatctctacaaagtatatataaaaaaaaaaaattagccaggcgtggtggtgtgtgatagtagtcccagctactcaggaaggctgaggtggaaggatcacttgaggccagggaggtcaaagctgtagtgagctgtgatgatgttactgcactccagcctgggcaacagagtgacacctgctcaaaaacaaaacaaaaccaaaaaaaacaaagttctctactcttaagttggtatataagatgacctgcacagtgtcacagagatttcccactcagtaaatcactctgaaagagtttgcataagattctgtagatttgcagtatttaatgtggatagtcaatagctacatgtggcaaatggccacttgaaatttggcttgccaaattgagactgtactgtacacataaaatatataccagatcttgaaggattggtaccagaaaagaatataaaacgtttcatcaatattttatattgattacatactgaaatgacaatattttagatatatcgattaaataaaataataatttgataaatataattatttcacttatttttatattttttatgtggctactaaaaaatttaaaattagacataggggtaacgtacttctttgttttttgagacagagtctcactctgtcgcccaggctgagtacagtggcacaatctcggctcactccaacctccacctccttgggttcaagtgattctcctgcctcagcctcctgtgtagccgggattacaagtgtgcaccaccatgtctagctaatttttctatttttagtagtgacagagtttcaccgtgttggccaggctggtctcgaattcctgacctcaagtgatccacccacgtcagcctcccaaagtgctgggattacaggcgtgagccaccgtgcctggcctggctaatgtaattctattggacatgctactctacacttacatggtttggggtaggcagtgaaataccataggtagaaaaggtaattcagtgaagcatccaaatagacagaaacaacacaaatatttttgctggagtcaggagcactatgtggcacagaacacctcccagaaagcagaaaatttttctgcctgaaaaccaatgtatatgtaagaccccaagtaaaaaacaaaagcaaatgagccccaaactgtcttccctcagctttgcctgggagctgctatctttgcacttatttttctagcatcaggatattagccacatgagggagccaagcatatttgtctcattttaggcatcattcttttgtggttccccccaccccaggtattgttgagtctgtccaaagctgggtgagataccacacaagtcttgcttccctcagtgtgctgcttctctcggccttggtggaggctgagcctgttgccggtacccaccagcccagtaggttttgatgctgcctcctgaaagagattgtatttgtttcgttttgcactagtcacagttgttgtttaaactacatcaaatttggggggagaatatttgcctgtgatggaaagagagatagatgagttattgcttcaagtgttttaaaataaaagctattctcacacacaaaaaaaaaaaaagaaagaaaaagaaaagaaagggagctcaaatcaggaggaaatggtggtttttcctgtaagtgaggtttcagccagacacattttctttttctttttttcttttttctttttttttttaagtcagtagtggtttattaaatggttgtatcacatctggaaaacattattcaaaacatttattcagcgtacttcctgttcatattttagaagatgtaaagcaatgaaatttgctctaaataaatggcattttttttgccattatttggcatcttgccaggttactttttacatccaagttcaagtgatattttgttctcaaaataaaataattttcaaggtttggaagtataatgcgaaaattttaacagggattcttttttttttaattatactttaagttctagggtacatgtgcacaatgtgcaggtttgttacatatgtatacatgtgccatgttggtgtgctgcacccattacctcatcatttacattaggtatatctcctaatgttatccctccctgctccccccaccccacaacaggccccggtgtgtgatgttccccatcctgtgtccaagtgttctcattgttcagttcccacctatgagtgagaacatgcggtgtttggttttctgtccttgtgatagtttgctcagaatgatggtttccagcttcattcatgtccctacaaaggacatgaactcatccttttttatcagccaggcacattttcaatacagggtacataaatgggaggactcagttaattagatatttagtgtacacccatatatgactagaacacattcttagacttcagtgagcctacatggcagtcacgggaggtacatattaagtaagttctgggtctttgtttcctgctaggacaaatagttaacaagtggctgttctgtactgactacttgctcaggcctgggttaagtgctagggaggtgcaacagaaacttaaaagatagtatctgtcatcagataggaaggaaaaacacatgaaacaatcagatgctatatgcaaagtagtaaacagttggatgtcccctgggatgtacgtgccgtaggagttcagaggagaaaagggccactgggccccaggatggtcaagtgggcttcatgttggggatggggaggcagtggatactcagagaatttatattgcattcagagaagaactaacaaaaccatggaggaggaactggaaaccttgggcttcaaagcaaagtgaagtcaggctaaggtaccggtgatattacgtgtggctaagatatgttttgctctcactcttttggaagcttagattaaggcaggcacgggtcatttgccaggtactgtattttattaaagccacactataaagtgaggcagtccttttatgatggatcctaaattggatgggaatctccaacaaaatagagatatgtgccatggaggaaaataaagcagtaaagaagtacaggaagtgctggggtggagggaggtggccaattttaagtggtatcatcagagaagagctcaaagagaaggtgatatttgagttgaacctaaaagacgtgagggagctgcccaagaggttacctggaggaaaggcatgttaggtagaggcatgaacaagtacaaataccccgaggtgggagtgagcttggcatgtttaaggaaacagcaacgcagtctgtgtgtttggagcagagtgggcaagcaggagagcaataagagctggggtggggagatgtgatgatgccaattgtgtggccctcataggccaagaaggccttttgaccagaagccatttcagggttttgatagaggagtgacatgacccaacttatgtttcaaataattactccagtgactgcatttaaaaaacactgcagggcaaaggcagaagcaagttaggaggctgctaccattacctgaacaggagctggtggtgacttggatctgggtgggagcagtggcggtggtaagaagtgatcagactcgggatatgttctgaagggagagccaataggacttgcaaatagactggctattgggtatgagggagaagtggagttgatgctgctgctgaggtttttggctagcactgaggaccttggctgatcccagaaaatccaagttctcagaactagagtcccaacctggccctaaatgtcccaaacagaactcttcagaggatggtctgggttatgttagcatttgtcagagggttcattctccctcatcatatccacactttatgagcatcagttgggcaattaacatattcctgttgtttaaatttgcttgcattaattcaactgtaagatgaaaacattcttctgaggatttttaagccttttacaatactaacctcttttctactgtatttaacctgccaaaacatgtgtccacttctttctcatgccaggtacgctccatggtgagtgactttgctgttttcctcactatcttcacaatggtgattattgattttttgattggagtcccatcaccaaagcttcaagttcccagtgtgttcaaggtaaacagatctcagagtacttggtgcactcatgtaatttcatacattctgatgccaagtaaatttcaaaggccttttcatatcctaatcctgagttttacagtcccctaaatctgaaccttgctcctcataccttgtcatttagaaaagcaaacttcagacttggttgaattcaagacagaaaagccagagaacagaaaaaccaaggttgtttaatgaatgaaaagtattattattattgttattaataccacttactgttcttaatatgttaatatttaaacaatggaatgtgcacatttacataaatatattcaagacactgtggaaacatgggtctctggaacaagcctcgttaacagcactttcattgagcatcagctgtataagggcactgggaagaatgaaaaaggtaaaggacttggcctgaaccttcaaggatggtgccccttccttgaagggggagaatggaactgagaggagcctcatcaggagtctagggcccctgccggagtaatcatgacatctctttcgaaatcatctcaatctgatttcattgtttgtataactctctctaatatatggtatttttcaagaaactatacaaaaagtcaaacaaatgatcaatacatggggactccaaatagatttcagtttgggagcactgactaagtagacaaagaagatagaaaagctgagctcagttctatagagccccatagggtgaggggagagaaaatctgtgcgtactcagtgacttaagaagaattatgaaggaggaaagtgggagaagttggtgaggagaaggccgacaggaataaaggcagtccctgacttgcaaatgctcccttcagttgtccctttcctttctcttttttctctctacccatgaagtaggcctgttgaaataccttcttccatattgtctgaaaatttttaattttgttgaatttgctgaaatgccaccagttggaagtttatggactaaccaatccctcttgtaagtataataccttctagaatatggcattcttgcctttgtgtgaatgagcacaatcagctttctctctaatacctagctgagatcagtgctgcaggaggaatggattttgtctaaaaataggtaatatgggaacattaagcggtccttggaaaggttccaaagggataggcctaagatagtcagaaggcactgaatttctgggacatctgtgaagaacgcctctgggaggtaggacaggggagaaagggaaacgggagaatgtcaaagaaaatgttgctcatgacaggctccattttcaggaggcagagaagaagttttcttctttttgtctctccctattgtatcacatggcactcaactcccaagacccaatctgaaggctagtactattactaggggtatcacgtcattaagggtttatttaataagtttttgtgttggtctgagaacttaactaccacttagaacattgttgttagggaaacatagattctgtaaacttttagaagctaacccattcataattttggacttggtggtgttattaaagagtatttgaatcctagagtcatgactaataaggaaccaaatcaaatataacagtctgtgctttgtttcttgaatttgggtcaactctggtccagttggtatccctggccttttatcctctagcaccacttgccaaaaaagggcgaacttgtcttcctcagagtacactgcaggggtggggtaaggatctaggtgagtttagatatgttgtgaacaccccagtaagatttataaacagttgtattacaggggcattggagaggatcctaggtcaaacaaacccccaactttagccgtcttaggctccttctcaagtctctgatggctggacccctgtttcactattgatgggagaagccccttggagcaatccagtccattcaaagcccaagagattccatgcagatggctccactttgcctttatttatgctgtagacacacattatgtggctctggagagaagtcgtaggagaatagtctaagttatttatatttgtctttagaagtcattaaatttttttgacaacagatacagttgttaattatattttacttgggttaatgttgagatacacttgttttctctctacacagaggtttggaaagtaagtggaaggaagtgcaagattaatgaatatttcacaagaaattaataattgaagattgactgtttcaaaggggattcggaactattactgagcaaaaggggcttgctgcccaatgtgctagaagccaatactatgataccaggtttttgagagaagaaaagttttttatttcaagtttactaacaaggagacaggaattcagctcaaatctgtctccctgcactggctttactgcaataattagaaaatgtttagggggtggattctgggatagtaggttattggtagaaggaaaggggaggtctggaaagtcctcaggcattcatagttatctcttcatgctacctctgggtcccctgtgccaagggggtttcagcaagttgtttcttttcttatctaccatcctgcaaacccaagaatttctgttagtcattggtgtctttaactctttgggaaatggtttcagaacaaggtcatagatttcctaaggagttgctgtatttcatgccttttttttttttttttaagaacctcactcaagaataaaaagaaatatggatattgtgatccagtttgatatgttttaccccaatgactataacttaaaatacaaaaataatatattttcccccttagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaaggtaaaaagaggttctgacctagaaggctgctgtggcaacctgttacattttcgtaaaattttagggtaagcacatctagaccagaaattgtagaatctcatagaagaggttcataaggggtttccattctttaataacaaagatttctttggagattagagtggaacatggttgtatggtatgaaagcaacgtggactccattactctcctctcacacctgtggggaaggtgattgggtagagttcctggtgatccctatatagctatatgctttgggtcaagcaactgtacagcttgtcttcctgaggttcaggtgggggcctgggccactgtttcctagaggcaggtattctcccactggtgtctgttactatagtttctaggccgaaactggaaccctaggatcctagggaagtaacagagcaggcaagcaatatccaaatctgtcaaggatctgggggtatgtggtaggaagccaataaggacacttacctctaactcccatagtttctaccatctagaatggtcaagatgtggcagggtgtctggttaatcttccagagaagaatggatctttgaatgtgtaagactcagagtcagctggaggcacttggaaaaataatcaatattggcatatataggacaggctaagattcccctttttcttctttgtttcctcctaaccaggaggggctacaagactcctcttggatccctgaaccccttccttcttatccatacaccccttcatgctttgggcctgagacccgtagctcactgttctatgccctactacagctagcctactgatggtgacaaagactctgtttccccacagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaaggtaatcatcctttcagtcattcagcaaatatcaagggcctgatttgtgccaggaatcctgccaggtgctggaaatacagtggtgccaaatacttacaagtataaatccctgccctgaaagagtttattctagagggataagacagataacatgtagttaagaaaattagttaagaaacaaacatgataactacagaatgtgaatagtgatataaaggaaatacacagtgctttctggcactatagagaactgagaggggtctattttagtaggatggtcagagaaggcttctctgaggagatgctatttaagatgaggtggaggccaggcgcggtggctcacacctgtaatcccagcactttgggaggctgaggtgggtggatcatgaggttcggagatcgagaccatcctggctaacacagtgaaacctcgtctctactaaaaatacaaaaacaaaattagccgggtgtggtggcaggtgcctgtagtcccagctactcaggcaggaggctgaggcgggagaatggcgtgaacccaggaggcggagcttgcagtgagccgagatcatgccactgcactccagccagggcaacagagcgagactccatctcaaaaaaaaaaaaaaaaaaaaaagatgaggtggagccatgccatggatggtgggacatggcatggaaggaggggagaaaagcagtctagtcaggcccttaggtgggaaagagtgatatgtgttctacgaaatatcagggccatgtggctcatgggcattgagtcaagacaagagcacagtgcaatgagaaggaaagagaggcaggggcagatcatgtagggccttgtcgacagtgggcaaggtaacctttgaagggttttaacaggagagggacatgatccagctagtttaaaaagatcactctggctgaggtctagggaagaatagaagcagacagaccagtgaagctgttgcaggtgacagatgatggtggcttggataaggaagctggtagcagggacagataaaaacgcatggcttctgtatagcttggaggcagacccaaaggtctcaattgttgactggatgtggaatggggtgaggaaaatagaaaaatcgaagaaacctgttaggtttctgacttgaccatctggtggagtgtgatggcatttattaagatggaaaagattgtatgatttttgtgaggggtggggctgtgatcagatttggagtgagatgtctgggagtcatctaagtgaagaggctagaggagggttctggactaaaatataaatttgggtataaatttgggagtcaacagcacataggtggtattgaaagccgagggaatagatgagagaactcagggaaaagagacgacgtaaaagagaagtgggacataagagcagagttagaggttggatagaagaagaggtagcaacagagtctcagaaggagctgccagagaggtgggaggaaaactagggggatgtggtattagggaagccaagtaaggaaaatgtttcaagaaagagggattgggtagacacgtcttggaaaatgaagactaagctaaggccattggatttagcaacattggaggcctcaggttatctgacaagagcagagtcagtggattgcattagtttctgctgcctgtgggtgatttagaagtagaagcaaaagcagaagctgaccatgataaaaatcattttgttctgaaatgaaatgattacatgtaagttaaattacaggcctccatgtctggctcttcctccacccctgtctggggatgggcagacacacacacacacacacacacacacacacacacacacccctctttaacagaaatgatgccttttaaatcttccacaatctcaaaaatcttccaaatccttagggatttagtgcattttaacatggaacttttttactgaccagtgacttgaggcaggagttgggggtatcttatcagagaaggaattcagtggaactatagagtagaaatccaattataggtggctaaagagtgaataggagataaggaagtaaggactgcaggcaaatctttcaagaggtttttctgcgaagcaagatggaaaaatggcagtggctagtatgagaagtggggctaaaagagaggttttttttgttttgttttgtttttggtacagatagaggatactttgaacattaaaaaaatgttttgtgggtggaaggcctgcatctgggagattggggtgagaaggaaactttacggctgtattcccaggtgccagccattctggagcactgccttgtctcccttgcctcctcttcccttttttttggcaaatcttcaaccaccccagcctgtaccacaaatgcccttcaagggtgagaactgagagggatgggaaggatttctgaaccatcttcctgtcccctcactttccactcaaccttaccacccacctctcctgacacccctttcccacctcatattccctgtccccagcccaactcccactcccacctggttgaggcaccatctggaagagcctaaacgttgctgcttctccaagatagaaccatgaaggcgcggcagtggccatccctgggctttcccctagctgcttcaggacaattctcttaggacaactattcagtagttcacaaacaacatcgaattggaatgtctaatcactctacagctggaacataaaatccaatgggggattttctaattttttgttttttaaaattttactttaagttctgggatacatgtgcaaaacgtgcaggtttgttacctaggtatacatgtgccatggtggtttgctgcacctgtcaaccgatcatctaggttttaagccccacatgcattaggtatttgtcctaatgctctccctccccttgccccccaccccccaacaggccctggtgtgtgatgttcccctctctgtgtccatgtgttctcattgttcagctcccacttatgagtgagaacatgcagtgtttggttttctgttcatgtgttagtttggagggattttctaattccacaaattagatttgagaatatttatatagtcccaaaaaaactaaattatagtccaatttagttttcagctctgagactttccttgccttgattctataggcccaatttccctacctcagagtcaatctgaagattacctaggttgatagacatgacgtgatcagaaagtcatgttcaaatactgtgtggatgttcaagtgcagtataataatgtcggtgtttccccccagaccattacctctttgataagatacgtccccactcttgccctcaagccactggtcagtaaaaaaggaagcttttttggttcacgttaaaatacatcaaatccctgaggagatgattgtgagattacagaagatttaaaaggcattatttctataagagaggggtgcgtttgtgtgtgtgtgtgtgtgtgtttgtgtgtgtgtgtgtatgtgtgcccatccccatggaggaggaagagccagatgggtgagatgggaagtctaacttacatgtaatcatttcatttcagaaccaaatgatttttatcattgtcagcttctgcttttgcttctactcctaagtcacccacaggcagcagaaactaatgcaatgtgtctgcagctattttgtgactttgtttcattcttggagatttaaaagtgtatatagttttgagtgtgctatgataccaaatttaatttctggcctttcttgtccttttgtcttcagtttattccaatgccagtactctacggagttttcctttacatgggagtttcttcactacagggaattcaggtattgtatggttcagccagggcagtttcttctcactgcaagtttgcatgtcctgtccagggagggacagctccccaagagaagcacaaccagttcttgagaaaattgtttcctagtcttgccacttaggctattttagacatgtatttggatatagggagaaaaacagccatgttggcaggagagtacagagacttccagggtggtctggcttgatgtcatggctccagttattcattaattattcaacagacaatttttttttggcatgtattaaacattagttgctttgccaggtgctagtaaacttggatctgaaaggttgatcaagaaccaaactggctttcactcatggacagatctaggttagtgccaggctaaagtataaaaatggggtgtttaactttgggagagggttcattggcagaagagataggggaatagtgggagttgctcctggtaaggagatgtcacttcttgttatactctgcatttttccatccatcaactattgctctaagtctttcaaaaagaaaaatcaggagcttgtcattgataacttgggtattccagataatataataacttaggctgattattctttgtttgaatggaatgtcctatggccattcttttttttctttttttttttttttcctatggccattcttacatactgagttctactatgaacttgggcaggttatttaatctctggttctcttttttccttattgtaaggatgatcattttttatatatctaggatgttatgaggttttattttatcttttcactataaataatcaatgaatggctccaaactcctaaaacaagtaagaaatttggttttgataataagcaaaaagatgtaattggtttattttgttttcaacaccccctgagaaagagctctcttaggagacacagcgtgggataagagaaagaagtttgaacctagaattagaaaagatggattcaaattttgactttgccacttaataaccttggccaaattgcctggtcttttaaagtctcagtttccatttctgtccagaggaaatggtgttacctacctttcagagcaggtaatgtaagagatatgaattggtctaacaaagcttctgacccagaatgccctcctgaaaataaatgccagttccttcctttcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggtgaggtggtttttaaaaaataaattcttattatcattgttattttttagtggtaaaatattataactttaaaatttaccatttttaagtgtacagttgagtggcattaagtacattcacattgctgtggagctattaccaccctccagctctggaactttttacatcttgcaaagctgaaactctgcacctattaaacactaaatttccattctcccataccctcagcccctggcaaccaccattctactttctgtctctatgtattgattattctaggtacgtcatataagtgaatcacagaatttgtccttttgtgactggctaatttcttttctttctttctttcttcttttttttttttttttttttttgagatggagtttcactcttgttacccaggctggagtgcaatggcatgatctcggctcactgtgacctccacctcccaggttcaagcgattctcctgcctcagcctccctaatagctgggattacaggtgcctgccaccacacccagctaattttttttgtattttttttagtagagacggggtttcactgtgttggccaggctggtctcaaacttctgacctcaggtgatccacccgtctcaacctcccaaagtgctgggattacagacatgagccactgcgcccagcttgtgactggctaatttcatttagcctaatgtcttcaaggttcatccatgttgtagcatgtgtcagaatttccttcctttttaagattgaatagtatcccactgtatgtaaatactacattttgtttatccattcacctgtcaatgatactgttgtaaatatgggtgtacaaatatctgtttgtgtctctgttttcagttctttggggtatatgccaggagtggaattgctggatcatatggaaattctatctttaatttttttctaatcctctagatccacaccctcctggtgggtttctcaattttgtcaggctacatataagggtttgtattcgtgtgttacgttcatgggttaaataaatagcagattactgggaactcctagaagggatcctatcaattccagatgtattaggaaagtagtcactaaattagagagaaatgtacttgaatttaataagcctgatttgcctcattccttgtccagtcaccaattatagctgatgaacagcagtccacccaggcaggattaattctttgttttcctttggctaaaatggccctcatggaaagaaagtggagcagcagttgagatgccctggacatacctttatcggggaaatcagctgtcagattttaggcgagtcactttctctctctgggcctcagtttcctcatttataaagcgagtgtcaggccaggccagagggcaaagacaaaaaccactagagacaaatgatgcaggcccaaagcaaggatttgggtaggggaatgtataggcaaaggatcagagggaataaagatgatcttctaagagaacccatcatcccactgtgaggaatgcttgggtggctgtggctggtcccaccatggcccagctccagcagaggctttctacccacctgctgtcctgtagccttcctgctgacccctagccatctgcagatgatgtgctcatcttttcaatgacagaatccagttagctgctctctaagttgtagagctgttatgatagttaaaatactgtatgtaacacatgttacctggcacaaagaaagcattcaataaatggtgactgttaggattattatgagtttgattttgcttgaaatgtcctagtctgctgtgaaaataaggctttgcttttaagtccaggaaggaaattagtccctttaattcacttttttttttaatttttcttcaggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctctacaaaaaaaaaaagaaaagaaaagaaaaaaaatcaaaataattagctggatgtggtggcacatacctgtagtcagctacttgggaggctgaggtgggaggataccttgagcccaggaggttgaggctgcagtgagctgtgatcatgccactgcactccagcctaggctgagtgagatcctatctcaagaaaaaaaaaaaagatgacttttttttcccctaatatcttgaactttaaaaatcttgtatttctaaataagcttcaacaattataaaatataaagtcaatggaagaaaactttaaagagaatattgatagaattcactacataaaatgtgatgctttcaggcatccaaaactctaatcaaaattttaaaataacagataagttgagacatgttaatatccttactattcaaataattcttataaattaataagaataatatgaaattgaaatgagcaatggacatatataatttacgaaaaagaagtacaaatgaccagttgccttatgacaaaaatttcattctcactaataatcaaagaaatgattgtgcagcatctggattttatgaaatgaaaataaatattaaaaaataaaaaagaaatgaaaatttaagcaaggagaatacttttttacttgtcgaattggcaaagatttttaaaagataaaaacaagtgttggcaagactgtaattgaaattggcttctcatacactaaaaatagtaatataggctgggcgcggtggctcatgcctataatcccagcactttgggaggccgaggtggttggatcacctgaggtcaggaatttgggaccagccgggccaacatggtgaaaccctgtctctactaaaaatacaaaaattagctgggcgtggtggcaggcgcctataatctagctattccggaggctgaggcacaagaatcgcttgaacccatgaggcagaggttgcagtgagccgagattgtgccactccactccagcctgggcgacagagtgagactttgtctcaaaaaaaaaaaaaaaaaaggtaatataagttgcataaatctctttagagggcagtttaaccttagagtcttaaaaacgtatatgccctttggcccagcaactctaatttttaaatttatcctaaggatataattagcaatgtagacaaaatattttaatttgtggtgacataaagaaaaaaagaaaattagagtaaatgtattacaatggaatattgtacaacagtttaaaaaaatttttttttgagacagagtctcgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatgttaatatccttactattcaaataattcttataaattaataagaataatatgaaattgaaatgagcaatggacatatataatttacgaaaaagaagtacaaatgaccagttgccttatgacaaaaatttcattctcactaataatcaaagaaatgattgtgcagcatctggattttatgaaatgaaaataaatattaaaaaataaaaaagaaatgaaaatttaagcaaggagaatacttttttacttgtcgaattggcaaagatttttaaaagataaaaacaagtgttggcaagactgtaattgaaattggcttctcacacactaaaaatagtaatataggctgggcgcggtggctcatgcctataatcccagcactttgggaggctgaggtggttggatcacctgaggtcaggagtttgagacctgaccaacatggtaaaaccctgtctttactaaaaatacaaaaaagtagccaagtatgttggcgcatgcctataatcccagctactcaggaggctgagacaggagaatcacttgaacccgggaggcagaggttgtagtgagctgagatcatgccactgcactccagcctgggcgaaagaacaagactttgtctcaaaaaaataaaaataagaaagatatgtggacgtgtttctgacattttatgtgaaaaacatagggaatataaaatggagcatacagtaagactgtcaaagaatctcacttttactaaaacatatacatatacacataccgtacacacacacacgtgcatgtgtgcaccccccacacacgtgaaaaagattggaagaaaatacaccaaaatgtttattgtgttgctctatgtctctctagttggtaagattatacattttttgattaattttcttcctccatatttattgaatccttactctgttggtcactgttccagatacagtagtatacaggacacagacagtccctgaccgaccacatggagcttacattctcttggaggagacactgtcaacaagcaaacaagtctatatttgttttcttggttatagtgctataattctacacacacacacacacacacacacacacacacacgtatataattttaggtagtgatatgttttaagaaggtagggagtgagggagttactttatttaggatgattagagatgacttctgaggagacatctgagtagagacctgaatcaagtgagaagcaaattatgagaatatctgggagtaagaacattccagggcaggggtacagaaaatgcaaaggtcttgaggaggaatgagcttggtgtgtttgaggaacaccaagaaagccagtaagactggaagggacagagtggtagcagggagaccagctaggaggctggcagcagctcaggcaataggggagggtggcttatgctaaggtagaggtgatgaaagtggctgaattgggtacttattttgaagatagagctgacaggttttgctaatgatggtgggcatgggtgaaagaggaatcaagtatgactcttagatttttggactgaacaactgaatgaatggttgtgctatttattaagatggggaagaccaaggagaacagcaggtttaggaggaaaatcaagagatctcctttggatgttaagttcgaggtggctggtagacattatattccttattttccaaaattcctgaagtaagtacatatttgttaacacgtgttactttataaaattattttaaaagctaaatgaaataaaagaaaaaagtgaagactttttctccacctcatagccaacattcatgttcatttctttatgttgttttcaattttttaacatagttttcatataactatgataattatataattgtgagtttgtatttatatatatagcacatatatattctgatttttcccctcaacctgatttcataagacactttcatgtttctatttgtatcatgatattttttaaatggatgtataatgttctatagtattatctcatacttaatttaaatatttttcctttgttaaaatttttagttgttttatattactttgaacatctttgtacagatagttttttctctgtaattattttctttaaattagtgggattattttcttttctttttttttgagatggagtctcgctctttcgcccaggctggagtgcagtggcgctatctcggctcactgcaagctccgcctcccgggttcacgccattctcctgcctcagcctcccgagtagtcgggactacaggctctcgcccctgcgcctggctttttttttttttctttctttctttctttatttttattattattatactttaagttttagggtacatgtgcacaacgtgcaggtttgttacatatgtatacatgtgccatgttggcgtgctgcacccattaactcatcatttagcattaggtatatttttagtagagaccgggtttcacggtgatagccaggatggtctcgatctcctgacctcgtgatccgcccgcctcggcctcccaaagtgctgggattataggcgtgagccaccgtgcccggccagattattttctaagaaaacattttattatggatttctaaaaaaagttattttagattcagggcatgtgcaggtttgttacatgggtgtagtgagttatgctgagctttgggcttctaatgatcctgtcacccaagtagtgaacatagtaccccataggtagttttccaacccttcccctgtcttccgccttttggagtccccagtgttttttgttcccatctttgtgtccatgtgtacccaatgtttagcctccacttataaatgagaacatgcattatttggttttttgttcctgcgtcagttcacttagggtactggcctccagctgcatccatgttgctgcaaaggacatagttttgttctctttgtggctgcgtagtattccatggtgtatacatactacagtttctttattcaatccaccattgatgggcacctgggttgattccatttctttgctattgttaatagtgctgcaataaatatatgagtgcagatgtctttttgacagaacaatttattttcctttgggtatataccaagtaatgggattgttgggtctaatgctagttctatttttagttctttgagaaatctccaaactgctttccacaggggctgaactaatttgcattcccaccaacagtgtagaagtgttcacttttctccacaaccatgccaaagtctgttattttttgactttttaataatagtcgttctgactgatgtgaaatggagtctctttgtggttctgatttgcatctctgatgatgcatgatgttgaccagtttttaatatgtttgttgactgcttgtatgtcttcttttaagaagtgtctgttcatatcctttgccctttcgcttctatgcaccaataacacccaggctgagagtcaaaccaagaacacaatcctgactacagtagccataaagaaaatgaaatacctgggaatacacctaatcaaaaacatgaaagcactctctagagggagaactacaaaacattgctgaaagaaatcagagatgattctctgaaaaagaagtcagattagaaatgattctctgaaaaagaaatcatctctgatttctttcagcagtgtgttttttgtttgtttgtttgttttgagacagagtcttgctctgtcgccaaggctggagggcaatggcatgatttcagctcactacaacctcctgctcctgggttcgagcgattctcctacctcagcctcccgagtagctgggattacaggtacctgccatcacgcctgggctaatttttgtatttttagtagagacaaggttttgccatgttgaccagtctggtctcgaactcctgacctcaagtgatctgcctgccttggcctcccaaagtgctgggattaaggcatgagccactgtgcctgacctctttttttttttgagatggagtctcgctctgtcgcccaggctggagtgcagtggtgttaaaaactggtcaacatcatgcatcatcagacatgcaaatcagaaccacaaagagactccatttcacatcagtcagaattactattattaaaaaatcaaaaagtaacagacgttggcatggttgtggagtgcagtggtgtgatctcggccgactgcaacctctgcctcccaggttcaagcgattctcctgcctcagccttcctagtagctggaactacaggcatgcaccaccacgcccgactaatttttttttttttttttttgagatggagtctcgctctgtcgtcgcccaggctggagtgcagtggcgccatcttggctcactgcaagctctgcctcccaggttcacgccattctcctgcctcagcctcccgagtagctgggactacaggcgcccgccacctcgcccggctaattttttgtatttttagtagagacgggggtttcaccgtgttagccagggtggtctcgatctcctgacctcgtgatccgcccacctcagcctcccaaagtgctgggattacaggcctgagccaccgcacccagccagcctgacgtctttcagcagtgctttgtagttctcttcgtagagatcttttaccttatggattattattatttttttattttttatttttattttttttttgagacggagtctcaccctgttgcccaggctggagtacagtggcgcaatctcagctcattgcaacctccgactcccgggttcacgccattctccgtctcagctgggactacaggcgcccgccaccacacctggctaattttttatatttttagtaggaacgaggtttcaccgtgttagccaggatggtctcgatctcctgacttcatgatctgcccacctcagcctcccaaagtgctgggattacaggcgtgagccaccatgcccggcctaccttattgattattttaaacctacaaaggtagaaagaaaaggcttcttattgttaataatttgtttatttgaattagcatccaaagaagagccatatattgcaattggttgatatctgtcttaaatctttttaggggttccctttccatttttttaaagttgaagaaacagggtctttgacctctagggcttctcaccatttagattttgctaaatgtgtcccttggtgtcatttaaaatgttcttctgtctgctatatttgtagtaaattggtcattagctctagaggtttactcagattgacattttctttttttcttttttgaatgccattccacatgtataaatatctggttgtctctcattttgtggtaactcaagtctatgaaagaacctaattatattctttataataaatgcacaatgaaattaggtagaaattgtggtagaagaatgggctggtgaacttatggtcttacttggtccaagatataataatgtttctttttcttccaggaggctgagaaaatgttagaaattgggggagacaagtttcccttagagagcaggaagttactaagtagtcctggaaagaacatcagttgcaggtaaaacttccaaacaccaaggagtttacttttgggttattctctaagtgttctggctttgtggtggtggtggtgtcacaagtgcagctgctggcataaagagctaaatattcagcctcccagttccatcctgtgaaaataccttttccatctcattgtttattgaatacctgctatgtaccaggcactgtatcaggttatgggaatcacaagaagagaggtaagaaagccaatgtactgagtgcctcctttgtgctgggattgtgctagagggtttacttatgtgttgtcagttaacctgtactcatatgaatatcactatccacatttgtataagtgaagaaactaagtcttagagagttttaggtaatttatccaaagttacaatgttgctgaatagaaagattaggattcaaaccctggtcgtcttctattcctcaaaccagtgctccttctgcctttctttgccaccttccaaagatgaaaaggatgtggtctttatttccagagagttctcagcctagtaggcatgaaatccaatgcttgggcaagcttttggggataggcagaaatagtcaatgttagcctggcttgtggcatctgtagttctgggagcaagggggaattgaactgggatcatgaaaattccttacttctgccaatgattttagcccctttctctatcaaacctattgctcaccacaaatgacaggaagctaaattggtccattcatggttttactcctagcatcttgtttctgaattggaagagatacacatagcacttgtgtacctctaggtaccataagctgaaaaacctagaggtcaagagggagcagagcaaaggaaaagagcaggatatctgggtcattgagattctgaagaatttactgctgcatcactgagttggttgtggtttatactgtgggggaaattaggacagtctttttcgtaataatagtcttggttcttaataaactttctacgtgttgttgtggaaggagccgtgagcttgatttatctggtggcaaagtaggaacaatgtttcccctgtaacaggatgctgcctcctctcttggcattttagaaggagataatctggcttgcagcaaacatcaaactattctgtttctaggaaaccaagggctgggttcaaggtcttgattctctacttgctgttgtttgaccttggatagtcacttagctctgagagctttcatttctgcaccttcaaaatgaggatgttaataatctctgttgctatgatagttaagatactaggaaagtcctttgtgaactatgaatagaagagatttggctgtttaaatgggaaaatgaatgaaaaatgcctggcatgcagcaagtgctccgtaagtggtagttcctgatgctacactgttgatatcatagtgttgtcagcagcatctccagtgaggcccttcggaggagtgcacagttgtgggagcaggactggctgccacctggcacaccagcccagctttcagcaccacctcatgggccaccttgccattctgacctcagtggctgcaggagaaagatcagactccatcttgttccccgagttcctgagagctgttggctgcgtggtctcaaaccccatcttctcccttctattgggacagtgatcattatagactgtggtatgtattttacttgtatgtctgacattcactgtcctaatgattgatttcagatgtgacccctctgagattaatatatctgatgaaatgcctaaaactacagtttggaaagctctcagtatgaattctggaaatgcaaaggaaaagaggtaaagagaactgtaacatctggtttttatttatttctggcttttgacaatggcgatattgaaggtaaaatgtgttttagttgtaaaatggaatttgtgtaataaatagcacttccaggaactgccgctaaccacataagaatagctataagccttaaaaaagtaaaaatgttttctaaatatttggtcagggtgttttaagcagcccgtttacacaggtccaaggtcaggaagggattattttggcatataaatttgctttgcctgtttatttcctttaatcctctttctagttctcatttcagaatctgaagggcatgtctctggttactgcaaccacacaaagtaggaaattgctaaaatattcagatagtgttgatagtactgatacattctttaacctatttcacttgttacataatgagaactaacaacaagtaaagatttttgaaatatt

SEQ ID NO: 629 - DNA, 3040 bp, Homo sapiens
tcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagaccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacatag

SEQ ID NO: 630 - protein, 987 aa, Homo sapiens
FGSAMPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 631 - DNA, 24251 bp, Mus musculus
  misc_feature (1)...(24251): n = A,T,C or G
gctcagtaaacttccccgctgtgatctcctggccttcccagaatgcctctggtcccctctgagcgctcaattcaacgacaggggtgctgggtcctggcccctgagccttagagactcaaaactgcaaagccattttaacatcaaccaaaacagaaagatccattccatttcccccccccccccccccgtggtgtttgtttgttttttggaggcagagtatcgatattcatctcaagcttcctttcactgtgttgtctgcagccacagatcctcctgcatcctcctgcttccgaaatgctgggatcaatgtctaccagaaagcatccgaacttggggatcatggtacatcacttctgtaatctcagagctgcagacgccgaggccagaggatcaggagcacaaggccatcctcgagtctatggagaattttggtttcttttaaaacccagttatgttgtgggaatgagtgtgtgtgtgtgtgtgtgtgtgtgtgtgtgtgtgttgtgtgtgtgtctatacctatctatcttgccccagagaaccagagcccctaatcatcaagaagtagtctatatacaccccctttctcctctaacttctttctctccaacctactgttggggtttgtaataaaagttgggaggtagacgtataagaacctaataaagtagttttgtttttttaaagccaaaactcaactatattatgtagggagttcaagactacctttgtccacttgagactctttctcagaaaacacacatgagggctggagagatggtttgttggtgaagagcaattgctgctcactgctgtatagctcggggttcaggtcccatcacccctgtaaagccaggcatctgcctctaaccagctctgagggattacacctctggctgtgtgctaggagggccacatgcatataaatgagtaaataaaacccttctttaaaaccacacgaaaagaaagtttccaaatcaccaggaattcagaactaggataagaaaattacgtcaggatggtaggctcagaacccatgagcagccactgtcctaggtggcaggacgactcagaatcagacgcgagtttaagtaatttttgttatttatatatttatttgtatttattgagacgcgatctcctatgtagctcaggttggcctggaactcaagatctccctgcctccgccttccggagctaggttttaggattgtgccaaacctaaatctgcatttctaaccacctcgaaggtgttctgcgtgtccggaccgcatttctgaacctcactcggcaacctcccactgaccctacccttggatagcaggagttaggtactgaggctgggatttggctgggtgaggccgggcacttgccagttggcagttagatgggaggggaagttatctgttcacaacctcagacgcctgggacagagcctcggggctcgctgccgcccagcccgccctgagagctgctggcctcgggctctgaggtccgcagcccctccgccaccgagccagcacgttgcacaccgtggcttgctgctctcgccctgcggagcaggtggcttggagtggcgatggcctgggatgcgggtggccttgggtggcggtgacatggggtggcggtgccctggggtggagctgcccgcgatgcagtctggcctcggaccgtgcacccaacgtgagcggcctcgcatgccggggttgggagcggagtcacagcacctgcccgagcggggcggggcgtcatcctcgacaggacccgccctggacccgccctcccggtcgccccgtcgggaaacccacgagcagctcggcggcagcggcagcggcagcggctttgcctcggcgcggtaggtaagcagcaacgggtcgcgaccccatggtgccctcggacctggcagccccgtgctcctccgggactccctcccagccgtcccctcccccacccccctcagtgagatgaaggggctgagccagactcatcccccatgccttcgcttttcgccccgcgcggtgccatctagcgtctctcgcggtgagaccccttcacctctgcggttgagaagctgaggggcgaactgggagccccggaatccctcttctcctcgctctcgctctggtgcctactgtgtgcctcccccgatttgaccacctcgtgtgctcaagcgttgggactccttcctgccataccctgaacagaagggacaaatcaggagaagcctcattggtggggggcccctcagagtccttttcctgattgatctccccttggatgcttagcgctttggaggagtgggggacggagttctgtggtattgtgtagagtgtatgactgtgactgtcaccaccaacttcctgattctccctccctcgtgatgacagaaaggagaatcctcctgctacttgcccaaaagccagtcatctagagactccagaccactgcagagggctcgcctgattttgtggacactgctggcgattgcttgtctcaaagcacaaaaaggaacccggccgggtcttgagccgtaatcgccacagtggttccagggagagctgtaaggttgcactctgagctcatccctacaatgactgaggttaatgacagacacaccaaagagcctccagggctaccttcgcttcaccacaggtgtgtgtgtgtgtgtgtgtgtattacataggccgggctctcctgacaggacagctgtttccctgcttggcagagaaaagctaagaaggatgagataggcaaattcatatgatgactagatcaaggttttgaaatactcttcattcagattgtccaagggcagcctgcatcatcgcaggctccgtgtcctcatggacgccctgtgctttaaagaacccagaggtggggataccaggaccccacagcaatcgaaactctgaaagagactgggtactgagtaattactacccacagctggcactgcctccagcatacacaagagcccagcgaaagggaggccccctgggtgtcaggtgccctctgagatcagaactgtcttcgtccacgttcaactgggagaaacccagacccgagatctaaccataggctgagtcctgtttgcactgcctagaacagaagtcgggtttgggaggggccctgtcctcagctgttcgtagggaaggctgtggtgtatataatgaaggctacaggtggctgactcagctctgccactaatgtagctgcagaaccttggccacatcgccacgtaaacattccagggcggggcggggagcaaatgagaaggtgcaagggctttagggaccaactgaacataagatgtgtcgtggctttggacggacaaccctgagtgtgagtttagcctctggtcttgcctagctgtgtgcataaggctctggttccagtctccagcactggataaactgggcatggtggcccgtgtctgtaatgccagcatttaagaggtggaagcaggaaaacccaaggttcaagctcatccttggctacgtgttgagtttgaagccagcctggactataagactctgtctcaatgcaaaagtcaagaccaaagaaaacaaaatataacttgggtgagactttggtttgattttttattccatctttgtgctttgagacaggttctctcttcatagcccagattggcctagaactcactgtgtagaccaggctggactannnnnnnnnnnnnnnnnnnncatatacatatacatactccacacataacaccccacacactcacacacacatgcacacacactccacacatgaacccctccacacactcacacacacatatgtatgcacacatattcacacaccacacatatacacatatacttcacacatacacacagacacaccacaaatgtatacacatattacccacatgcacaccacacatatatacacaccacgcatgcacacacaccacacacatacatggacaccaccatgcacaccatcacacacaccacatatacacactgcaccacacacacactactcccccacatacatactatccacacacacgtacatactaccccccccacatatatactacccacctatacatacataatacacacacatactattcacacacacactatcccacaaacatccatactacatatgcacacatacatactacccacacatacatccatactatacacacacacatactacacacacatgaatactacccacacacatgcataccacactcctctgcagaggaatatataccttgggagtgggaggtggccgaacagtcagaacaagtattctggatgcagaaacttgggaaagaggacttagggtggagaaggacagggaaacaggatctccgtgtctgggcttgctctccatgaacgcagtgggaaagtcccacatggagaaagcgtggggagcaatcggcttttggaagaaagccgcacacccacccccacccccggaggcggcagcacacattcgtgcagaaaaccgtcttttctttggtttttagagaccagattcccttgagctgcgcacattctccatgtaactgacgatggccttgggctccctaattttatttttagatccatttattttctcttatgtatgtgaatgttcttgcctgtgttcatgtatgcatactctgtgcatgcctagtgcccacagaggtcaggagagggcattagagtcacgggatgggatcccacaggtagtcgtgaaccaccttgttctctgcgagagcagcagatgctctcaagcactgagcctcctctcctccatccatccagtccaagatttgaggatacaggtgtgggctgccgtgttctggcacgaagacttcattttatttgtgtgcatgtgtgtgtgtgtgtgtgtgtgtgagagagagagagagagagagagagagagagagagagagagagagggaggtcggattctccctggaacttcagctcacactcatgtgaactaacagatgccagggctgggaactgaacttggttccctgagagagcagtaagcactcttaacaactgagccatctcttcagccttggaaggcttcttgcaaaaaaaaaaaaaaaaaaaaaaaaagagtcacaagtaagaatttagactgtcggttttgttttgctttattgagaccttaagaagagaaagacagccatgccaagcatctggctaggctggaaggtaagcgcagacaggatgctgaccactggctgattttgccacagttaaatggccttagtctaaaggaacgcaaccagaactttgctgaccatgaggtagagatgcccaaagcaaagaggcactgtatctcaccctccaggactcagtaaggcagggacagtttgatgacagttttgagtggaaaggaagggcacatggaacacaggcacacacacaaacacagatatactcacacagacacacggatacacacacatagatacatagacacacagacagacacagacacacagatagatacacacatgtagacatacacacagacacagatacatatacacacacagagacacacagatacacacacatagacatacagagacagacacacacacacacacacagatagacacacagacacacagatacacacacatagacacacagacatacagacactacacacagacacacacagatacatagacacacatacacagatacacacacacacacacacacacacacacacacacatacactctgcacctccaacccaggaggcaaagcataatcagcagggcgtgggaatggacttggtaaccttgatactgagaagggattgaacataacagatgttgaagcagacctggaattaggggcacttgctgggaactgtgggaaactgctcagattagtgggcttggctggcagatgtaggcctgagggctatggaggggctatggctatccagccatcctggatgtccaagctcagttccccatcctaggaccatcgtcccatgacccccagcttgtctctaccctattgcccaccagccaatggtgacagagctcagttcagattccctgtgtaccttccttcaagccctgggaggttacagaggccctccctggagacctggcataaacaaaagtacaggtacctgacctagcaggctccctgcagacaaaccccctccctagctgcctgtcatcttgatttgtagcaactttggcgtgggggataagacaaaaagaaggaagaaacacctttacagccaaacacggatccagttacacgccgtgcgtgaggaaatcctgttgggtgttcagtagaaaatgtttgagtgactgcagttccataaacttaaaatgaacccgggtgtgtgggcggtaaaggcatttgacgggctggctaccgaaatggcttttatctcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatgagccacgtggctgtagagccggtccacgaaagtgtaagtcatccgtcatcggtgtgggagccgtccaccgaactgtggccgcacaggcatcccaggggcaggggagttttggagatcagtcggtggtcttttggtactatgactacaggagaggccaggctgcagggccagatgacgagaaagtgtcaatgaaggaggaggaggaggatgacgaggaggaagaggaggggaagaggaagaaggggaggaggaagaagagaaggggagaaggaggaggagggagaggaagaacaatagcaataagaggaagaggaggaggaagagggggaggaagaggagaaagaagatgtggagaaggagcaaaaggaagaggaggggaagaggaagaagggggaggaagaggaggagtatcagggagggagaagaggaagaggaagaggaagaagagaagaaagatgatgaggaggaataagaggagggagaggaggaggaggaagaagagaaggaagaggaggggaagagaaaagggggaggaagaggatgaggaagatgaagaagaggagggagaaaaggaagaggaggagggagagaaggaagaagaggagggagagaaggagggggaccagacagtcttgcagtacccttcccctcctggatcttgcaaccagcctgttccctctccaccaggatgtctacctccatacacctatgtgctagcggtcagagggcctccacccatagctattgaagagatctgtaattgagccaattatcttgagcaaatatcctgtatggataccgtggtggcagctcccttcccagaggccacgtctctactctctccatgaggtgtgcagttcatttgataaacaggaagaaacaaagaggccacctggccagcaagggtgtgttcgaggtggctgaccctgcctttcacttgagcggggacctcactccattcttcccagtttcagcatctttaagtatttgatccctgagtggaattggagagaaaggagtggcagggagggggttcggagtgaaaggggagtactcagaagaacccagtttctgtatatacctccatgggggaggtaagagtcccagggacataacaatgatctgagaactgaagacaggacctgctcctgggagctactatctgtgtgtcaccagtgaggtcatccaaccaaagccacacccataaaacaggctaaataccccatagggcagcaagctgagttacagcagaacaccaccctaacccaaatcctcgagggaagtgcacccagcgtagttacaaaaccagtgttggatgtttaacccctctagcctgttccactgataagaggctcagtcacagactacatataaccggtacttcagacctagccagtgatggaacagaagatatggcctggcctttggagtccaggagtccaggtccatggcaacgaagagagacacgctgacacaggccagctgtgatgagaaggaagaacaagcagagacaagaggccagacttggaggtgtggcttcctggtgaaaagcccttgcccagcatgtacaaaggcctgggttagctcctcaggactgagagaagaacaccaaagagaggtggataaagcgaacccgttaactttgttctggttttatgaatttcgtataattggtttttcatattccaaagatgacatgacatcagagacggcttcccgcaagacatgtcgctagacttggagcttaagtatgcgtggatagcttaaaagtcccacagtagttttacgcttataacaacatcagacgtttaaagcacatgaagtaacaggaagtactggacatgtggtcatttaaacttcagctagccttcatttagaaatataaattctgaaggccctcatgtagcccaggctggttacaaactctgtatagccaatacacctgaacttctaagccccctgctgccacctcctgggtgctgaggttacaagggtcactgtgcccaatttatgcagtgctaggaacagagctgagggcctcacatccttgacccactgagctacatccctagccccagttccaattttatatcaggtaatgttcgtcatcttccataggatgaaataatattaaaatccgatgattcgaaatgcataaactaaaaaggaaaaataaagtttcccaaacacccttgttaaatctgtagcatttatacctctgaggttattaaagctaagagctttggcacacgctgttcccataagaaattgccaagaagaaaatttaataaaggaatgcagtgtagtttgggggtttgttgtttgtttttatagagctaatgaaggcgcatgctgggcaagttctctaccacggagctatgtccccagcacaactgtttttaggcaaggtctcgttgtatagaccagacctggacctcactgtgtagaccaggatggttctggtcttagagatccacctggctttgtctcctgagtgctgggattaaagatgtgtaccaccaaagctatcttttcgtaattctggccatctttaggcctaacatttatgtgtaagactgttttttctgcatgtgagtctctgcactgcatgtatgtgtggtgtccttgaagaccagaagagggtgttggatcctctggaactggagttctgagcagttgtgagccaccacgtgggtgctgggaacacagcctatgtcttttgcaagagcagcccatgcttttagctccagtcttcctacctccatactctggccatttaaagacttctcatgatggtttccacacactggggctatttgacagtggcggcttggaatcagaatgtgggtagacgctgggctccgctcgctggagcagccattctgtttgttctgtctgggagggcttccacaactagggtcggggcatcttggctcgacaggctgatgagtggcagacccaagggaggaaaaagagctgggaatggaagttcgctcacagcaagggagggctgtgagctcacccgctggtggccccgaaggcatgcgcaggacttgggaggtggatcccaccgagccccgaacttaacaaagttctatattagaggttattccttttccaaagctggtggggctcaccctcctggtccttgctaactccaattctaggtattgcaacccacatggagcagaaacctttagccccaaagccctacagcataacgtgcaactgtgtgtttcttgaatggtgtcttccggttgccggcatgctgagccgacactggagagagcaagtcccttcctgccaagactaatcacaggtgtctcgtttcatttcaggatgtggttagaaccttgaggaactgcaggttccagagagaacactttagacggccggattggatccagagagcagatgctcaagagaacttcagtttagcccaaggtctctccgcgggaaatataaaggacaaaggtatccgcctctacaagggactccaagcagtgcctggatgagagtgctggagtgactggtgactccggaggcctttctggaggaggtgagtcctagcctgcctcttgactacttacggcagtgttacccaggctgtatctctagttgtacccatgtttatgggaagtaggcagaaaggtggatgaaatacaggctgcagggtggctcacgagacctgccttttcctctggagcgcggtctgcacagatctggactgaggttcacatatctcagcccctgggaaagaggctccacacacagttctgcttccccggaagccttcttgaggcctgtggggaatcctgccttcctcctgtctgtgtctgggacctcccattcatgttctctaaggagttttcccatcatgtgcctgtatcctaccctcagacctaagcaaatttttctggtaccacctctgccttcctcgtggcggcctcctgggtcagatctccaggctcctcttacccggtagtcaaggtgccgagcaggtcattgctcacctcagcagctcccagccattgtattcttcctggaaaaccctatactgttcctcatttctcaagagcaagtggcataaaggcagtgctgggcttcagccccacctgcaggctgcccttgcttctctttggcctcctgctcccttggccagcttggactgtgcttggcttgtccaggcaagtccacccaagttaggaacttgggtgcctaacccaggctttccccagtgtgacgttctgccctccgtcccccatctgccatctctacagactcctcctcccatccaaagatgtccccttatgatgctcttgcttcataatccggaatctcacttccccaactaaccatgccctccttgagtggagcccgtccccatccctgcctttccctagtccttcagagtctctggcacacggcaggtcttccacacatattggcagactcaatacatgcctcctagttctttctacaaaacaggaattaaaaaaaattatttattgggctggagagatggctcagtggttaagagcactgactgctcttccagaggtcctgagttcaattcccagaaaccacatggtggctcacatccatatgtaatgggatctgacgccctcttctggtgtgtctgaagacagctacagtgtactcatataaataaataaatctttttaaacaattattttgtgggtgcgggtgttttggttccatgtatgaatgcgtaccatatgcatgcagtgcccttggaggccagaagatggcgccggatccacagttacagacggttgtcagctgccatgtttgtgttgggaaccgaacccagaacctcaccaagagcagtttgtgctcctaaccgttgagcgtctctccaacctcaaaacaagaatttctttcgtgtgatttttgataatgcgatgaaagaaaccatctgtctccccagctcagaccgagactgctggccattgagtctatactgaccatgggtttgccctctgcatatgagggcctcccgacaccaggcttcactcaggcagggcacttgtttttttcttcagtgcagatgtaggatggggggtgaggtaagtggttactaccgcagtaaccaggctggttactactatagcccagagtcacgtttatgaaaaaacacccaaggtgtgatgccatggctctggccaaggagcacatgcctgggggtaatttctgggaaagcgcatggggatttattggttataacagcaacaatacctgagggtttagaggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacctttatgccgcttagctcccataggaagatctatgggcattcaccctctgagccttttggactgggatgctagctggtatgcctctcccacccacccaccccgtctaattctgcctggaaggtgttgtcattgaatcttagatttaaaacaatttaaaaaattatctaaactggaattagtggcgtgtgtttataatttcagcctgttaaaactgagacaggagaatcactaggagctactgtgagctacatcatgagaccctgtcaaaaaataaataattgcctctgaaggcagaggtaggcaggtctctctgagttcaaggccaccctggtctacagagtgaattctaggatagccaggactacacagagaaaccctgtcttgaaaaaaaacaaaaacaaaaacaaaaatgggctggagagatggctcagcagttaagagcactgactgctcttctagaagtcccaagttcaactcccagcaaccatatggtggctcacaaccatctataatgagatctgattccctttactagtgtgtctaaagccagtgacagttgtactcatataaataaaataaataaatcttaaaaaaacacacatatacatatatacctatatatgtgtgtgtgtatatatgtgtatgtatgtatatatgtatatatgtgcatgtgtatatgtgtatgtataatgtatgcatatatgtatatgtatgcatataatgtatatgtgtgcatatgtatatatgtatatatgtgtgtatttctatgtatgtatatatgtatatgtgagcatatatgtagatatgtatgtgtgtatatatatatatatacatatatatacacatgtgtatatatgtatatgtgtgtgtgtatatgtgttatggtgagtgagtaaacgcaggagagtccattggtggcctggctaattcataaatttttgtcttcagaaactggtttcattctctgcctctttgcagcttcaccacgcctaggcctccagggtcacacaaaccagtttaatctgacacactgagtgagccaggcatggtggtccatgcctctcatcccagtacacaggaggctgaggatcaggagttgaagaccagcctgggctaattagcaaaaccctgtctcaaaagtccaaaacaacctagggataaaagtgtaagtgcttatggagttcccgtcttggtccgaccctccgagccacgttgaccagtgtgttccagctgaactttattttaatggcaagctgtttcccaaagcagtttcctccaggtaagagagacccagacccggttttctcagtttatagcaaaaggaaatttaggcaccaggacgccttgcaaccattctccactgagctatgctcaggccccgagtccctacctccctgcccatctcagtaatggctaattttctcatatccctcttttctcaggttgagccccaggcgtggctacgctggcatgtcaagccatttccaaagtgaggcataagacttggagccgaccctgccggggtcccagttgagaagatgaggttgctacgaaggcgccacatgtccctgcgcctcgccatgctgggcagcgtcttcatgctcttcctcttcattcggcagaaggatgtaagcaaccaggagcaggccatggagaaaccgtggctgaagtccctggctggccagaaggaccaggtcctggacttcatgctaggtgctgtgaacaacattagggacgtcatgcctaagctgcagatccgggctccagaaccgcctcagactctggtctccacaaaccactcctgcctgcccgggttctacacccctgctgagctgaaacccttctgggaccggccacctcaagatcccaacagccctggggcagatggaaaagcatttcagaagaaagaatggaccaatctagagaccaaagaaaaggaagaaggctataagaaacactgctttaatgcatttgccagtgaccgcatctccttgcagaggtccctggggccagacacccggcctcctgagtaagtactgcgctcttagaattctctgagaccagagctttcccagaagtgtggccaggagggctgtggtcatcggccagttgtcaggaaaaaagccgaagaatccctgaatagccagggatttcccttaagccgtcttttcttttgctggcaagttgccctgatcccaggggctggagttcaggagtactatggtctagcagggacccacagggacccgtgagactgaaacacagttatggagggacacaggacacagaagaaggaagccagggctgtatgcagaccaggatctgacacagggcacctggaggtgctgggacagagctgtggtttctgcagccctgcccttaagatacttagcctgccagctgggcctctgatgagagagaggaaatttcctgactgctgctgtgtgggtctggaaggtccccacacccctgggttccctcacatgaaggccacaggcacaccaagtcattccaacttgaagttctttacattggctttagaacgggagacgcacatttggatcttagagctatcctcgccctaatatgtcccctgctacactctcactgtgccccgatgaaagatgttcttgtcttccacacttagccattgtccttttcaactaaagagttagttggaaagaaacaagtcacttcactaaagtcatgactctttagtgccaggggtcgggggttcctcagacttgaaccatgtatttcccaaggccctacaaattgcaacttgaggtaataggaacttctcagccagggcaggaaactccagaagttccgtggctggtccatacaacagcttcctgacaaggactgaatccgagtgtcagggaaactggatctggtatcacaagtctataatcccagtacttcagaggctgaggcaggagaattgcaaatgtgagagcactggttttcagtgggagacacacccccccatctccacaaaacaaaaagggtgttcagctgtgtggtccttgaaactggggacccaagtccttaccgagtctagatggcaggatagccaggtgtcgcacaatggttgctggagatcattgcggaagggcccggaagttgccagtgttggtagagtcagatcacaaggattcggagagggcttagaagggaagtgggaaccggaaggaccttttcctcacaatagtgactataatcactgtcctcaactgaacatttgcccttaatgactcggccccctggaacctctggaccagatcacgaactgtgcagtgttcaaggtgcagaatgagttagccgagggaatacctggcctgagagcaaagtgtaaaacttgggggcaggggcaggggtggggcctgagcatcaccttaggacacagagctagtgcagaggctggttttggagggggctggctagttacttgcatggaaggtaggaggatgtaaccgcagaagatgagcagttattcccaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtcctgcgctttgaattgcccctttataaaggcagaagaagaaggtgggatggagcatacaggccatagccctagagcctggaactcacccacaccactcagggcagcaagggcctccacattccctgttggaggtcacatgcatccctaactcagaggtgaaagaggaccagcaaagtggcttaccaagtaactgcacttgatgcccaagcctgttgacctgagtttgaaccccgagccccacaagctaccaactctacctgagggctgtgatttgagtgtacaaacagcacataagctaaataaggaaagaaaggtcggttggggggggggagggatggaggagaggagaagagaggacagctggctgggagggccttcctggtttccagctctgctggatctctctgttaggcttcccctgggaagtccttcctgccctaattgttaacaggggaggtcgctcaccatctttcaccttcccatcaattccatagtattcaggacccggctatggcctagacaaagggacgaggaaaatagaaaggtcccctgaggaagctgataaaggtttagagcactcctttagccaatctgaaatgacgtggacttgagagtccaaccctgggagatcaaatcgagctctgactctgcgccggacctctctcaactccactttccttccctgcaaatgggcgcacttgaccccttcctgtaggcgagatgtgaggtggggagcagcaggactggcatggggagggggggatggacacgctctgtctgtatttgtgtgtaggaagagagtgcattgtggaagtgtgtgcccaggagattttatgtctgcctggtgtggctatgactgcttcataatgggggctggagctgggccttaaaagctgagtgtctgaggacggaactttaggcagagagcattcctgtaagagaggatgttgtgagcccagtcctagagacaggagcttgtttgttggggagactgagtgtggctgaaattttggttcatcataggaaataagattggaaggattcaaggggtgggtgaaggggggtggggagcaggtaggggtaggggatgggagatgggcaaagggagtgggggaagttcagatgctaggatcaaacccaggactttgcatagtaaacaggttctctttactgttgctatcatgaagcaccctgaggagagactggaaagatagctcagctgtcaagagcactggnnnnnnnnnnnnnnnnnnnnctgtctgtaactcctttctgtgggatctgatgccctcatctggctccgtgggcgtgtacatggagcacaggtgtgcatgcaggcagaacaccccaggcacccaggaaaaaaactgagtctttaaataacactccaaaaaaagcaattcaagagagaaagggttaatttgaccttgaagtaaaggttttggttcactgtggtagaggcagctgggcatatagcagagagagagagagagagagcgcaagcgagcaagcagacaagcaagcaagcagggcctggagagatgactcagatgttaaaagcactgtctgttcttccagaggtcctgagttcaagtcccagcaaccgcatggtgacccacaaccacctgcagtgaggtctggtgccctcttctggtgtgcaggcatacgtgtaggctgaacatggtagacataatacgtaaataaattgtaaaaagaagcgacagcagagagcaggggagcccagtgctcagctcatgttctatggtccaggaagccagggaatgatgccacccacagtgggcggctcttcctgcttcagttaacctaaccaagctggtcctcacaggcatctcctgatagaaatgaggcgtcaccggggacctgtgctcatgcttcctgctcctgccagagctgctggctctcctacctctccagccgttcttggcctgggttgggaatgatgccgcaggagattggggtggtggaagtgggggctgggaatggactctgttgaacccccttgaccagggagctctcatgttcccagggaagacaggctcttggcaacccgagcaacgaggttacagcgagtctggttggcaagtgctaggcccgcgaggcttctggacagggaggggcttgcttgcagcagtgctcataatggtgggtttctgggaaatcgaaaaggagttaaagactctcagagggaagagtcagggcacagccacaatcaggcccaagcaaaacccaagtctagaagtgtaaacaactcgtggtctgacatccagaactcatggtcttctggactccagctccgtttctctagctccgccatatacagttggctcctctcatgggctcaagccagctccactccacagctgctgctaccattatggctgtcttgtgtggtattggcatttccaaaatgctggggtctgcacacaaccgggctgtactttcaccagtagctcttcttgggctcagttccaggaccctgacttggtccaagcctcagcaactgtccgtgaccccttcaatcctgggacagcttcagacactgaagcagcagcgacctcccctggcctctcacaatgccaagccccagttgctctccatgaccccttcatgcctttaacaccagtaaaaggctgacacatgagcctgggtgacgctgacacatgagcaggttcagctgccagcaccacagcttctgtgtgacgaccctaaggaaaccctccccagaagagtttgcttcagtgactctggcctcttaatcaaggccaaatctttagccccagctgaccagtatccatcgtcctagcaagcaaaggtttcacatgagtggttctggtttctcattaatcacagccaggtcttcacccgtagctgaccagaaacacagatccttaactcagaatatctcatggccccagtacaatgttagagactcccctgtggaatttcacaggccaggtctccatcatctacattgctctcagcattggcttctaactcagactatttcatggccccagtataatgttagagggaccctcagactcccctgtggaacctcacaggccaggcctccatcgtctatgctgctctcagcattggcttctaagttgctataacaaggctcaggctgtcaacacacattcatttccctaaaaccccattcctagtaccagtttctgtcatagctggaatttctattgcttcgataaaacaccatgaccaaaaacatggttttttgttgttgcttttggcttgtttgtttcaacaaaccaaatgaacccaaaagaaagggtttgtttcagcttctagttgttgtccaccatgaaggagagtcccaaggcaggaacccagaggaaggagttgaagccgaggttgtagacacactacttactggctttctttgcacagcctgctcagcctgcttatataacccaggaccacctgaccaagggtggcatcacccacagtcatctggctcctcccacatccatcactaagaaactgtcccacaggctttggtctacaggccaatcttatggagtcattttctcaattttggatccttctcagatagctctagcttgtgtcaagttgacaaaaggaagggaaagggagggagagaaagaccagccaggatggcaccttttcatagcagtcagctggcctgtgttcctttttttttttttaagatttatttatttattatatgtaagtacactgtagctgtcttcagacacaccagaagagggagtcagatcttgttacggatggttgtgagccaccatgtggttgctgggatttgaactcaggaccttcggaagattagtccgggtgctcttacctgctgagccatctcacaagccatggcctgtgttcttaaatacagtgtgtgtgtgtgtgtgtgtgtgtgtgtgtgtgtgcgcgcgcgcgcacgagtgcatgcatgtgtctgtctctctgtctgtgtgtatgtataatttttaaccatatgtattacatatacatgtgtgactgggtgagggtattaacacgtgagtgcaggtgccctaggaagccagaggatcccctggagatggagttccaggtggttctgagcagcatctcatgcaggtgttgggatccacactgcggtccactctgcaagggcagagcatgctcttaccacggagccgtctccagattccagacctgtgttctttctgttcacctcctttgtttgcctggggctcctcctcctcctcttcctcctcctcttcttcctcttcttcctcctccttcctcttctcctcctcctcctcttccttccttctcctctttcctcctccgcctccgcctcattttccttctgtgtataaatgtcttgcctgcatgtatgtctgtgtaccatgtatgcacctggcgccctcagaggccaggagattccctggaactggagttacagatggttgagggtttccttgaagatgctggggatcagacctgggtcctctggggatcagacctgggtcctctggggatcagacctgggtcctctgtaagagcatccagaattcctaatcgtggagctgtgtctctagccccgccccctcgctcttaaggatacatctgtcctctctaaattctcacccaagaactctagctcgtccccttcgttttctgggccctgatttgagaatgtgtgctatttccctgactggaggaatgtccttgcccatggtgacattcatcgtcacatgtctgcatgtgatcctagagacacgctatccaaaacccttcctcaggcctgacgctgagtgctgttacctggggaacagaaaaccaacctttgcacgtctgtccacacaggataaaattgcccacacatttgactgtttgatcagattaaccagttcttattacacacacacaagggctgtgtctctgagggacagtgttcctgctttctgtcctcctacccaggtgccccacagcagccctgtaaccatgattatatgagtatttgatacttggagcctgagtccagcctggaccacatagtgacaccgtgtctttaaaaaaaaaaaaaaagccaagctcacaaatgatctgattgacagttttaagtgataactctgaggcataggaagaaggaaggaggggcagggggagggggaggagggagccaagaatataattcagtcagtacagtgcttgctttagcatgcacaaggtcctgggttcaacctatagcatggcattaaccgagcatgatgccacatgtgtgtaatgccagggtgccggaggtggacacagaaggatcagacactcagggcgggtttgaaaccaggggcaggagagaggccaaggcctgaaggagagatgactcgacacttatgagcactggctgctctttccgaggacctaggctacattcccagcagccacctggctggtcacaactcctactctaggggatccaacaccttcttttggcctccacagaaatgacacatagcataatgcatatataacgtgatgcacagacatacatgcaagcagaaacatcacaaagtatttttatttgaaactcaaaaaaaaaaaaaaaaaaaaaaaaaggaaaaataaagagttggaggctgtcctggctgagagactctgaagagaaagtagggagagctctggagctagggcaatgtcctgtggcagagcactcaacctggcatgcccgaggctctgaactctggctccagcaccatcagacagtaaagagacagaggaacctgcaggcacggtggtggtggtgtttagttgcttggttggtttggttttggtgtttttcaaggcagggtttctctgtgtagccctggctgtcctggaactcactcgtagaccagactggccccaaattcagagatccacctgcctctgcctcccaggccagaaaactgcagtttaaggttgcttccatatctagaacattctgggagacaatatggagaagagtctggaagagcagttgactgttataactaaggcgaccataggaacaggttaaaaactaatccggtagggaaggggcagggagaactcagcttggctcagggtggagtggataacgggtgctggtgctgaggtcatgtggggatatggggtagggcatggactgaggtgcagagttttgttcaggtttgaggtaagttagctttctgtcagacatccaagtgaagactgcgaagttaggagggaagtcctgggtgcacagtatgagccatgggctgtgtagtgtgagctgtgggctgcacagtgtgagccatgggctgtgcatgtgagccatgggctgtgcagtgtgagccatgggctgcgcagtgtgagctgtgggctgcacagtgtgaaccatgggctgtgaatgtgagccatgggctgtgcagtgtgaaccatgggctgtgcagtgtgagccatgggctgtacagtgtgagccatgggctgtgcagtgtgagccatgggctgcaaagtgtgagctatgggctgtgtagtgtgagccatgggctgtgaatgtgagccatgggctgtgcagtgtgagccatgggctgtgcagtgtgagccatgggctgtgcatgtgagccatgggctgtggagtgtgagccatgggctgtgcagtgtgagccatgggctgtgcagtgtgaaccatgggctgcaaagtgtgagctatgggctgtgcagtgtgagccatgggctgtgtagtgtgagctatgggctgtggagtgtgagccatgggctgtgtagtatgagccatggggctgtgccatgtgagccgtgagctgcatggggtagaagaaaggggcatttacctcttgacctgaggagtaaggttgggtggtagtggcagaccatggcaactaagcctgagggaccatatgctggccctcctgtctcttactcagctgtgctatattctttcctgggtcttttttttccagtaactccagaggtgggacaaacagcaggtaggatagacagacagaggactgttgcagagagttgtctgactgtccttcaagggcctgaggaccagaacctgcagcctctagcccagcctcctgagactagaaggaaggcgtgggagagctgtatagcacagggcccttgaagtcacagctcagtgcttctcactgtctaaccacacagcccgcttcctgtgatgcttgcccgtgagttatctccaccaaggcttcctctggggaactaagtggggtctcagggaggcttccgctgagctgctgagaggatgaaggcccagctgggttcctcccttcctgtcagcaacaccaggttgtggccgggttgtggctcacatgtcccatgacggcaggccttccctacgaaggccagggtccagcatcgcacagtgcattgcagacacttgctaagtcattgcagtgttgaagccaccatagaaggctaaattggagcagccagattctggcaccagagacaagtggctccgtttctggagcaagacaagtccccctctcgggtgactgcctgaagtgtttcatttgcaaggctagtgggtcagggacacttgcctaccaggaggactggagaagacaaagcagaagagctcaagtttcaaattgtagtttctttccctggggctctgctctcccaggcagtaaccaaaggggagcttggcggaataaattcctttcacactctc

SEQ ID NO: 632 - DNA, 813 bp, Mus musculus
ggatgtggttagaaccttgaggaactgcaggttccagagagaacactttagacggccggattggatccagagagcagatgctcaagagaacttcagtttagcccaaggtctctccgcgggaaatataaaggacaaaggtatccgcctctacaagggactccaagcagtgcctggatgagagtgctggagtgactggtgactccggaggcctttctggaggaggttgagccccaggcgtggctacgctggcatgtcaagccatttccaaagtgaggcataagacttggagccgaccctgccggggtcccagttgagaagatgaggttgctacgaaggcgccacatgtccctgcgcctcgccatgctgggcagcgtcttcatgctcttcctcttcattcggcagaaggatgtaagcaaccaggagcaggccatggagaaaccgtggctgaagtccctggctggccagaaggaccaggtcctggacttcatgctaggtgctgtgaacaacattagggacgtcatgcctaagctgcagatccgggctccagaaccgcctcagactctggtctccacaaaccactcctgcctgcccgggttctacacccctgctgagctgaaacccttctgggaccggccacctcaagatcccaacagccctggggcagatggaaaagcatttcagaagaaagaatggaccaatctagagaccaaagaaaaggaagaaggctataagaaacactgctttaatgcatttgccagtgaccgcatctccttgcagaggtccctggggccagacacccggcctcctgagtaa

SEQ ID NO: 633 - protein, 179 aa, Mus musculus
GIRLGADPAGVPVEKMRLLRRRHMSLRLAMLGSVFMLFLFIRQKDVSNQEQAMEKPWLKSLAGQKDQVLDFMLGAVNNIRDVMPKLQIRAPEPPQTLVSTNHSCLPGFYTPAELKPFWDRPPQDPNSPGADGKAFQKKEWTNLETKEKEEGYKKHCFNAFASDRISLQRSLGPDTRPPE

SEQ ID NO: 634 - DNA, 46404 bp, Homo sapiens
  misc_feature (1)...(46404): n = A,T,C or G
gaagaagtggggacaggaaatatgagcatgaacttagtccatgcaaccattgcctcgaacagacctcaggaccaggaggggcagctaaccctagggctgagggcctctcagtgcagggaggcagtgagtatcatgaaggcaggcagctgactcagccctgtcactaacttcgatatataatcttagccaaaacacataaacactccctgggtggggagcaaatgagaaggtgtatatgaagtgttttggcaaagctccaagcaccagtcaaatgcaagacaatgtgatgtcatagttaagagagtgggctttggagatacataggcctgaatgcaaattctgcctctgccacatttctagctgtgtgaccttggtcaagttacttgacctccctgtgcttcagtttccttctgtgtaaaacagagaagataactgtaacttgatttgatatggtaagcagtaatatttaaaatggtgatggtattcttcttaacattttctggctcccacggatgtgttccgacatctcagccctggaagggatgctgaagaccaggttgggtgtgtccatgccgtagcttgggtgaactcagctctttacacagtcctctgcccctttctgggaaagcccaaatgttcattctcatttgataggaacgagagtgaggatttgaataagcaggaggttaagtgcagggcagtgcctgtctctgtgtcgagctcaatgttgtaattgtgctgtgtaaaaggcctgtgtggtgaacaagggtgagctcactccagggaggagaaggactgttagaagacttttgtggcacctgacagccctgtggggtcagcttattctctcgtaccctgaacaacttggtcctaaggcctaggtagagatttgaaggaagaaagcaacccagtcctcaactctgcacgtaatagagaatgaagaacagactagcaaaatagcattgccatacatctcaaggcagagagatgcgacagggattggaaggccaggtagattggtcaggaagaacattctggagacagaagtttggggaccaagactcaaggattgggaaggagaaggaaataggatctaggtggtctaccgtctaggcctgttggttctcccttctccatgatagttagtggggaaatcccacgtaaggaaagcacgggtagtagagaaacttgggaacaaataacacctaggaaactgaggcagcaagatgcaccttagtctaggaagccttcttgaaagaggggagtctctggtaagaatttgaaagaaaagaaatatggcttgcttagcaagaatataagggaaaggctttgaggaagaaaagatagccagtgagtgccaagcatctggttgggcttgagggtgagcagcaaacaggaagcaacccggccagcccctctgtgtttctgccacagtcaaacagtgctcaaggaatatgaatacggctgtcctgattgtgaaagagagagaggggcccgaggcaaaggaggctggcaggcagctcctgctgatcctccagatgctagttgataaaggcccaatttcaaatgaaggttttgaaagcagaaaggacagtgaggaacccggaggcagggaatgaatcagcaggacttgggagcgggtgtggggtgaacctgaaattgagacaggattaaaaacgacctgtctgagagtgggacaggggctggcttgtttcacggacttcaatgcttctggcagcaatggggaaattgggcaggctggctagcagaggaggctgggcacagaccctgagcccaggggatggtacattgagtagccagtggccccgggtgaaagttctgcagccaagagcagactgggggatgaggagaaaaggaaaaattcaattctagtctctcccattaagcccccttcccaatttgaagactggcccaagaggccttcgggaatacccctcctgtcttccacccttctcatcacttccctgtcccttctctgtcctttcccccaactctccccctcaagcccagtctcgttgtcaccaaggcttctaggtgattagagaatcccacctcatctccacctggaaccctccctccacttctgcactcctagggataaaccgttgcacacccctgccccacctggaagggcctacagggtctccagtgaaaaacctgtgaactgttgaacctcctgtttggtggcatattattttgatttttggtgactttttcttggaataagtcaacaaatattaaccaagtgcctaccacatgccaagcgctgctctaggtatacagtggtgagcaaagttgggttgagtttttcaatagaaaatccatgtttgggtaatttaagcttaaaatatcatgcaaacaggctggatgcattggctcacacctgtaatcctagtactttgggaggccgaggcagacagatcacttgaggtcaggagttcaagactagcctggccaacatggcgaaacactgtctctactaaaaaaatacaaaaattagccggacgtggtggcgggcgcctgtaatcccagctacccgggaggctgagggatgagaatcgcttgaacccaggagtcggaggttgcagtgagccgagatcccgccactgcactccagtatgggcaacagaatgagactccatctcaaaaaaaaaaaaattatgcaaacataaaatgaaccttgatatgttgggggaacttgacagactagctacagaaataattttcagcgtatcttcctgggaaaataagccacagtattgcagcttgagtcttggagaaaagctgaagtgtcttgaaggtgtaattacggggaaaaataaaaacctcccacattctgtgatcaaaagggtcaggggtgggaggagggctttggagaagataatttgctcttctgttcacagtatgagtacagaggacttgagatgagtgctgtgtttgatggagagaaagtgcttatgaggaagaaaggacggtcatttggccaaacagcctctcagccccatttcccccaacagtagtgtgaaattaacctgccccctccccaatatgatgtctagctccacacacctgtgcccgtggtaagagtggtgacagttatcactttccaaagaaacttgtaattgagccctcctctgagtaacttgagcaaatatcgctgtggtaaggactgcttgcttcctgctgccacgtctaaggaggtgaccagctcacctgataaatagaaagaaacattgttacaaagaggccacctggaaagctagggcatgttctggatggctgactctgacattcacaaaagctaaggctgcctgggacttccagtctccacatctttaaagcatttgtatccttgagtgggaggaaggcaaatgccaggaaggggatcaaagggtggagtcggggaggctcagggaggacaggcctggtccccaaattccctactcaacctccacgggtatgagtgtggtaaacagagtagtggtctaggagttgagagatcgggttctactcctgggagccactagctgtgtgttgctagagaagtcacctaaccattctggcctcgccgttgataaaatgagggtgttagacccacagacagacctagtcaaaacagcaagctaatgtgtaatggcagaatatcctgtaagtcaagtatttcttgcagtaagttcattcagaacatcatttagtgaagccagtgctccacatttaacccttccaacctcatctcatttaacaagagtttgtggaactagccaggcctgatggcacgcacctctgtattcccagctactcaggaggctgagataggaggattgtttgagcctgggaggtcgaggctgcagaaagctgtgttcatgccactacacttcagcctgggtgacagagtgagaccctgtctccaagagaaaaaaaaaaagtttatggaacacctgctatatgtaaaacttgtgctagactttgtaggtgataaaaagctggaaatggcatggcctctctggtccaggagtccataaacacagggtgggctgtgatgagactggagtacaaataaaaatcgggtgctaagggggcaaagcagggaagagatgaattctgctgggagatctgagaaggctttttggaggggggctagaatataaactgtggggtttggactgtgtcactggctttcaaacttctatgacttgaccaaagtgagaaatatactttatagcgagacccggtacctgtgtatatgtgacagggcatcccaaaaatcttagggcagttttataatttaatcacattacaagcataaattctgcaaaccataaaaactatcatttgaaaatggaatcatttaaacttcttttgtctttagttgtatgaattttgaataacaaatttatcattttaattttgtatcaggcagtgtgtatctttaatagactgaaacaaacattaaaataaaagtttacttttcaggctggacatgatggctcacacctgtaatcccagcactttgggaggtcaaggcaggaggattgcttcggcctaggagttgaagaccagcctgggcagcatagtgagacccccatctctaccaaaaaataaaaattagccggtcttgatgacacacacctatggtcccagctactccagaggctgaggtaggaggatcctttgagcccaggaggtcaaggctgcagtgagctgagattgcaccactgcactccagcttaaggaacagaatgagaccctgtctccaaaaaaaaagaaagaaagaaaaaacgaatacttgcctgtgttacatgtgatacatgatgcactttgatattttcttttcattctattctgggtttttaaaatttatttatttttattttttgagacagggtctcgctctattgcctaggttgtagtgcagtggcatgatcataactaactacagcctcaacctcctgggctcaagcaatcctccagcatcagcctctcaagtagctgagattacaggcctatgccaccacacccagctaactggtctctttttgctaattggtcttttttttttttttttttttgagacagagtcttgctctgtcacccaggctggagtacggtggtgctatttctgcttactgcaacctccagctcctaggttcaatcaactctcctgcctctgtctcctgagtagttgggattacaggcacatgccaccatgcctggctaatttttgtatttttagtagagaaggggtttcaccatgttggccaggttggtcttgaactcctggcctaaagtgatctgcccaccatggcctcccaaagtgctgggatttcaggtgtgagccactgtgcctggtcctaactggtcttttaaagaaatttttgaatgctaatttgcaacactctgaatttattttataatatcacagtggattgtaatcagcagtttgatacaagctgggctgggtaaagcctcagttccttacaccagtgagagaaggtaagtttgtgttctggccggtggggccagggaagcaaatcccatttgttcaatctaggcaggcttttcagagaggatttctggcatcatctcgggatcaaagccaaggatggtccaaagagttgcaggcccaagggtagctggaggaaaaagacttgggaagaagtgctgagccacagcgagagggaaatgagtggatgggggctgcgggcacacttgccaggaaagcaggaggccaggtgtgggagcccaaaggtgagggagatatacaagacaccaggggcggatctcgtgaagctttgtacttgaaacaatagcaaagaatagcagctattctttctccaaggctggtggaggggcgacctccacgaccttgctaaccatacttctgggaatcatctcctacacagggagcaaaaatccttaaccccaaagtcctgtggcttgcactagattctgtgtctcttctaagggactcttcctgttgccctcatgctaagcaaacaaactagagaatgagtgcctcaccaccaaggctaatcccaggtgtctcatttcggttcaggatgtggttagtaccttgaggaactgtaggtttgagagagaaagcttcaggcagccagatgggattgagagattagatgcctaggaagagctcaatttaaccctatatttctttctccagggaaaataaaagaagcaaaaacaggccctgctgtgagggaccacgaggcagtgccaggatgaaagagttggagtaacctaggtgattctgagtgaatcagtcaggaggccttcctggagggggtgagtcttgagcactggcaacagttagtaactacaatcttaccatgcctttgtttctaactgtgctccctctttcttgctggagtgggaaggtagatggaaagtagcagggaagacgaagcctgcaggacggttcaaagctgtcatggcaaacactcccccattctgcaggcctctgtgtgggcttagccgggacagttccagaactgatgaggtgtctagctcaagcaaatccccctgtgctagccccagcatagctcaacctctgtgacaagaaactcctgctacactgaatccccatttcctccccgaagccttcctcaaacccacagggaactctacctctctcagcttagctcttactgtctgtgctattctgctttaattttattcatttttgaataagtaatatagtcagggttcaaagtacaaaagagtattcagtgaaaggtccttttcctgctcctgaatctcccctggtcaggtgcttccttcacctggtcagtgctatcagttctcgttctccaataagattttcaaatcccttggggaaaggaattgagcctttgtgtccctctgtgtaccagacggggtaaactgtcccaccccatcacccaagggggtcttcctaggcaccataccctccctcttccatccacactgctactaactctcctgggtcagactccgaatgggtcatccagctgccaagcaggtccctttccaagataccctccaccgctgtcatattgctcttcctgtaatgctgggctcccagcttaacgctttattactccccatgccttgggtcaagggcaaatgctcctcagcatgatgaacaaggcccttaggacttggtttcagccacctctgtaggcccaatttctgctactcctgccataccagactgcttacagttctgtgactggctcttctgtctcccacctctagaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggtaatctctgtttaaaatctgatgcccccaattgactgtaggatccttgagggctggccttgcacttctctgtgtcccccgcctcttgcagagtacctggtagaggcagttattcagtaaatactggtggaataaacaaatctctcctatctcctagacaatagttaatacaaaatagatgctcaaagagatttcttttgtttgatttttgacggtgctgctgaatctgatgttataaaagaagccacatttgtaccccagtccagaatgaatccacctccccacttgagatcacgatggccacatactcccaaggtctcagacaccaggcctctccacaggcaggagcttgtgcgtttaaacaatagcattaaatagtacaaccagagttatttttaagcaaaacatgcagggagtaatgaacgtggctttggccaagggccaggtgcttgaggataactgctgggaagtgaagcagggatttatcataataatagaaatagttgataccatttattgagggcttagtgtgacaggtgctctgccaaacattttacctacattatctgatttaatcctccccacaaccctgtgagttaggtattagttgcccccactttatagatgaggaaattgaggcttagagggattaagtaaattacccaagggtcacacagctgctaatgatcaaaactaacactttgtgggaacttaccatgtgcagagactgctaagctttgtccatgaattttgtggggaaggagcataatccttgtaacaaccctaggaggtaggtgctactactagaagaggaagaactggaatttgtgcccaggtcccttgccattgatgtctagtgcttaaccagtgagcttatgtgtccagaactctgcacagaaagttctgcaagcattcatcctctagggcatggatccacatgcctgggggtggagcctggtgaacgcccatgcccagccctgccgggaatgtcttgtcatgaaatcttaggtttctgttaaattcttttttattaaataggagtagattacagataacttttatttatttatttttaaagacagaatctctctctcgcccatgctgaagagcaatggtgcgattatagctcactgcagccttaacctcctgggctccagcagtcctcctgcttcagcctcccaggcagctaggactacaggtgtgcaccactacgcctcgctaatttttaaaattttttattgagatgggctctcaatacgttgagcagactggtcttgaactcctgggcccaagcgatcctcccacctcagcctcccaaagtgctgggattacaccatgcttggccaagaaatatttataaaatacgtatagggtctaaagaattacagtccaccagcagccgccatccactttgagaaaaaaacactttgaagtcccccattaaccatctctaatcctgtaccgttttcttcatcttcagaaactggttatgtcatttctttagctttctttttttcgtggggagacggagtcttgctctgttgcccaggctggagtgcagtggcatgatcctagcctactgcaacctctgcctcccgggttcaagtgactctcctgcctcagcctcccaagtagctgggattacaggcatgcgctaccacgcccagctaatttttgtatttttagtagagacagggtttcaccatgttggccaggctagtcttctttagctttctttatagctttatcacatatttgtattcaagaacaagatattgtttaattttagcatgtttttacattttctataagtggaatcatactgtatgtatccttttgtcacttgcttttttcacccaacaacacatccacattgttgcatggagaagtggttcattcttggtcatcactgtagagcactgcacggtatgggtattttgcactttatttattcattctgctagtggacttaaaggttttaccagtttgttgccatttaagtcagtgttggcttaaatgttcttgtacatacctcttggtttgcatctaccagagtttgtctgggatataaaatgaggagtggaattgctggctcaggctgtgttcatttcaaatttttcttgataataccaagttgtttcccaaagccataatgattaaatctcatgagtttaatgattaaatctcatgtagtgtttcagtgttccagtgactctagatccatgcatattaggatcttagggcaggaaagaaacactgcctccggtctcctcattttatggatgaaggaaatgtagatatgggaaagttgtggccaataaggtgatgccaccactcagcaacagagcctggcctcgaaccccaagcacccgactccctccttaccctgtgttggctcacttctctctcttgtcccctcctttctcaggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtaagtagcacccagagtccttgtggggagaccagggctttgctaaaggcatggctagtatggccagggccatagatcaagggccagagaaagagttgaagggaattttataatatgggcaaggatctcctctatgcctcacttctttcccagaacaactgtgctgatcccaggggttgtgattcaagggtattatggtcaggccagaggcccagggagacctgtgagagtgaaatgcaattatgaaagtgagatgatgtggaagaaggaactcagcctggcaccaggacctggcacggggtgactggggagacctgataccaagctgtggtttcagtagctttctcctctactgaggcctgctccagagactgtgggactctaatgctgagctgtttggggggggggtgggcatttcttaacagcaaccctggtggttaggaatatcctcacacctggtttcctccagtgaaggcccacaaggccggaattgattccaacctttatctgaagttgtttatagcctcaatcttgcacaatgagatctcacttagatctttgagtggcagccccctccctctaacgcccccatggctgcattcccatgatcctcaagttaaagacagtgtgtcttccccacttagcctttgtcttttccaggtcaagtgttataccctatttggccttttctcaaatggcagccctcatccccagatttcgtgagtctttagggctgtgaacctgaggttcttgagacttgagccaagtatgatagccctagaacaaggggccacttgaagctatcaggaattcctcagcagagaagggcactggggccaggcacagtggctcatgcctataatcccagcactatggaaggctgaggtgggtggatctcttgaggccaggagttcaagaccagcctggccaacatggtgaaagcctgtctctactaaaaatacaaaaaaattagcccggcatggtagtgggtgcctgtaatcccagctactcagaaggctgaaggacaagaatcgcttgaacctgggaggtggaggttgcagggagctaagatcataccactgcactccagcctgagtgacagagcaagactctgtctcaaaaaaaacagacagagagaagagcactgggtgtgacagcagccagaggaggaagacagggaatctcttcttggagggtccccaagaaatcctctgaccagcagaggaggtcaaggaaagggtgtgaggtcacatgattccttgagatccaggattcacacattcccaccccaaccctgagatagagtgtcaagaaggtagcagcatggccaagtgccacagagtagctggagtggatgaagttggaagaaaggttgcaggaaattgactgtgatagtggtgtcaaatcacagggagttaatgagaaaatggattagagaggaactgtacgctgtaaagggaagagccttttcttctcattgagtatggaaatcatagtcacttttctcagatgtcaaatttggcctttattacctacccctctgggacctctggattggattacattttatgcagttcacatattacggaggaagagagccagccctgggaactcctagcctgagagcagatagcagatgaaggaagggggtggaggagcctcagcatcacagctggggcactgagccagctctgtggggatggattttggagtggtttggctagaacctgtgcaaaggctcagggtgggtggcagataccggggaagacaggaacagggaacagctgttcccacctgctatagagaatgtaggctgtggttcagaggagtggaggatggtctgggggagtctctggatggggccctccccacacctggtactcccagggaccaggagaactttgtccgtactttcatacttccaggtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagagggtgaggctggaggggcccagaggagggggccggggtctcccctgggcactcaaaggaggagggcagttcctttcaagggagcaggcaccacctcatgagcctgttgcctgacatcacagctcatcttaaaggccaggagcaggaagaagtcaggtaggggcaggtagaccatgcttccttcacacctcagccaaagagctccaagagcttttcagctctggcttcaagactccctgaacgctgccaaggccaaccctaactcagaaatgctgggagagacagggcagagggtagggacaggccttcacctctgtttcctacccgctgggccactcttctgctcttgaagactccccaaccagccctttttgccatagctgttgataggtaagtggggttgctcaccaaacttccagccttcaattccacaaacatctactgagtactgtgtgcctggctctgacccaggcagaggggatgccatgacaaaggagacagaccctgccctgaaaatactaaaaacccccataggtcagaagccttttttttttttttttttttgagatggagtttcgctcttgttgcccaggctggagtacaatggtgtgatctcagctcaccacaacctccgcctcccaggttcaagcgattctcctgcctcagcctccctagtagctgggattacaggcatgtgccaccacacccagctaattttgtatttttagtagagatggggtttctccatgttggtcaggttggtctcgaactcccgaactcaggtaatctgcctgctccagcctcccaaagtgctgggattacaggcatgagccaccgtgcccggccagaagcctcttacaacactagccacagtgctgtggcagtgatgcacctgtaacaggtgtgaaagggcatggtactgcagagtccaacacctaggaattcaaatcccagctctgacccttcctagctctgtgaccttggacaagcatttggcctccctgaacctgtttcctcttcaaaaaatgggggcagaccgggcacagtggctcaagcctgtaatttcagcactttgggaggctgaagcggacagatcacttgaggtcaggagtttgagaccagcctggccaacatggtgaaaccccatctctacccaaaatacaaaaaataattagccaggtgtggtggtgcgcgcttgtagtcccagctactcgggaggctgaggcacaagaatcacctgaacccgggaggcgtaggctgcagtgagccaagatggcaccactgcttttctgcctgagagacagagtgagactccttctcaaaaaaacaaaacaaaaaaaaggactgggcgtggtggctcacgcctgtaatcctagcactctgggaggccgaggcaggcagattgcttaaggtcaggagttcgagacagcccggccaatatggtgaaaccccgtatctactaaaaatacaaaaattagccaggcgtggcagagcatgcctgtagtcccaactactcgggaggctgaggcaggagaatcgcttgaacccaggaggcggaggttgcagtgagccgagatcatgttactgcactccagcctgggctacagagtgagactccatctcaaaaaaaaaaaaaaagagcagttgagtcccttacatggtgggtgagggatatgagataggtcataaatgagattcatgtgccacagagtggctggcatcaagtaagagtgtcacaagcatgcattccattttattcatggtacgagaacaatgcaccatggagtatgtagccaggaggtgccatttctgcctggcgtggctagggctggtctgcagtggaagccagattggagctgggccttaaaggatgagtgtctaagagagaagagtggatgaagggcattcccacaagagaatggcataagcacagtcctaaagacatgaatgtgtttgttaaagagatctggtgtggctgaagcttaggtttgtttaggaaatgagacttaaaagatgttaaattggccagggacagtggctcacccctgtaatcccagcacttagggaggccgaggcgggtggatcacttgagcccaggagttcaagacagcctgggcaacatgtcaagaccttttttctataaaaattacaaaaattagcctggcatgacggcatgtgcctgtagtcccagctactcgggaggctgagccagagcatgaccctgtctcaaaaaaaaaaatgttgaattgacattcatgtcatgctaaaagcatttatttagaaagtaagaaggagtcgttgaaagtgtttcatctgtactgtgacttcatttcagaaggatggcagctttggaggaggataatcggcaggaagagaggcagaggactcacagtctggagaggaagttcttacactcacttgagagtaggagatgatggggcctgaactaggaaaggctgtgggactgagacacctttaggctgagagtctccacaagcttagccctcctcgtaggaggcatgtggtgtctggggctctcccagattgacctcctgtgctcaaactcccaatagtgagggcaggaactgactccacacttcccagtgtaagcgctggggccactccagtagagctgcttcctgtccttgtcctcccccagcctccctccttcctctaggttaggggtgatgctgaaaagaggactagggctgtggaaggaagggctgagtgtgagccctgttgagttcatttcttcaggaagctcacatcttcccagggaagacagatacttggcagcacttataaagcaaggccagaccagcctgggcaacatatcaaaatcccatctctacaaaaataaaaaattagcaggcatggtggtatttgcctgtggtcccagctacttgggaggctgaggtgggaggatcacttgagcccaggaaattgaggctgcagtgagctgtgattgcaccattgcactccagcatggatggcagagtgagaccttgtctctaaaaaagatacaaataaagtaaaataggccaagcacagtagctcatgcctgtaatcccagaactttgggaggctgtggcaggaggattgcttgaggccaggagttcaagaccagcctgggcaatgtcacaagaccccatctctataaaaaatagaaaagttagctgggcacggtggcatgtgcctgtggttccagctacttggagggctgaggtggaaggattgcttgagcccagcaggctgagactgcagtgagccttgactgcaccattgtactccagcctaggcaatagagtgagacccagtctctaaaaaaaaataataaataaatcaaggcaagcaagtatcagggatgcaatgacagggtctggtggacaaggaatgtatagattaggcttctggaaagggaagggtgaagagtttggcagagatgggaggagcttggcagtgatctctagggaatctttgtagcaatggaaaggttgtatggaatggaagcaagcatattagcggtccttcctctcaaactgggttctttcgttatctttctcctcctaaccctatgctacccatccttcggaagctctttcacctgaatctcttgtactggagtgtattagtccattctcatttataaaggagagaggtttaattaactcacagttctgcagggctggggagacctcaggaaacctataatcatggcagaaggggaagcaaacatgtccttcctcatgaggtgtcaggagagagaagaatgagagccgagcaaaaggggaagcccctcataaaaccatcagatttcgtgagaacttactatcacaaggatagcatggtggaaactgccccatgattcaattatctcccactgggtcccttccatcacatgtggggattatgggacctacgactcaagatgagatttgggtgaggaaacagccaaaccatatcatttcaccactaacccctcccaaatctcatgtcctcacatttcaaaacacaatcatgcctttccaacagtccccccaaagtcttagctaattccagcattaacccaaaagtccaagtccaaactcccatctgagacaaggcaagtcccttcccctatgagcctgtaaaatcaaaagcaagttaagtcacttcctagatacaatggaggtataggcattgcgtaaatacaaccatttgaaatgggagaaattagccaaaacagaggggctacaggccccatgcaaatcgaaaatccaacagggcattcattaagccttaaagttccaaagtgatttcctttgacttcgtgtctcacatccaggtcacgctgatgcaagaggtgggctcccgtagccttggacgtgggggttctaaactgttaacttttcaccctaaactttgtgactctgtgagctgcaagtgcccaggtaggcaactcctctgactagctagacaagtgacataatgccaggctggcataggcagcatctaacaggcagagtagcctgtgttcagtagggcagagttggcagtagccccagtatcccctccagagcacccgcccctagcaggccaccatatacacgttcaccttctctctgtctgtcctggacttgttgccctggactctcttctaaagccaattctctccaaaggccaattccagcatctctaaatcatctgcatggtcaggacgcactggctcacacctgtaatcccagcactttgggaggctgaggtgggaaaatcacttgagcccaggagttcaagaccatcctgggcaacatagtaagactctgtctttacaaaaaaataaaaaattagctgggcatggtggtatgtgcctgtagtcccagctactcgagaggctgaggtgggagggtcacctgaactcaggaggtcaaggttgcagtgagccctgatcatgccactgtattcagcatgggtgacagagcgacaccctgtgtcaaaaacaaaaacaaaacaatcacctgcctgaaaaacctaagctagtcattcttatttttctgggtcctggcatcctttcagaatctgttaaaatccctagaatagtgcaccactgcccacaataatatgcaaaacccacatttttgcatttaattccagggaatttgtggaccctatgataaacaaccctacccagagggctttcagacgctagagatactttaagcaacattcagttcagtgaggaaaggaggaaaaaaccctcagatccatggtcagaaatctctgccgtccacagtgggataaaatttcccacacgtttgactgtttgatcagattaaccagctctcattacacacacacacaaacaggactgtgtctctgccgaaatacaatgtccctgctctctgacctccactccaggcacccagtagtagccctatgagagtgagtctaagggcatttgataccatgggggaggagaccgcgtgctgagctggggagctttttcttccccacctctgagtcagaaccagggcacagacctcattcctgagtggctaggtcagcagccagggttccctccctgtctggcacactccaccagcttaactaaattagagggaaaaaaaagaagaatgcagggcaatgggttagtgagtgagtaattagggagctcttttcaccggagtagccaggaaagactactcttagtactccctgcaaagggagcagccaacacagaggcctgaggcttgacttgttaatgaggcagaaagaagacagtgtggcttaaacaaagtaagccagggagcagaaagagtgctggtggagtgggtgtaaggagccgggcccatggctcatgcctgttaattccagcactttgagaggccgaggcaagagaacccttgaggtcaggagtttgggaccagcctggccaacatggagaaaccccgtctctactaaaaatacaaaaattagccaggcatggtggcgggcacctgtaatcccagctactcaggaggctgaggcaggagaattgcttgaaccccggaggcggaggttgcagtgagctgagatcacaccattgcactccagcctgggcgacaagagcaaaactccatctcaaataataataataataataataataataataataataataataattttttaaaaggctagcgggaccaaattgtgagacctccgtaagccaccgacagtgtttggatttttcatgtgtgtatgtagtaaaaggcacgacataaaacgtatcatcttcacggtttcagtccacagtttattgattttaaatgcattcacattattgtgcaaccatctccggaacttttttttttcccttttttaataagatggggtctcaccatgttgaccaggctggtctggaactcccagcctcccaaagtgctaggattacatgcgtgagtcaccacaaccagccaataacttattttttgtcatcccaaactgaaattctgtacctattaaacatgaattctccacgctgtcctccccacaacccctggcaaccacccttctactttctgtctctatgaatttgattatcataagtggaatcatacagtatttgtccttttgtgactggcttatttcacttagcataatgccttcaagattcatccatgttgtaacatttgtcagaatttactttattttttttgagatggagttcgttcttgttgcccattggcgcaatcttggctcaccgcaacctccacctcctgggttcaagtgattctcctgcctcggcctcccgagtagttgggattacaggcacgtgctggctaattctgaatttttagtagagacagggtttctccgtgttggtcaggctggtctcgaactcctgacctcaggtgatccacccaccttggcctcccaaagtgctgagattacaggcgtgagccaccaaacccggcccagaatttactttttaaggctgaatactattctattgtatgtatacaccacattttgtttgtccgttcattcgctgatggacactgaggctgtttctgcctttggctatcgtgactaatgctgctgtgaacattggtgtgcaaatatccaagtctctgctttcagctcttcagggtatatgcccaaaagtggaattgctggatcatatggtaattctgtctttagttttttttaaggaaccatcatacctttccataaggaaacaccatggatttgtttttaaatacaatttgaagccgctgtagtgacatgatctgatttatgatttttagagagaattttacttctcacagtagctgccgtgtcaagaatagattgaggagagtggtatagaaggcagaaaagcagtgactgtggggatgagagagagagctggcagtacctgcagatgtgctgattgtggaaggggacagcaggggggattctagcatgacttccaggttagagcagctggagggatgctggcaccgtgtactgacgtgagggagactggggggcagatttgcaggggaaattcagagcctgttttgggcatatgttgaattttccattttgttccacatccaagtgaagatggcaaggtcaggaaggaatccctgggagccatctgcatgatacttcagatcatggaactgagtgcggtgtctgtgttggcatcccaggggtcttgtggacttgagttgtgaggagtgaagctggttggggtggtggggtgttgaacctaagttggaaggctgtcacggcggggacatgagtgtgtggctgggctcaccggtacagctatgctcagctccagtctcctcagttctgggtctgtccagtaggtctgggggtggaacaggtggagtatcacgaggggcattgcttaggggagttgtctccccagaagggcttgaggccagaggctggaagcctctcaggctgagaatccctgggtctggcctcaccagactggaaggaaggcgtgggagaagggctttgtagtgctcggggccccccctgaggttcacagctcagtgcttcactgtctctcaccacaaaacccacttcctatgatgttttgtccgtgggttatctccactaccgtgaacttcctgtgcgcagagctgggcaagctctcggggaaacacagcagccatgctgaggagcctgggcttcctccctccttcctgtcagggccagcacccggggctgcaggtgcactatgagtctcaaagggcaggacccagaccaggcccctcccttcccagaacagcatctggcacctggcagcacattgacagacatttgtggagtgagtgctgggctgaggctgctgcatgaggctgattttgattcctgaggtcctggcccccagagataagaggcctcattcctggagttaagtaagatacagccccctcctcagatgactgcctgaagaatccattcataaatgagcgccatgtcataatcacctcacctgtctgtccagtaggattgaagaaggaaaaagtgggcggggcgtagtggctcacgcctgtaattccaactctttgggaggccgaggcgggcagatcacttgaggtcaggaattcgagaccagcctggccaacatggtgaagccccatcttcacaaaaaatacaaaaaattagcggggcgtggtggcaggtgccaataatctcagctacttgggaggctgaagcaggataattgcttgaacccaggaggtggaggttgtggtgagtcgagattgcaccactgcactccagcctgggcgacagagtaagactctgtctccaaaaaaaagaagaaaaaaaaaaaaaacatggaaaaaaaaagaaggaaaaagctgaaattccaaattatagagactttccttctcctaggcgccactctccaggacagtgactaaagaacagcttcaacaaacccctttctctccctttccctcccgggatctcacacacagggaaatggcaaggccttgggtgactgcgagaggaagcagagaccaccttgaaactcgggtgcattaagtccttggccttctcatcttaatctgctccagaataaaaaaatttaaaaaaaaaagtccgtggcctcactggtggtcaagagaccaccttgaaactcaggtgcattaagtccttggccttctgatcttaatctgctccagaattaaaaaattaaaaaaaaaaaaaattccatggcctcacttcccctggagggagaaggtggggagtcctcacatgcagactggctaggatcctgctgctgccctttgtgcttctgccaccctgggctagtcactttgagtcttactttccccatctataaacactggggacaatactccctgtttcatagagttgttaactatcatagagaagattaaataaagaagtcaccatgaagacacctacctcacccacaccggcacacactccagctcagtgctgggttattgtgtgcgtgcatttgtgggagatcaattgcatgcaaccccctaagctgcttaatttcaggacctgccgtttgtagaatgctgcattcagagcaaggcccaagctctgggctgatcccacagtccaaaaggaaaaggacacacaattgtcacatctgtcccccacatctgaaactgcaggcaactccattctgcacagaacagaaccgtggcagagataaaccaaaatggcagttagtaaaacatagtaaggtttggaattcggtatgtttcaagatggactgcttcagaatagagctattcttcgtttgttttttgttttgagacaagtcttgctatgtcactcaggttggagtgcagtggcatgatctcagctcactgcaacctccacctcctgggttcaagcagttctcctgcctcagcctcccgagtagctgggtttacaggtgtgcgccaccacacctggctaatttttgtttgtttgtttttggtttttttgagacggagtttcgctcttgttgcccaggctggagtgcaatggtgcaatctcggctcactgcaacctctgcctcccaagttcaaacgattcacctgcctcagcctcccgagtagctgggattacaagcatgcgtgcccagctaattttgtattttcagtagagacagggtttctccatgttggtcaggctggtctcgaactcccaacctcaggtgatccacctgcctccgcctcccaaagtactgggattacagccatgagccagcgcgtctggcctaatttttgtatttttaatagtggcagggtctcaccatgttggccaggctggtctcaaattccttggctcaagtgatccatctgccttggcctcccaaagtgctgggattacaggagtgagccaccgtgcccagccagaatagagctattgttaatgctctgaggatttcagactaaattacagggccatgaactaaaactcttctttgaaaggagctggaggtctcagtagagacatcttcccttcaaaaagctttccccgctcctcaaatccaggagatttggcccttctttgggacccacaccccagcactacctctgttagatcatggatcacctgccctggaattgcctgtttcctggtcagccttgcttctgggtggtttgttccttaggacaaatggtcaagccggctgggctcgccactgtgcctggtccatggtaggtgcttggtgcaagtattttcttaatataattaaaaagctgctgggcatgttttcaccttaaagaattctatctgcagaggaggttacaaaggggattagagtcagatgtcctgctgctgatccagcaagcaaggagtcaccatttgtgtatgcccacccatcgacgttaccgtgaagagcctgggagacagggaatcctagacactggaaaacaaccgtgcaatggagctgtggaattgcagctctggaagatggtggctgagagggtggagaaactgagggaggcatctgagagcctctgtcagaattttgtacttgggccgggcgtggtggctcatgcctgtaatcccagaactttgggaggccaaggcaggcgaatcacttgaggccaggagtacgagaccagcctggccaatatggtgaaatgctatctctactaaaaatgtaaaaatgagccaggcatggttgcacacacctgtagtcctagctactcaggaggctgaggcaggagaatcacttgagcccaggaggtggaggttgcagtgagccaagatcacgccattgcactccagcctgggtgacagaatgagactccatctcaacaacaacaacaaaaagtttgtacttgatacgtgaccacagaaacacaactctgaggtgctgtccctgacattagagagggtgcccaggtgaacaggcataggatctagcaccacagagccagagccctggtgaggcagttttgaccacagacagggcttctttcttcctctccccatcttccctgttaacctccttccccagctccggcttctgtggaatggctcagtacagcaggtgttgggggtttaaaattcaggcctgctagaggcctgagagcccctagcttggtgcccacaggggattgggtatacagcaaagtggtggactggccacaatgacactgtcccttccagagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtaccagggcaccggcctgggtgtaacctggaggctccctccctgctagaatgagccagggccacagcctccccaaggccccttcctgttctctcttccgggagtgaaggaggcttgggacccactccaggtgcctctacccctttctcaccccaatcccaaggatgtttcatcaagaagacaaacatccctaaaacaactggtgaccccaaaatcactggaagtgatttccagtgatcaccggggccccggacattcatccctccctgtactcccatctgcaccttgctctgagcttggcccctcagagaggcctcctgctatgacagaactggcttgtttggggctttcttctagggcaacatggagccaggaaggcctccttcttgcccaaaaccaaaacacttccccactgttgtggaggatgaaatattttccctaggagtggtgatatatattaggggaagctctagtcttggagtcagaattcttggtttgcattctgaccctgccccactaacagcctcagtttcctcatttataaaataggaatgaggatactaaccttactgaacagaaatattactctgagggccgaatgaagtaataatacgtgcagaagctcactgaaaatctcaaggagctagacaaatgaaagagattattcttctacgattagggctgaagcttgacatgcggatgcccctgggagggggaacaccctcttctgaaatccacacgtgggcccggagggctgggccaatggatcggctggaaccccggaagataccatccagggcctccctgtgcttttgggtcatctgagttgaccatgttactcccctgagacctccattctccctgccaaagctgcctccgcctttgggggtagaggggtggtagaagggttttaggaaattctgtgtgctccctgtagctgtggggcttgctgcctgtaacccaggagtaggtggactgtctcttatcctcctgggcattccctccaggatgcagcttgggctctgctgtgggcagggccctgactgctgcctcctggttggggcctgcaggtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaagtaaggaccgcagcctggtgagcccccaacctggccccagtcctacccagttccaggaacctgtgccatctcacatcaacatttgttaggtgctctatcaagcacttgacatattgtgattaatcctcactccctatgaagcaggtacaatactaagaatactaaggctcatagtgataaacactgacctaagatcatgcagctagcaacagtggagcaaggacacacttcccggactgtctggccctaaccgtggcactgctcttattcaccatgacagtttgctcttattcaccacttaccatgtgccaggcactgaactaagggctatacattctttagtttattcctccctacacataaaaggagtggcccatgcttgcagatggggcaagagatgtgatggaggccattgtggaatagtcactgtaataagagggagtggtatgtgcccccaggtgactgtctttgaaaagactgagaatatactaaaagaaaacagacacattttctgcagcgtgaagtttgtagcagttgccctgaacttctttggtgaagggccagatgataaatattttgggctttgccagccacatatagtttgctgcatattcttcatcttatttattttttattttttttacaaacattaaaaaatgtaaaaataattttttgccccagaggcttctaaaaccaggcagccagattttgcccacaggctcttgtgtgccagcccctgagctgcagggtagacaattggaagtcaacccacagtttaatgcccactgggctcacctttccctcttatactcaccccatcctcccctctccaggcagcctgttggtgttattggagactgtaagtttattttaacagttgtctcagacaaaccaagttgaggagtgacttttagtgtagcctgtggtttgggattatttgtgtcattgttatcttagactggccagtatacttaaggctcaactgaatatacatccaggacggagggatgcagaggttggagatacagtagccagagataagagggaaggtttgaaaggaggaaaggattggtgcttcttcctctccacgtgcccagaatcctaaaaaatgctgtccatgccaggcacagtggcccacacctgtaatcccagctagatgagaggctgaggtggattaggtggattgcttgagctcaggagtttaacaacagcctgggcagcatagcaagaccccatctcttaaaaaagaaaaagaaaaaaaaaaaaacctgctcagagtcccagtagaaaggaactcaggtgaatgccacagggagaaatcccacagatcctgaacagccagctgctctgtctccattagaaggagagagggaaaggaaaaggcaaaagagagaaaagaaattggaactttccactgacccaatgtttgtttcatagctgccttttgtttggtgtgcactgcaacagatccccacccccacccccatgccagtgaccaggcacacagcagcacagtcagaaagagggcacctggcccccacccatcactgacgtcgcaggcttcaatgtccaagggccatacaactggaagacaaagctccagtgtttgaggaatgaatgtgctccttggcccacatgccccggtagcatgcatggcttgccgaggctcttcatgtagcgcccccaccccaggaggactgctgacagtcccctcccggcctcccatctcaagccaaccagagcctaagaggagaggcagaggacctgggggattctaggggtaggccaggacataaagggtgtttactagaggttgcctgtggttgtgaatttacagtgaagcttcccatgcagggtttgtcctcatggctaatccatcagtgacttctcggtctgggagacttctcaaagacaagactcagggcctgtgggggaggaagcaggttggcttccaagtgctcctctgcagttccagcactctctgagcctctcagggtgctacttgtgccggtttaagacccctgggagaggccagagcctcttccaaagtgataggaagccagcctgagcacgactgaaattccttccagaaagtggctgcaggagccaacttcaggtagacaagagcaaccacagggtaacaccagggtcacattcctgggtaggcaccttgatggatcatgcgaatgaacagtgattgggccccagctgtgtgtaaggcacctagataggttctggggttacaggggttctgtatctttctgcttggttgtaccacatgaagctgcccactgagggcagcaaagccctagccatgccaggctggcccaaacagaaaccagcagctgatgattgtgctcctgccatgtctcaccggcccccaccccagcattccatcttgcttatacttccccgggtccgcttcgataccctaacgcttagcccagtccctcttcgaagcaacctggtatctaaattctaggaattagatgtttttgtcaatttatcttatcttgagtccacacctccctgcctgtgtctgaaagccagaatctttttataaccttctaaatgttccctgtagcccaaattgagcttgatctcacctgaccttccactgtttccaggagcaccttttatcagctttctctgttaaaagcaactggcaacttctccccaaatctacagtttctcatgcagtgtaaatcaccagggctaggcgcctactaaaactgtggcttaatagtccctgaggggcaggggccctgaaacagaatggagtcagcccagctgacaatattcattcattcatttattcatggtttgaatcctgcctattttcaaaaacaatttcacacagcttctgaaagttgagtatctcctaggctccaggcactttgctgccaaaaagtaactaatggtagctttaacctctgtgactagattgagctctgggggaataggatctgtctttctccgttctgtgtgtccatcatgtagcacgggccctggtggccagtgttacgtgcatcctaggttgaacgaatgaatgagtgccttttagaggataattacatatttccttgacctggtcctagaaggggaagaggacatagtaaaagctaaatgatgagtgagttagtggatgaggggctgcacgtcctgagaaagaggaaaggagggggaggtgggttaggaggggagtccacaaacagctttccccgccaggctccgctcctcctctcccagaagatgcacacacttctccctctgtctctccagatccccgacgtttgctggtggcctcttctccatctccaagtcctactttgagcacatcggtacctatgataatcagatggagatctggggaggggagaacgtggaaatgtccttccgggtgagagtgaagagggctttggggggaaccacaacatcccaggcgacagcttgagaaacatctctcaggcagaggtggcatcagggacatcccatctggaactgaactagaaagggtggctatttcccagtgtgtctcttcctcttttctgctccccctgtccatggcagtagggcttgggcagtcagcctggacagctcaaaacaaactactgggcacaacttctcagaggcaaggaataataggggtaatgaggactggacatctggtgactggggactcttttgcgatgtctgtgggaaagggttagggtgaagatagaaacaggttagtatgttcacaactagggctagaaaaaaaaaacagatgagtaaccagtcatcatcctttttctggaaaaatcaggctccccttcccagttcaaaggacacatgccctggtaacctttgaagtttccctacctatgtacaataagcccttcataacagtcagagaagatggtggccccaactctggtggaccccagaactctgagagattccaggaattaggcaaatcaggattaggtcaggaagcaaggattgcctctccatgaaacctacacaaatctccatgccatggaaaagtaattagtaagtagatgagctcatttatgaagtcacctctcacggtgcctgatgcatattaagcacgtaattgatgcctgctgttactataacgattatgtatttctgttgctgccacactaaaatgaataacaacatactttcccacctaaaacccaaaagaagaaaccagtgggagggatgtcttcagccagcccaccagcatagaaaagggtcacctgccagtcaccccaactcccagcggcccaatcctaggctcctccatgagcctctgacctctgttcaccttcctaggcagccagtgtgctaagggcccaagtgactaccactagccacctagcagccaactatccttgctattaattaacagactgatgctctggtttttatcacctgagggagctgataaactcacatttccaggtcaaaaagccaagtgatcagagctcagagtaggtatacaggcacaggtaacaaaaattaaccagcaggcttttccctaaagtgggccctggtaaacacaggaccctgcagtctccctgtgcttaagtcagagtgaaccaacatcagaaagcctgggatcgtgtagtcatggcctaggaagaagcctggtcggtatcctttttcccagggagagagagcagcatttgcccaagtccttggacctggggtctggtgctctgggaatagaatagagctgcttatggggagactgtctcacctagcccactgaaggcctcatcctgtctcctcttacatcaggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagaggtgagaggaaatggttctcggagaggtttagatgaagagaagtacggcccccagaccctgttcatgggcctaatggctgggacccacctcatctctaccatctggcgcctcccttcaccctcagggacctgtgagctagagcccaggagaaggccacaaggcacataggtttcaaaagctagagaatgttgtccctacgcatagagtctctgcatccctttggaggggaagggagggaaaggagatttggaggaaaagcctcttacggaggctttggaggctttggaggaatggctctgagagcctcggcactggggagtgggacataattgtctggggagtcacaggagatggaccgataagcaggggactccaaagctaaggcggggtttttgggattggatgtgagggctgggccagtatctttaacaggtcctgagtgggaatgaacatgagagacagtagccccaggcgctccatgctatctgcactacttcagcccagacaggaaggtcaaagactggtggaactggctgggtgtggtggctcacgcctgtaatcccagcacttagggaggccgaggcgggcagatcacctaaggtgaggggtttgagaccagcctggccaacatggtgaaacctcatctctactaaaaatacaaaaattaattgggcgtggtggtgcgcgactgtagtcccagctactcaggaggctgaggcaggtgaatcgcttgaacccaggaggggaaggttgcagtgagccgagattgcaccactgcactccagcctgggcaacagagtgagactccctcttaaaaaaaaaaaaaaaaactggtggaactgatccttagggggctggcttgattgacagaaatccttcggtgacatttcggaacgactgcagctgagggaacaactgcactgtcacaacttttcctggtacctgcacaatgtctacccagagatgtttgttcctgacctgacgcccaccttctatggtgccgtaagtcttgagaaccaacctgcctgcccatcaccacagcaccccttggagaagttcaagaccactgaccccacagatggatgacaaacaagaattgagttttgccctgcaccctcctttatccaggaggaggactgagaggccacgttggggcttctagagatagcaaaaaaccttataaagggcaaaacaacccacaagcagtggtcctgaaacattagcatgcatcagaatcaccaggaaggcacggtaaaacgctagggcccatccccagagttcctgattcagaaggactcaggggaggtctgaaaacttgcatttctcacgagtctccaggtgatgctgatggtccagggctcacatttgagaaccactgcttataaggaaactcccacgtgctgagggcttcttccagggacctggcatcctgggaggttccctgcctgccccacagaggggttcagtcctgccctttccagcctctggggctctgcagctcactttgctgttagctccaggcatgtgggttaacgcacagaggagagaaatgacgggggaaatccagccatgcaaatttgttgcagttgactggaatttgttccagtggggccccataccacacatgaggaacctcctgactgtgccatcctgcttcccctctctgctcacccttctgcagatcaagaacctcggcaccaaccaatgcctggatgtgggtgagaacaaccgcggggggaagcccctcatcatgtactcctgccacggccttggcggcaaccaggtatgcagcccacccatctccggagcatctcctctcctcaccggctccttttctctaccctaaagagtcctttcctgaggactgggagggaggagataccatccctgccctcaggaagcttccagtcggaggagaaggcataacacacacaaggtctgaataagggacatccggagagaacgaggcatcggtgctgggtgtgagaaggggatgggagggagggttgttcatcagaggaggcttgaggaggctagctgctgggggatatttaggggtgagggtggaaaattttccagcacatcccatcacctgcactcaacttctatcttcaatgcatcctctgcccagaagctaccactctgatcctaccaccttccagtgaccccaaaactaggtgcccagcactagtaagtgagaggcactgaaaacagagccagagtggggaaaggagtggtgtgggtcactgaacaagcccgctggcatatgtaggtgaagacagtcattctacagcagtttcctgtaccactggcctgcaagatgatttccagtggtgcactggagaacattttttattttaatagtaatgtattagcaaaaatagaacaagcatatcacatgatttcacggatgttacttaaaatgaggctaagttaaattgaattttaatctaatttaaaggaaatatgattaggcacggtagcccacacctgtaatcccagcactttgggagggtgaggcaggtggatcacatgagcctaggagtttgagacctgtctgggcaacatagcaagacaccccatctctataaaaaatttttaaaaaattagctgagtgtggtgctacacgcctgcagtctcagctactcaggaagctgacatggaggatcgcttgaacaaacgaattcaaggttgcagtgagctatgatcatgccaccacactctagcttaagcaacagagcaagaccctgcctcaaaaaaaaaaaaaaaaaaaaaaaagagaaaatatactggttgggcgcagtggctcacacctgtaatcccagcactttgggaggccaaggtgggaggatcacttgagctcaggagtttgagaccagcttgggcaacatagcaagaccccatctcataaaaaagaattttatatacatatacatatatatatacacacatatatatatacacacacacatatatatatatgtatataaaattccagcataaccctgatatggtaacaatcctgaaggcagcacataaatgagtaaagtcttggcatggcctcacattcactctcctccccaggagaccatgcatggtagacagctcagggcaggtggctttggaaggctgggggtgaactctccacctgcttctcttgtcttgatttccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggtgagtcagtgtccagaaagctcagaatcaagaacttgaggccaggtgtggtggctcacgcctgtaatcccagcactttgagaggccgaggagggcagatcacgaggtcaggagttcgagaccacctggccaacatggtgaaaccccatctctactaataatacaaaaattagctgggcatagtggtcggcgcctataatcccagctactcaggaagctgaggcaggagaattgccggaacccaggaggcggaggttgcagtgagctgaggtcgtgccattgcagtccagcctgggtgacagagcaagactccatcttgggaaaaataaaaaataaaaagagaacttgaggccacatcggcccctctatattttcttcattttcttcctgagacgccatggggtggagtagagcaatgtagaaggtaggtgagtgtgtgtgtggccacaggcagggttcttcaggcttaaagggtatttggtgatgactgatgtaaaaatggggtgacaggttatggttcgtggctagctctgccatggctgaagcatttttaggctgaacccaattagaagaaggtgaagagtcattcatagttcctgcttgtcctctgtgtcctaggctcaaagctaggcactcacatgcctgggtccagttaatctttcagaggctctttccaagcaggaatagtcactgtttctacagatgagctggagccggaggaagcccagcatgtctgtgactggcccaagacccatcactagtaaatggcaggcctgggatttagccccagatgggtctgacttgaaagcacgggctctttccattacaccacactgctccaggatatgccatgtaaccgccaagccagcaccccaagtgagcctccctactccaccccagcttaggaaagaggaacctaacctggaggctgcagggaagggagcagtctaaacataatccaaggcagaaaattggaggtggagcagtggccctgggtctttgagcctggccatctgggggtgcgggaggccctgaaagcatttttctctcagcccatggtcttgtctttcaccatttcatccactcagtctgaagctagggatggggatttggcaccagatagaggtgggaactcaggaatgtgtctcatgagagggcaggaaaggaatggggaagtgtcctctttgtgccttgtggggttcccttggcttttgtcaattgcaccccatcgcattgtccctggtagcaccgttaagaggtctgtggcccagactgaccttttgctttgtcatcttttaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgcctttcagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgggaggccgcctgcatccctgagagccttctggagcctacagaggagacattggccagccaaaaggaaaggagtggccagggtacgacctggagtagggaagggaaaaagttcccggaaagaagagaattggatgagaggtctcggtggaaataaaggttttctggcattggtcaaggaaactcgcgttgtgttctcttacctgtgttgtcccttagctgaatcagttgatttgggctatgaagaaccacacacatctgaaaagttctgttacagccactgtctcatgtccccaaacattctctggccctaaatctagcttatgtattgtgtcaagcacgtggagacgtgagacgtcaaacgaggtcctgtccccgtggaactcacacgctaaatgtaagcaaatcatagcaagcctggagatgctccaagaggtgctggatgagttagaaggagcaattccttccacttagggaatcagataaggcctcacaaagatggcaatgtttgacctaagacctcggaagatgagtcctcagatgggaagggctcaataagcagagttgttacacaggcagcagcctggcaggagcaaagccacagaggacatgtggccccagtgggtctgagaaacccagaggacattggggtgagggagtgactggtgtagaagctggaagatcagagttacatcatgaatttcaggggccctaggcactttagccttcacggagctcttgctccattcaaaaaaaaattaatgttatgactatgttggtataaagatgaatgtaatccaggctgattggatttactttatttcttctggttttaaaagaagctaaaacatttctatgggccctgggcactgcacctgctgtgcctactgggtaactcagccccgtacaagagtgggttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgggactacaggcatgcgccaccatgtttttttcatgtttttgtagagacaaggtctcattatgttgcccaggctgataccaaacttctggcctcaagcagtcctcccgccttggcttcccaaattgctgagattacaaacatgagccaccatgcccgaccagtgtttatctcaaaagaattcattcctagaattggtatgcaatgtcagaagaaatgcaatgcctcaaaatttaagtcattgtctggctgggcgggtggctcatgcctgcaatcccagtacttggggaggctgaggtgggtgaatcacttgagctcaggagtttgagactagcttgggcaacatggtgaaacctcgtctctacaaaaaatacaaaaattagctgggcatggtggctggcacctgtagtcccagctacttgaggggctgaggtgggaggatcgcttgagcccagaagatggaggttgcagtgagttgagatcatgccactgcactctagcatgggcaacagaatgagaccctgtcttaaaaaaagaaaaaatttaagccattgtctatgcctaaccctaagagtaagatttttttttttttttttttgagatggagtcttgctctgttgcccaggctggagtgcagtggcacaatctcggctcactgcaacctccacctccagggttcaagcaactctccctgccacagcttcccaaggagctgggattacagctcccaagcacagggactacaccacaacgcctggctaatttttgtattttcagtagagacgggatttcaccatgttggccaggctggtctggaactcctgacctcaggtgatctggccctgctgtgatgtaaagaggtaaccttcaggaggccctcaagcctcctcttggactcctcatcctggggctagaggccagaggaagcagggaagcgggaggagaatgaccaaagaggccccgggttccctagcgcagctcacccctcttccctgagtgtgccagaatgctggagggcaggctggagagcaagctcttcaggttatctgagcatcaaagtgcaactcctctgaacagctctagacactgaaaaagtgactgtgcagattccttcaaagagcattttccaggtttctcccacccctgcagccatgaagcttggattctggagtgtttaggcaacaaaagccctgggtgggcaggtgatggtcctgcttctgtctaggttcctggcttctccctgcctaattccaaaccccatgcgttgctaccatgactgctgcacccacagtcctctgctctggagcctgcagtggctctgatcattttgtggccaacccaagggtcctctgcccacctcaaggcacattgcaactcttttctctctctatttatttatttatttatttatttatttatttatttatttatttattttgagacagagtcttgctctgtctccaggctggagtgcagcaacctccgcttcccaggttgaagcgattctcctgcctcagcctccagattagctgggactgcagaagcgcaccaccatgcccagctaatttttgtattttgtttttgtttttttttagatggagtctcgctctgtcgcccaggttggagtgcagtggcgcgatctcggctcactgcaagctccgcctcccgggctcacgccattctcctgcctgcgcctcccgaggagctgggactacaggcgcctgccaccacgcccagctaattttttgtatttttttagtagagacggggtttcactgtgttagccagagtagtctcaatctcctgacctcgtgatccgcccgcctccgactcccaaagtgctgggattacaggcatgagccaccgcgcccggccaatttttgtatttttagtagacggggtttcgccatgttggccaggatggtctcgatctcttgatcttgtgatccgcccgcctcagcctcccaaagtgctgggattacaggcgtaaaccaccgcgcccggccgcaactcccttctctctcctctacgaactgtgatgaacaaagcctttcatctcctgcaggaacctcggctcctaccctcgttctccctctgccctccaccctccatctaccctcatagccctcagactgtcttcacatcccaaggatcccctcctctaccctgcctcatattctcctctgggagccccttcttggctctccatctgagagggcccaagcctgtttctcagtactttcctcccccagaattatctccactgcatctatttggcttttgtgtctgcatttacacctatgcctgcatcctgggggcatgtgccatctccctctttgggcagagagagttgctgtgtcttccttgcccttgctaaccactcccccctcttccactatccccctggcctccagctgctagtgcacagggcaagtctctgcatttatggtgccactgaggacaacgagagagtgatggatgacaaggggtgctcccttagagaaaaaccagccctggttctccatcttatttctgaaaaagagtttgttggatgcttttcaattaaaagcagatgattaattcagccctggccttgttctgtctttgaataacagatacattagtttacttgaaaagaaatattttcatttgtatttccatgtcacttgtgattttccctgccttgcaccctcagccctgccagttggcaagaagacagtcagctttgctgctaagaggagtataaagagggcttggtccaagcaagaaggcagtggtctactccatcggcaacatgctggtcctttatggtaagtggatatggtccagtcgcaaccctggtcctttatggtaagtggatcatgtggcctgaggtctatagggagggggacttgggcaggaaggtcagcaaattttccctaagtccaggccagcaccctgtcccagggcaggtgggacgctctgcctgcagagcgtcctttactctcctggaggccaagatagaaaaggtcagggccactggctattcaggcccctctgggtggcaggtccctgggccacaaagcagagagaagccccatctggtagtggggtgggtccctgggcttccccaccacccccattgacaggaggacttcctcagcaggtgcctggctggggtgtgcactgcaggccctgaaccctggagaatcttgccaaagcattagggggctggtgggggtcaaagagtgggggggggtctcttcaggccaaagggtgatcttgagcaaagaggagaccacaaggagcctctggggcctagcctggtggtttgagagaggtccttcatagcatgccggagttctgggaacacctgggggaaacagaaggcacccaggcacccctgttttcaaaaggggctcagagaactcacagctgggcccctcattcgttagagaggaactgtgaatttgcagacaaggctaacattcctcaaagcacaatcgccaccccccacccctacccctggctgaccccatgcttagtcatcactcacttttcttctgccccacaaaggacacagcacccaggaccttccggaaaccaatgcccgcgtagtcggagggactgaggccgggaggaattcctggccctctcaggtgggtgttccttcccagccccagacttccacccaaataagagctcagtgcatgacataaggtatcatgtgtatttgtgcatgtccctatcaacaagcagctctccaattgtctaggttctcgattttaaagatggatgggatcaggcttaggtggttttctaaatgcaaaaggcttggaggaggggatttatacaccaaccacagtccctcttcaaggcacacacccaaacacaagatacatttatattctcagcgacagcacttgtgccacgcaagaaagactgggtgccagacagtcaccttggactccacataccttgaaactcacacgcacaccactccacactgtgtgtgtcacaatgcttgcacgcatgtgcgcgcacacacacacacacacacgtacagcatgctgcttagttggctatttagagtttccactttgctaacagggcagctgggccctgatttaagtgatctaaatatgtaaacctggcaaattaactgatgaagatccacactttgagaagatatcactgcaatcagagttttagcttataaaagtctgagccccagttttcaggagtagagctattacataacatgaggtgctagaagaagagacatgaactgataaaaacaaacatcctattggtatttttttttttttgagatggagttttgctctcattgcccaggctagagtgcaatggcatgatctcggctcactgcaaactctgcctcctgggttcaagcagttctcctgcgtcagcctcctgagtagctgggattacaggcgcctgtcaccatgcccagctaatttttgtatttttagtagagacggggtttcaccatgttggccaggctggtctcaaactcctgacctcaggtgatccacccgcctcagcctcccaaagtgctgggattacaggcatgagccaccgcgcctggcctcccattggtatttctaagtagtccctgaagtggggagacaggagatgtcttgaaaacactaaaggtacagctctggagacctaagcctgttgggcttaggtgatggagcaaatctttgcctatagttcctcttttttgggggaggagagggggcgatggagtctcgctctgtcaccaggctgcagtgcagtgacgctatctcagctcactgtaacctccacctcctgggttcaagcaattctcctgcctcagcctcctgagtagctgggactacaggtgcatgccaccacgcccgactaatttttgcatttttagtagagatggggtttcaccatgttggccaggatggtcttgatctcctgacctggtgatccacccgccttggcctcccaatgtgctaggatcacaggcgtgagccatggtgcctggcctatagttcctctttaagggagaacagaggtagaaggagttccaaaaaaggagttacaatgggttctaggtccattgcaacaacctagagagataatgccaaatacactgtgtgcctttactcctccatccatgtacacagcaaacatcaccaagcgatggagcatcccttcctgctggccccagaagcatctacacaccccttatcaatgccacactccaggtggccactaccaagcaatcagtagcaattggcaggtcagatgaaacctatttgccatctctagcctagaaagagaatgttttgaaggacagcaggactttaaggaggtgacatgtagtttgaggcaaagtcttttatatttaattatttttgacgttgtagaggcgaggtctcactatgttgcccaggctggtctccagctcctaggctcaactgatcctcctgcctcagccttccaaagttctgggattactggcatgagccactgcaaccgacctggggcaaaaccatttgagaaacaccaacctatcccttctttctttcctccccatctagatttccctccagtaccggtctg

SEQ ID NO: 635 - DNA, 2881 bp, Homo sapiens
atgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaa

SEQ ID NO: 636 - protein, 622 aa, Homo sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 637 - DNA, 45960 bp, Mus musculus
  misc_feature (1)...(45960): n = A,T,C or G
ctcctgccaggtcacccaatgtgtcatcctactctcctgttcttctgaccttgtgccctcagggtcagctcatccacacccaaatccagagccagctccactgctctgcccggttaaggtgaggggctcactctcccaagtgctgcagccttcgagtggctgcaccagctctcccagtcacaccctcagggctggctcacctgtgccttccccattgggcctgctccactgtgttgccctgacaaggtgcagggccagctctcccaagtgatgtagctggtgagggacagggccagctcacctgctctcatgaccctagggtcagagagagacctgcagaccaccagagtagccagtgaggatcagggacagttatgcatagtccctagacatccatgtgatcccagtggctgcccctgacactggctatgctggctgcgtagccatggatggagacatggctcttagtggcagctgatgttggggcgtcaccatggtccccaagtagcagagctgtccacacacagcaggctacttctctccacccttgagtctccagttccatctctcttcataatgctcaagctgctccacctctctttctcttccatctgaccatcacatattcacacactgtggtggctcctgctgcaggctggcgacgtggctggcagacccctgagtgacatcttctgtctatactgcgtggcatgttaacaagtgggtctcttctgcccacctatgccttgcactggagggcaggtctgtgtgtagcatggtggtctgcaggcaggtctctctctgacttcttcctcccatacagtgctgtgtggtggtagtaggactctgtgtgtctatggcctgctaaagatgtggtgcaaaaggcagatctgtagatgtctttccctgcctgcactgagtagcatggtggaatgaaggtctctgcccatcttcctcctcccacacttcactgcctagatttgacttgacttgatttgatttgatttgatttgatttgatttgatttgatttttatgagtcctaagcataaaacggctttgccaccaagccaggcatcaagctaggatgcacaaaggactgccatctgcgctgctcctgactgatagaacaccaataccagcaaggattctctttgcccattgccagggggtgggtatcaaaattatttttattttgcatcttcctttttaatctttgcatctgttttctgttttttaaaaaaatcaactaaggggctggtgcgatggctcagtgggtaggagcgcccgactgctcttccaaaggtccagagttcaaatcccagcaaccacatggtggctcacaaccatccgtaacaagatctgactccctcttctggtgtgtctgaagacagctacagtgtacttgcatataataaataaataaatcttaaaaaaaaaaaatcaactaaagtacaatttctggcaaaataacgctgccttagcattcaagagctgagcagagaagcactcttcccgaacgctgttgatccagtgtggctaagaggatttggtgctgactccatcaatcatacaacctcacccacccactttacccaggacaggtacaacagaggaacaacagaccctcacaacaggacagaggacagaaatgtttccacagaaaaatctcggtcaaaagtaaggaccgtggaagacacaagaatcaaaatggaatcatttgcgtcaacttgaacaacaaacaacaaaaggtaaacaaactgaggagagacatgggcttgcacagatcaccacaaacttgtataaaatgtgattccacgtgggcctctgcctagcgattcgggttagctccaaactgacacaagtggaagtcaaggggcacagccctcagtcatgcaagcgtgagcaagcctaagagctactacacctcagtgctcttgggatccctgcaagggacatgagggaggcagactcacagaagaaacacacaccagtacttagtatagttctgcctgtgcaggagcctctaccaggaaagtcagctccaaccgaatatctgaccagtgaatgtacaatgtgcacaaggggctatctgggtagagaagtaagggaggctgagggcaaacatgacaagattggtctggtttgtatggcttcccaagatcatcctctgtgcctggaaggaatggtttatccccagtacaggcgatctgccttttgcacagaaactgtaatgtttaaagaaaaggcctgggaccaggaaagcacacagtgactccacagaaactgagagtcaaaataaactctctgagacgaagagagggagaaaaacaccaacgtcgggggcttttcctacaccacccccaagccaggttccaagtgtgttaactcaaagaggcgggtgcagaaaccatatgtctatgtgcttttactctcttgtgggcagagggcattatgggcaggcactgtcacatctgacttaggcagtactgacctcttgaacactaggcaaacatttggccaattaaactatattctcagccaatatacaaattgattctttttttttctttttttttcttttcttagatattttcttcatttacatttcaaatgctctctggaaaatcctctataccctccccctgctctgctccccaacccactcactcctgcttcctggccctgccattcccctgtactggggtatatgatcttcgcaagatcaagggcctctcctcccatttttggccgactaggccatcctctgctacatatgcaactagagacacagcttggggggggggggtactggttagttcatattgttgttcctcttatagggttgcagacccctttagctccttgggtactttctctagttccttcaaatggattcttaaactgaaggcatgccaaaaaagtcctacaactacccacactgtattacaaacaacagagcaaacaataggattcctgagtctctgctaggtgactgactagcatatttcaaggctcccttgcttggatagacttgcaggggacaagaatgaatcccaagaataccaccacacccaaagcacaaagccttaactacctgctctagcattggcctcctgcttgcagacaggggcagcagcaccacccagtggctgtacacaggtaggcagcatcatagcatatagaccctaccgggaaaggctccactccgagaccatcactattccaaccagagcccatgaagagatcatggtctgtgggccacagccagacaggagaggaagtgtcaactccaataccttaatctgctctgatccagccacccaggagattggcttggagttgtgagaacttgtcctgatcaatagcaacctttggtggcactctcagaaaagcactaggcctggcaaaaagatgagggagagaatagagacaagttctctgctgggagaagaagatggcttctatcccaagccaaccttgaggacaactggatctagggtatctataggcacatcccaggccacctgctctgcttctgactctctaagaacatggaattgtgttcctctgtcagcatccctgtcttagttaggattttattgctatgaagagacaccgtgacctaggcagctcttagcttaccgtttcagaggttcagtccattaccaaaatgatgggaagcatggcggcatccaggcagatttggggctggagaaggagctgagagttctacatcttgatctgaaggcagccaggaagagactccttttccacacttcatggagcttgagcgttaagagatgacctcaaagcccacctacacagtgacacacttcctccaacaaggccacacctcctaaaagtgccacttcctatgggctaaacacatttaaactaccacattcccctaccccatctcctctggtcaaagtgctcaccactcccactgactacccaacagttgtttgtgtatctttttatcaagattcccaagctttccctcatatgactcctgcacatacttcattaggagaaacttggaatctagaaatctttttttccctatgcaatcatatggcacacatcttttaaaaatcttagctagccgggcagtggtggcacacacctttaatcccagcactcgggaggcagaggcaggcagatttctgagttcgaggccagcctggtctacagtgtgagttccaggacagccatggctacacagagaaaccctgtctcgaataacaagcaaacaaacaaacagctagggagcaggggagtgactcagatggtagagtacaaagccctggttccatcccccataccacataaaaccttctgtgatgtgcacacctgtaatcccatttttgagaggaggggaatcataaactcaattccttggtgatatagtgagtttgatgctggactgggccacatgataccctgtctaaaataaataaataaataaataaataaataaataaataaataaataaataattgagttgtgttagatgaactttaaaaaatacattttatcttttgtcatcatcctatggagtaagaggcttatgcttatgaatctttcaggtaactgctttaaaatgctctttttatctgttatggatacctttaaacattatatcaagtaaataggaaccaagcacacacacacacatacacacacacacacctatcatctatctacctgtgtgtgtcataatgagacccatttctttataaagtaactaaaaattaatttttataaagtacatcaggggctggagagatggctcagcggttaagggcactgactactcttccaaaagtcctgagttcaattcctagcaaccacatggtggctcacaaccatctgtaatgggatctgatgccctcttctggtatgtctgaagacagctacagtgtactcatataaataaagtaaataaataatttttttttaaaaagtacatcagaaaaaatgcactagtctcctagggtagcttctcccttgtcacagagttagagatctgaaggagggtgcctctcactatgactgttaagtcacaaaccaatagtcccaattgcagatgtcactatagtgatgttatatttgactgctgtttggtttttttggttggttggttggttggttggttggttggttagttgattggctggttggttggttttttgagacatggtctcatgaagagcaagccggccttgaattccctatgtagctaaggttgaccttgaaatatgatcctccttcatctacctcctggactcttggaccataggccatgtggtgatctcagctcatgtggtgtcatcgactgaaaccaggacataatgcatgttggacaagcactatcaatatctgtgatgtcccccccagcccctactgagtgtactggtatcgctttagtaacaccctaaggtagtcaggcagtaggattttagggccaaacatggtggtgtacacctacaatctctgtaaaatagggtcttccccagacctggggctaagcctaccctgccccagagctacaccccagttcatgtcaacattattgatatgactatttagcagtggaggaatccaagcagcagagaggttggatacttttctaactctgaatgagccttcatggtcaagctagttcagcttcaagctgaagtagtccaacttcccagttccccttcagtctatgtcccaagccgctctgtagaagacagctttggggagcaagtggcagaggtgctctgtaaaggaatccttctacactgtggacagtcatctccgatctgaatttttgttccattagaatgttaaagttcatgttctgacagtgtgaattaagatttgtttgtgtttgattttccagtggttaataattaccaggaattgatgctaggacacatgacatctttccaataataaagaaatcattaaacagccctaacagtgaaagctctgacaacaggaaacatatttataacttagtaccaaatttaaacaaaaaaacacaatgatgggtaaaaacccatgtgtaaaaacaaaagatgggtagctatggacagaaactaaaaagacaagaaaggcagggaacttactgttcctgtcaggcagtgggatttttaagatcttttagggccaaacctgtggtgtacacctacaatcttattgcttggcaggaccagaagtttagtttaagaccaccttgatcttcatgagattatcataagagatgttttaatggtgctatgttatactttttataaaactgaagaaagagcgattttgagttcttcccagccagttttcagtgtgtctaccctctcccataggctggcagtgcagtatacatcccctgtgctttagtgggtaggttcagaacaacttccctgcgttgatacccgtgacagatcatgccaaataagaacagatttgaaaggtgtatgtcaaaaagtagaacaggctatggggagggagggactccctctggagtgggcaccatttgtgacgtaatcaggatagtttaaccggggctggacctatcagataaatagtgaccacactactaaataactaccttactttagagtccaggtctctagaatcagacagtacttaaggagtcacctctgctgagtccttgggactctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggctggaaggcctcctttttcagtctaccttaacttcgcttttctgtcagttactacatatgtgtatacccatctatccatgataaacccctctccaggcctgaggatatatcctgaaggatgataaaattaaagcttagtgtgccccctcttatcatattaggacaaaaaagtaacttgccctttgcaatgctggatcctaagaacagatcctgatataggtgcactatggcaagcctttgggtcttcagcactgttgagctaaacagcagagagagatgcattagctatgctgattcaggacaagtgctgtgtcagggacacacatgctacagtaaaccacaaggcagttggaggtgcggcaagcaaagggggattagatgagagctcttaaattatcccagtggcaaaggtcaataacaagggtgacagctgtccaagattaaacaggccagatgccctttcagaagctgtaaggtgtgtgtgtgtgtgtgtgtgtgtgtacatgcccacacacatgtgcatgtgttactagatatatacgtgtgtatgtggcatgcatatgactgtgtgtgtgaggttgcaatgggctttgtacaaggttgtggctctggctgtaatgtaattttttttcatgtagggtatatgggctggcctcagactccctatgcagcaaggaatgaccttgaactcctaatcttcctgcctccacattcagagctctgagattatatgtatacaccaccatgatcaatttatgtggtactacagatgaaactcagcctcatgcaagttggatggatagtaaatagttcttgataacaggcagtcacctcacagaatctatacaacaaacacagatcttgtctaccgtgaacccttcttatacagaaaaccgagatttttatgtctaaatgacactccaccaacaaggcccacacagaccccacagagggctgagtgcctgatctgccacagatgtggactgcaactagctccatgtagcatagcagacaaccttgtaaatgtaggggatgaatactattgctcccacccaatgactggatgttggaccacctctgagatgtgtggacatctgatttaaaagtgaccagcaaaatccttgaaagactaaagagcaaagtcttcgaaagactaacaacagtttgcctaccccagacctcctgacagactcaaggtttgtcaatcagctttccctcgccttaacaaactcccccaaaaaataagttatgaagagagaagtttggaaggttcattccatgatcagttacctcagacgtttccaggcctgtgatgaggtgaacagcagagcagaacttcgtgatagggcaaaagctcacctcatgactagaaagtaaaaagtggagagaagagcctagatggactctcccctctgaggacacactaccaacagtctaactgcctcccaataagcccattcccaagattctagcaccttccagcagtgctgaggtggggagctaggctctgagatgtggaactttgggggatccaaaccacagcatatagatagatagatagatagatagatagatagatagatagatagatagatagataccactagtagactaataaaagtacctggagctttattctagaataaattacttgggctggtaatgcactcatgtattcatgcacccatgcactcatgcactcatgtacccatgtactcatgaacccatgctatgtgactttgaacttgcattaacattagtcccagtagcatgagtatagcacccaaagagtacccagccatagataagaatttgatctctgtatacatttctatatagtttttaataaagtccaaaaggatctatggcaattctgatacaatctcctgtctccctgtgttctcgggtatttctcaccctaggagcctccttggtctgggttctagtataagaatctggcctgcgtgcttccttcctgcctacttcttgactttttctcttaagagaatgaggaaatagcagtcatgaagaggactgtgataagttctccatgttaacaaaacttatcctagctacttgaatatatcattatctgcctcacacctgcttcatacctgtctcacacctgcctcacacctgtctcacacctgcctcacacatttcgaactgtatagtctccatactgagtggcttgttcagaaggttgcagagcagtccttgaacttgtacaaactcagtttcctgtttatctatcctgagttgctctgggatttcccatttgtaagtttctttttaatgtatcagttctctttaatttttcccaaaatttcttagttcaattcactgggatttttcagattcttttggctacctgccttctgccctctagccctccatatttcacccctccacactgcctcataaagacatgaatccaggatgccctcaaggatctggaactccacaaaacacacagatccttcagaccacaggagactctacccaatgccagtattgggaaaaagagactccaaacagctagatggtatgagaaacatccctcctgggtcttaccacagaagtggcaaggtatagatatggcccagaattcatccctgtgtagtcctagaaaaacatttttttttaaacagggtttcatgtagctcaggctagccttgaactcaatatggatgatcttgacctcctggtcctcctgcctctacttcctgaatgccggggtttcaggtctggcttttaatgctgggggtggagtctagggctttgtgcttgctaggcaagtaagcactctacctaccgagctacagcaccaaccagaggaagtgaatactgggctgaaactgccagagagcagaccaatcaggtagttggagagtgggtgcctgggtggacttcctcaccagccctggaggccccaagagtgcaggggccctctcaaattgctaagggcaaggagaggaactgaggtttgtgaacactgtggcttgtgtttcctgtttcagcatgctgctgtgcgaaaataacgtcagtataagaagaaaatggtgagggggtttagaaacttcttcagaaactcggcttgacagcttccccagccttctgagaccagagagacctagaaagaaagggctgaaggctctcctgagacacttgagacagaacctgggacttgaggtaactgtggaggaagatgctttgggatcttggtttggatctgctgacttagggtggggcagaatacgctctgccatgccagcctcctgcgtagcagcaggtggtagaatgtactcgatggggcttgtatgacaaaaaaacatcctgtgctagagacctcaggcaaccacagggtatggctcccagctctgctccgtctgatggcttcggttaggtgtgagttgcatggcttggtgttggtgtgctctgcatccataacacaaattaaatgacttttcccaatcccttcaatgtagggatccctgtaacaggctcttcagctcccgctgagaactctgaactaagaaggccagattcgtgtaggaagccacccatcatctcctctgcatacacagccaggaggtaggtgcaaaactgtggcaagtcaacatgtctgtagttgaggggcagtgtgctgctgtcttcctgtgcaggaaggagagccttccctagccagtactagcccttcctccgagctctaactaggccctttcatgttggccaggggtacctcagaaactacagaaatcctgggcagtggccttgtgacctttttctgaactacaggaccagttcctttttttctatagcctgtccctgtccatcagactttccatagcctacttgcgttaaagcaagccaggatgatcccaccatcctagaaggctgtgtggttccatacaggtgtcacgccacaccccaggaggtgtagaaggctatgggtttggagacactcctctctctagggagccattcctattgcaacttcctaagcattaagacctaatgatgcagagagtaaaatagccatatttcagtggccctacagacaatagatggagaacaggaagagacatcctcacagacctgttctcaacccctcagacctttcttcttcccgtctggaaggtagggaacctgggagctccctctggtaagaagtcccacagtggggagcctaagccctcacacttataatggcgtctcctttcttcacctacctgttctttgacttcctgtctgacctaattgagttgatgattacatccagaccacacagaagtgttttgtccttgtaacccaaactcacagactacaggaaccacagtaaaattattccaagatggagctacaagccctgttcagaactgagagtgggagtaggggagtcagagggcaaaattgatcattctctgtcctacagtctggcgttccctggggcatttgattcacagcaccaagttttcagtattcagcgccagccatgataactacaatatttttatatctattatttttaaaaagctgtcgcttatcatatgccatgtggtaggtatatggtgtgggtgttgggtgttgtcttttaaggttcatgccccttcaagggaagttttagccccatcttataaataagaacactgaggcttagcaaaccacccccacacacacacacacacacatacctgtttggtgggtattgacaacctagaagtgagtcacagtctggccccaaagcaagggttcccctccttcagtgaagacagaataatcgggtgctgtggcttgaagatgcacatgtatgtaattccaagtctcctctatatattcatttatgacaaaacacaagtaggctttttggctcattttctacataattcaataaacagggtgacatgtggcagatctagggagccccacagagggagagtgggaagaagcctgagagaaaggcaaacagcacctcagtccttggggaaagctctgcccaaggcagagagtgtccctccagtcctctagagtcagataattaaaagtatacaggacttagtcacacaagagccctccagagagtgagattgcccagcaacagccctgtgaatgagtactgtgaccagagggagaataggaagcctgcacaggactcggtcttgtgctaggataggcatcaaagtcccaacaaagaaacacagggacctctcttcctgcagagtctgtgcagcctataaacatgaggggtcagtgtttgcaaaaccaccgaggaactgaattcctgggcagtggaataatcaggtcatagagaagaggcagcggctgtgacgaggaccttcctccatcaccacagtctgaccccagagggtataggaggcagggtacaatctctgatggcggggtgtagttcatctgagtccagccctggttccaccaggctaccagagcccaaaataagtctagccaaatccatagctgatgggtgaagatgagggtttggggcactatatggatgccaggcaaggccacctagaggggcatcaagggtgacctgtcctgaaaactgttccttgaggacttcccactatataggtttcttttgtcttgtttcttatgatttttaggattcctgttgaaggcaccccacatgcttgatagatggaagatttggggaccagactgagtctggcagggaggtgatcctaagagaatagaatctccccctctgagtccctgaaccagattctctgaaatgaaccatcaagcatttttaaggtcctcaactaacagactgacttgatcagcagctgagagtcagagcccagcactagatacacagtagatgacaaagaggaaagttgggagtgctgatgaaggaattagagcaggtttccctaggtcatggcagtccagagccacaagatggctgctgagagctaggagtgaaacagagagtgccagtcacaaacctggtcacttcctgaggggttgtggctatccttctaggtctcaagaagtgtcacttagcaagagatagtaaagatgacatcatctttcctttttagactgggagataaagtgggcagggctgtccacagttctacaagccacccacatggctgcaggctcattatggctactgtcagttcttcgtgtttcctcgcttagagacatctagtcaaggaagaaggggctccagagagacccatccactttaggagatcagtgctagagaaaagcagaaacctggccttaccggattgcacctgttcatgcaggattgagcctgggagtcctgaccttgggttcttaatacacatggatggagccctgtgctacttccaccctgacccagagagatagactgtcagttttcaacccatcttctgactcctccctcttggcatctggcagatccaagcagctgttcaagggaaagtaagccaaacacaacaggtgctcggggaggccaccatgatcagctcagactcgaggtcctcccctggcttggctcggtgggctgagagctatgaggccaagtgtgagcgacgtcaggagacccgagaaaaccgtcgccgccgccgcaatgagaccacttgccgccagccagggaaggtgctgaggacccaacacaaggaacggcttcagggagctcggcagctacagttcctcaaaaggagaaacctggaagaagagaagaaaggccaagccagggaacaagggccctccagcaagacagatggaggaacaggccaagtgtctatcctcaaggagtccttgcctggtgccaacaaggcctctttccctggacagcaggtgcgatatggagataatgctgctccagggccgggggtggggggtggggggagaagggcggtatctgcaaggtacaaaggatgaacatctctaacagtcagtttctgttagtcccttcctcagcatgcaatcaggtttcctttagccatcaatcactgttctttcagagattccgtggtgtctttatttaacttcttttgaagaggagggtcctacacctacctatttggaagaaaggaaataactgaacaaacaatttcaagccagtaattagtataagattttttttttattcctgagagagggcctcactatgtaatccaagatggcttcaaattcattatccttcctgattgctgggattacaggtgtaccataattggcagattccttcccttctgttttcttaatgctgaaggcccttatgcatgagctcaccaagccactgggccacatccccagctctataacccaagatgcatcatcgcacagacgctcacacacatacacacacacactaacacacagacacacatatgcacacagacacacccttactctccagtaaggcttcacacccactcttctctctctctcttgtgacacttcagttctaacagcttcgcccaactgaggcctcatctgattggggaagccttccctggcaactcaggccacctctgctctcatgggtctgcatggttaatattgcataaatacataaaaatcccattagcatgcataagaggagcagtgttcacaagagcaggctctgtgttatcctactatagtgtcaacacactgaggagaggaatggatccatgtaaaccagggtgtgtgtgtgtgtgtgtgtgtgtgtgtgtgcgcgcgcgcgcgtctgtaggtattcatgtgggtgtacatgaatttacatgtgaaaactaaaggtccactccaagcatcattccttgctttttgatgctgggtctctcactagcctggagctcactaagtaggctatcctggatgttcagcaagcccctaggatctagttgcctggctccacctccttggcaatgaaattacaagcacacaccaccagcctggctttttaaacaaaacaaaacatgtgttccgagcttcatggttataaggcaagcacttcacttgactgcactgtctctctggccccttcatgaggctgccacacagctgcccagaacaaccatcctggaacataactaccaaggaaccagctgcctgcttacagggtaacaaggcctctgagtggcctgggcgaggggggccagggtatgaaggatagaatagaaaacaatgaaataactgcctgcccatggttatcaggtcagaccatgatggaatcccatagatacttcttgggcttttagtgcctttcttttattattattttgtaggagaaaaggtaaaaagacttgcttgtgaccaccactatcccatcctcccaactgtcttctttcagtggaaaagctcaaaggtcctgtggctgtaaggagaggcaggcaggccctctaggccctctgttataggcaggagccagaggcctagaaaaggcctgatctgactattgtcaagtctctgaccacttctccctctaaatcagcacatggctgagtggctgaaatgggagaatgaaggaagactggccccttgtctggccaaagaaagacattctccctgtccgggacaaggaagaacaagtggttttataggtgggaaatatcggaatacagtgacaggttaccacgcacagaacagcttgtgcacagaaaggtattcctcatcatttataaggctcaagcccaagctcaaggctccagtgtgtctgaaatctgatgaggacactctccctgtatgcagatgcactgtgtccactcttgggagaaagcaggcagaggggcaagtgctcttctggtagggcactaacctcattcatcagggccccacactcagacataagtatttcccaaaggctccatttcccaacactgttagaatttcaacatatgagtttcaggaaaaccactcagtgcacccagatgtgattaccattttgctttgcttttttttttccccccatgctgaggatggagccaagggccttgtttgagcctggcaagtccactagcactgagctacatctgcagcgtctggtccttctttctgcagttgtctggaaaacttaagaggcccttcagcatcctttatcattcatttgctttccaggaaacagggataagctctgaggttttcccggccttacatcattcctcctcaggcatccagagggatctgggtggccaccatgcctcccatgggagagcctttccaccacaggactctgacatcaagaagccacacagacagcaccggggtgagagctcagccctgacctgcaatggcagtccagctcccccatccctcccctcatcctccctccttccctggatgctgcaccatcctctctctctctctctctctctctctctctctctctctctctctctctctctctcaggcactcagacaaaggcagaagaggcattgccaacaataaagaatgatgccagtcagcaaaccaagtgagttcctctgtgttcctgaccctaaagcttcacatcacatctacccctccaaatgtttacttggaacacctccactggacacaccaagaggagcccaccccaactgaggaggaaaagcccttccccaccctactattcttcagcagggatgcccggtgcagctggcatccttcctgcttccattctttgacccactgtcatgttttccttctcttcccagctgtggagttgctgtcctagacaaggtaagagaaccctcatttggggggtgggggtgggtctggctcaggtggcacctaacctctatcattctgggattctgtattaaactcaggctggggtagagggataccttcttccaggatggccagatggtcctgagtgtagatgtggggccagaaggaccctaccagatccaaggcaaacctgtaagcctgccaggactctgctacctgtaagcctgccagggctctggctctatgccgaagtcctcctgaatctctttcatctctcccactaggacatcattcaactctcggaatacctcaaagtaagtatcatggtaagccccccacccccaaacatacacacacacacacacacacacacacacacacacacacacacacacacagctctgcacctattcttcctccagattaatctttccttttgcatatcccttctaggaagccttacatagggagctgatcctaaaaaagaaaatggtgattctccaggacctcctgcctgccctgatccgggcctctgacagctcctggaaggtaagggaaaagtcttcttcagacaaagtacgcaggcctatgcatgcctgcctcatttctctcagcataccagctaacaaggacagggctgtctctctgggaagaggcaaaagtggtgatactcagatacagtatcaaagtcaaagggtcacatggtaaatgcatacctagggaagactcagaaccaaaaggagacagaggcctgtctttaaacctgtggaaagaaaagaaagaaatgcctacgcagtgttgtcaaagtcaaggctttcacgagggattctgtgcttgttagttacttttgttgttgatcaacaacaacaaaatcatcaaaataccctacaaaagcaccttccaagaaagggccagttttggtttatggttttagagtatgatcaatcatggtggggaggagggtcatggcagcaggagactgtgaggcaactggtcatgctgcatccatagataagaagctaagacagaaatgctggtgttcatctggctgtccttactcttttttccactgggaagcccagcccatgaaatgggacagtccctttgcaggtgggtctaaccacctctgcaatctagaaactcccatacaaacacatccacgtgtttgtcttcagtgttattctaaacgtcatgaagcagacaatcaaacttaaccatcacagatccatacaagccagtcaatgacaatactctgcctgtagatgggtggcagaatagagaggacttaatgggtgatctagtttgattttctgtttgctgtaacaggccaaggccttgcccacagtcacatagtcgcttagctaagttcagatctctaatgatggtctgttcgttctctagatagccaaacaccatgttcctgcttacaagtactgggaatttgttctttaggaaaaaacatgttgtttgtttgtttgtttgtttgtttgttttgttggttggttggttggttggttggttgtttaaaacatggtcttactatatataactccggatggccatgaacttgctctgtagaccaggctggacttgaactcacagagatgcacctgcttctgtactccaagtgctgcgattaaagtcatgcactgccatactctaggctcagggtcctgctttttagagagttcatagttttgaaaacaaaacacgtaccaaaataatacaatgaaaagaaatgcttccagtgtagggcagactacaggagggaacagacaactccagagaagaagctggaggcacccagacagcaggcatttaccaagcaaatgaggacactaggattgggttacaaacaggacacctaagagccagagcatggcttggtttcgaacaatggctctctaattctttatatcaggatgctttaaaaaaaaaaagtttatttattttacttatatgagtgcactatagctgtcttcagacacaccagaagagggcatcagatccattacagatgcttgtgagccaccatgtggttgctgggaattaaattctctctggacctctgaaagagcagtcagtgctcttaaccactgagccatctctccagcccctacatcaggattcttttttttttcttttagatttatttattttatatatgtgagtacattgttgcagtcttcagacacaccaggagaggtcattggatcccactatagatggttatgggccaccatgtggttgctgggaattgaactcgggacctctggaaaagcagtcagtgcttttaaccactgagccatctctccagtccagggttctttatactaagtttaattaaaaattccaaagaactttggatgtgtaccatatcagaactcaccttgttaaaagttaaaacagaaatttagaaacattaattttgaaatgacactagtcaagcatcattcgttaatttatgtattttaatgaagaattttgttttcaaaaggataaaaagagagaagcggcatatacaatatacatttacaatatctagctgaaaaaatagacagctaaactctatttgcttctgaattcagcctcttgtgattcactcttttagttaaagtgtttgaaagaattcagtgtcatggagacacatgctggaaagggagaggccttgcagatcccttgaaagagtctctaggagctcatgtgtccaacagatgataagcaggttggtgccaccaaagcctaaggcagcaggagtgttgaggcagaatgccagtctcccatgcccccaatgcacctcattggtaggaaggtttatgcttaaagaagtgaaataggaagttacaaaacactccaggaagtttgcagtgatacagaagaccaccactcccacttttcaagctagtcactggacctggattcaggagtccctttggtcaggcccctgcttgccaagtcatttccactagcagggaaggagcctgagccgggcagctgggcatgtgaggtggtttccggtacagagctaaattgagctcatctcacgcaccccttcagcagatactgagtgactttcaactctatgccaggacttcaggaacaaaacgaaatggagcccttgctttgaaagactcacagtccagcaaggaagagtcgcagcagataatgccagtgagacaaggctgcaaacgtatgtgcagcctgacacagaaaaagagagtggctctgcctgaggtagaataaggcaggctgtttgcagagaccttctcagctgggccttacaggatgagccggagcttaccagttcagaagcagcttgatgcggaggaaaagcagaaaagcacttagggaattagactgtttccgggccaaggtgtgcagagcactgggtatagcccaaagccatggacaggaagggatcctgtctgaacagcaccacacaaagacctctctcacagtttcagaacaggagacttgaacctttccggttaaggtttgtttcagatttaatgaaaagacacacaaacacgcataaatacatatttgtatgtgtgtgtgcatgagtgtcacagcggacattttgttttggaacggccaaaccatgaaactgcataccacacccaggttgagaaacctgcctatttggagcagcttgttcactagagaaccgaacagaaaggaatgatctgatctgtgttcatagcttctctaatcaaaggcccagctgagtgaggggtggggccctggagaagtctagaaagcccaggccaactgtgcttagtgggaatgaggcagatactgtaagagctattcatgtagatatcaggaatctgagactggaggattccaaactccaggccagcctgggctatatgttaagcccctgccttcctttttaagctatttctatcataaagttggaggagggtgttattttatcccaggctcttccccaggctccagcttggttcctcgctcccatcttcccacctttcccaggtctcacacatcacacacacacacacacacacacacttctcttgtttctcccaccccaagcttctagcttcctgtatttaagaagtcatccataactgttcacttgagaacccttacttctcccaaaacaaaacacttccaattccacccctcctgagacaactgcagtaagccattggaccgtggcctcatttgatggtgttaggaaagtagctgaatgaatgaggtcagacctgggactcaggcttaagcccagtgtctactttgtcctttccattcgggtccacatatgaatctgcagcttctcatgcaaggatgttcatggtaagatctacaggagaaccccagggttggtgcccctgaagacatccctaggaactgctgagaacccagagctggggtctggccactggaacaaaagtagctctgcctgcagaggaagcaggagtggagcactggggctttaagttctgcaaagcataactgagatcctgagatgacaacacagagggaacaggcttcacccagtatgcaagctgttaggggagagatgagcagccatgggaaggggcttctgtggtgaaggtgtggcgtttctggaaacagagctgaggcaggaggatcaaacagtagcaggatctaaagccttggatcaacactctgtgtgtgtgtgtgtgtgtgtgtgtgtgtgtgtgtggcctcctcactgccttcctctcctttccaagatgctccaggctcctggggtaaggtctgtagccttagagcttctcagatactctaacacagtcgtcagcatgggtagagtcagggtgcgggggcaggaaatcctgtgctccacttgcagcaacgtgaacatggctgggactttcctgcttgccttatggagtctgggaagcagagctctatgtacaagagattttgttcatgccctagacttgggtggcagcccctattcctacttgaaaggggatactgtaaattgtcttgcattgcaacataaatggaaaaataatctgggggttggctgagatacataaacccttgggagaggaaaacactgaattgagcatgatactacagaataggaaggtgcccagaggacattccaaggactctgtctggggcttgtgtcccttccacgctataaggagatgatcctggtctttaaacttggtgggtttggctggcttctgcactgtagattttgggcaaagaaaagtgcatgcagttagtgggaagaccaacgcagagcagggcggggtggggccagcttagtgtgttgccaccagactgacagtgaacaggcccctctggggaatgcagctgttctacctcttacccctgcgcccgaacagtggaagcctttgtccttctctctcattggtcccaagccctgtggttattgtaaatgccaaatccctttctctctgctctttcccacatgcggctgagaaaaacattaatagtaggaggcactttagaaaattgtttttggcaaagatttttgcttttgcaaggcccagctgagtaacacaggaagcagaaagggtgggggctccccctggtccctacagttagaagaattaaacaaataagatcaaacgggagctgtgcgatgccactccctgtcttccccaggcacccgactcccagaaagggaggcccacctcatcccagacaccctcttccaccctagtctttttagccatgagggctggaagtcagtttgacaccaggagccacaacatccaggcctggagaaaggactccaagagtcccacagaacttgggtagacaagtcagagaaggaatatgaaaaccactacagactaactgctcacagctctatctctaaaaaacatactctcattactgacacccccactactccagacagatgtcccctgggtaaaattcaaggctggcaaggggggtgtacacaggtacaaagatcagcaaagtaggtgaaacgctccaatgtatgcaggtacaaggatcttatagctgaaatgctacaagactagaagccagaactgcacctctgctcatctttctctgcttggtcctagatcaagggatacctaccttaaagtgccacgaggcacctcaggacctggggctcacgggacggggcagggacagactattaggttgacccagcttctgaatcgctctgtgactttccaagaggccctcttacccctccccgtgtccacacctactctgtttcgtatctgtaggtccatttctcacttttcaaggaatttctcaggagtcctgccagatagggaggaacacacacaccagtagtcattcctctacagccacaggttccaaagcctcagattcaaccaacattggatcgagtataactgaaagggggtgggggggggaaatcctgtttttcttgtctttcttgtaattagtgccaagtccatacgttatagctgacatttccatggtatttccagtgtactgtgtgtgagagtcagggacgactttaagcatacaggaagatatacatacgccttagataaaagtacacatttacatacaagagagttgaacattctgaggggctctaggaactctcagtggatatgaagggtgtgaaatgcaaggactgccatgacagaaacctctgccccactgtccttggccctgaaatcaaggtatcaccagtaccagtctcccctcctgctgaatgggctgccaacacccatcttgtcttctgtggtcttccctcagtttaaccttgtgttctggtcttgttttagaaaaacattaccagactagactaaattcatttgactgcatttaacttcattgaaggtacagcctctgtcttagggttttactgctgtgaacagtcaccatgaccaaggaaactcttataaggacaatatttaattggagctggcttacaggttcagaggttcagtccattatcatcaaggtgggaacatagcagcatgcaggcagacatggtgcaggaggctctgagaattctacatattcaactaaaggctgctagcagaatactggcttcgagacaactaggatgagggtcttaagcccatgaccacagtgacaaacttactccaacaagttcgcacttcctaatagtgccactccctgggccaagcatatttaaaccatcacaacctccaaatatgctcccgttctacatagaatactgtagctcactgcagcatacaaactgaagggtgaacaaacacacttcaacccctaacaaggagctggaacaaatcagatcctccccaggagcaaagacctcatttagcttcatacctgtgctctacagacaaaggtccaggtccaggatgagagaaggcaaggaaagctgggggtagggggcagtttagaaacctccctctctatggccttctttgctgtctgggccatttgttagagaaattcaagatacaaagagaatttggggccaatcaggatcaccctaggcctacagagagaaaaccaacttcccctcagagtgccttagccatctctgcacctagaggggttcaacccacagcaccaagctttggctgtgggacagggctggagagatgtaacaagcctctttgtggttggttggttggttgttttttccttagcttactaactaatcctgtttattttagggacagcttaatgaagacaagctgaagggcaaactaagatccctagaaaaccagctctacacctgcctgcaggtaagcatcctggagaacactaatttccagcacattaatgtcaataaagttgaaatgtttggatcttagctctgccttctagaaatgctaccaaatggagattagcacactaactcttacctcactgtgcttgtctatgtcatgctgtccctaattggccgtgtaaccacctccaactgcccttctttgtcctaccatgcatgcttttgtaccctgggaagggattccaacactaaacatgttgctggctcctaaggaaatatagggagaagccgttggtaaaggttcacaccacacagtcagtctccacagaacccaatctgaggacaggtgaagagggtctaacagaaaatcacaaaaatagttttcatctcaggaagaaggggttttgtttgtttgtttgtgtttgttttctttagcaggaaccctgagaaagcaaaaactcaagagtctaaagaaagtgatgtaagtgttcaactccagtaatctcttgatttggcctatccccatgttacaataaaagaaaatcagtccccctgacaggtggagagatgggagaacaggggccagcaagaaggcttagtaggtgcttaccaccaagcctaaaggcctgagttcagtctctgggatccatatagtaggaggaaagatctgcatctccctcacaagttgtcctctgacctctacacacactctgtgtatgtggcaagtacacacacacacacacacacacacacacacacacacacacacacgtgcgtgtaagaaatattgaaggaaacataagtaggaagggaatggttgggcttctctcatgtggcaccagagggatcagtaatttcctatgcagctgagaatagtttatagtgtctatagcagcagttcttaacctgtgggtcatgacccctctggcaaacttctatctccaaaactatttacattacaattatcatagctgtaccaaaattacagttatgaagtaacagtgaaagacattttatggttgggctcaccacaacataaggagctgtattaaagtgttgcggcatgaggaagctgaaaaccactcactggtctataggtttccaggtctacatgtttgcttgttttcaatgtgagctgctttgttaggctcttagttaaaatatgcccatcagacttttaagtgacaagcatgtaagccagaatgcaaatctttaatttgtttgttgttgagaaaggtgtagttattaggctgaccttgaacttgtgaccctcccaccagcttccttagtgctagagtcacagatagaagcagctatgccaacgtagtctattaatttttctattggaaatgaagctaacctgtgattactacaattaaatctagtaactaggacatcaccatgtttggcttcaaccagtttctcttgagtttgacttttaatgaaaattccaaaaagcagagtacccttacagatacaaaaataaaattccagacaatcccaaggtgagacaaaatgattgctaatgatcctctccttaaccttcgttgtctggacttacccagatgggtctagaactgaccataaaagctgcctgccttccccaaaaccacaaggcaaaaagaggaggtaacaagggccgtcaatactttactggatctgcaaatctattttatctgatttgggggaattttccttggtccttaagcaggggaaacatctaatgcaaatgcactcttttagaacaccaagtcctcagatcccctgaactttttctttaaaacagcagtgtgtcccctgtttggaaattgtttccagtggagtgaggaagattcatccacagaacagagcactagatgaagggggtgattattggaaattccaaaatcatgggccccattctcataaatgcaaatatgccaatgctaagcaaaaaaagccacgagagctggggctagaggaattagtgagattccgcagaactgatgtgttctctacatctggagcacagaagaagagagggaggctgtggtagaagggctctaccaatggcaggcacttctcagacagcctgggagactcccctgctcagctgttccctgggtatgagacctacagtatgctcatgtgtagatccctggagtgggaagttcaacaagtatttgttggcttgttctgatttacagaaacactccccctggggaatgaaaaaggtgctgctggagatggaagaccagagaagcagctatgagcagaaggctaaggcgtcactgcagaaagtgctggaggagaaaatgtgtgcagagcagcagctacagagggcacaggtggagatgctgtgcagttccaggggctggggccctgggagcagtcccccagagcaagagggctaaccaccacttgcagggagcctgctcctcaaattcatcccgcatattaaacttcaggagttcaatgtgttccctttctctaagcttctgctccttgggaaccttctctcctctggtctctcccagctgtccctggctttggcagagcagaagtgtcaggagtggaagagtcagtacgaggctctgaaggaggactggaggaccctaggggaccagcacagagagctggagagccaactgcatgtgcttcagtccaaactacaggtaccaggcccggcagtgggagaggaagggaggcagaaggggggagaggggtctgctgagaaaggagtctcctaggttgggcctcaaaggttggatacacgtaacaagcagctttcaagtcttcatccactgcccacttagtaccagactcactgttttgctctgaatcataagtgcgtatagagggaatgcctacactgtccatgcaaatgaactaagtacccactggaaagacattaaccaaatacaaatgcctgagttggggcattcattgggttgattggcctaccaattgcacactattcaaacaccaccccagcagggcactcagtgcataactgcccattgttttgtacataataaatgttactggtttatttacaggtactaacacatcctgctggtgtgtttcttaataaatttcagtaaattcttgtcatgctcaaaagttcctacactttcaatctgccaccttagaaaatctaattaatctacattaattaattaatttagattaattgattcatttataattaatttagggtcttttgttgcatggattaaatgtgactactcacacaacatgtgtggcatagtctggtacatatgagcacttcactcgggttagtaattacatggaggcctgacattccacgctccccaaagcataggaattaatccacttgggccagtcaatcttctagctaatgaaccacccctcaggaaggcagattcaccttaagccatgccaaagaaggaaaagtaattattcttttagtgagatcatgaacttccccttcctagaaagcctgagcctggtgtggtcactcacagagtcatggccacgctacttggtcaagcctgaccagtcctctgaatttctcagaaaaatgtaacttttctttttcacatcttctttcttcctaacccttgctgaagcctaggtgtgcttccacaacactcctggctttctcactcttctttgatgttaccctctccgcatcccctttgccatatggctgcgtgccaaactgccgaatccccatccctaactcaaaaggcatgactttctttccctcttctccacctttatcctccaggcagctgctgacattcacaggattctcaatctgcctctgttgtcattattactgtttttggctgttttggttttttttgttttgttttgttttgttttgtttttagtcttcttcagaatctgctcttaatatttttaatgttaaccatctttcttatttttattctcaagattctaattacatttctccctccttctctctccctccaagccctccctatctccctcctagctctccttcatgttcacagcctctttttcatcaattattatttaatgcatatgtgtgcatgcatatatatccctgaatataatctgttgagtctatatgttacttgtatggatattttcattacctatagttctccgtgtaggattgaggcctcatgggctctctccctcatctagtttggcacacccattggtggcctccttttcccttcacatttgggcagccatgttggtgagactttatgggtattgcttctgacattactaggaggcacaatctcacagaaaactccctgatcttacaatctttctgccccctcttttgcaatgttccctgagcctcaagtatggagttattttatagctgtattcattgagaccagaatccacaggtatgcattttgattgatagtggttttctgtagtggtctccatctgtttcaaagagaagtttccttgatgtgttcttaacaaatctaagaactcagagaggagaccctatttccctagtaacatatggcaccccaggtgagcctccccaaaatctccagttaacacatagatttcacatacttagtttgaaactttgaagatctgccctaagagtgaatctttacaatttccccaaacatgaatcaggaaaatatatatatatatttgatgaaagagggtgtgagacatttagaggcacaaattttactggctacacacagcatccacatcttaacctctgctctcttttctcatcatgcataaggcaattcttaggaaagtgttttgaggtttttaaaccttaattctttgtgaaaatagccttaactgcccctctccctcaacaactggtcatgccaaagtaaaaagaaagtaaaacatctagaaaattctggcttgatgtggagatctgtcaaggcatcgagacatacatatccccataaatatcaagtcagaggcactgccataaacatgcaggatagggcagaacaaagagaaggggagagcttccatttcctgacaccccatctcagtaatcctactgtgtcctgttccatggtacctgtctgctctgtcaccagccacactgacctgctgctctgtggctcctccccctcctctttgcagggagcagacagcagagactcacagatgagccaggccctgcagcttttagaaaatgagcaccaggagctgcagaccaaactcgagagcctgcagggagacggagagcagcagagctctgagacccaggacctacaaggtactcctcttctttgaggtcacagggtcattagaaccacaactgaatgggctcagaggaaggaggctatggggagaagctttgctcctcatttgtgcttggtcccatgatttcatttctccttgagggaaaggcagagaaatgtcaatcaaccaaaatgaaccttagttgtccttcatctgaggactctgcatgctctctcctccagcttgaccctgtgggccataccacagctgctcccatactagtcacatgcaaaggccatattcctaatttgaaagggaaaggttagtacaaacacaggcaagatgaaggcctcctagatgtgcctctgtgggctgaaaggacccactagtgtgtgtacacaatattgtgatgttcctgtgtgaatgctggcctctcccttcagatctgaaagacacctgacactcccaggtcacagaggacaggacttacctctcatttccaccctctggtgctctcctatttctgtttgtattctttcgctttcagatcaactaaagaagtcagaggaagagaaacaggccctggtgagcaaagtacaacagctacagagtaagtttccttttcagggttcaacctgcacaggtggtttctgttgctcctgaccacagaagaccttcgaaggagggagggctgagccatggaggcttcagtgtgtcctgtttctgagcatcctcgagcacacttcctgcaaggggctgggctgagggatcatctgcacaaccctccacaagttatatggtttctttcccatgttattacattagcatctgtccttgtgtttcctttctatgtgtgtgtgtgtgtgtgtgtgtgtgtgtgtgtatacacccatgcaatatgcagagtcaagggagctggagggtgttgagtatcttccctgttattgtctgccttagtcccttaagaaagggtgtgtctgtcactgttttccaggtaggctggctagccagcaagccccagccatcttcccttctctgtccccagaactaatagcattagggtaacaggaaaaggcagccacgcccagatttttacatggacgctaacaacctaaagtcaggtcctcgtgcatacacagcaagaactcttactcacacattgttccaggccccacaactgcccactttcaagaagtattaggctaagatagttcttttcttatacattctatggaacacacgtgaacaagtcacttagatttttctcactaaaggttcagaaaataagtatccatcgatcccctacataggaatcaggcatcctggacatatacactgaagtataccaacaagcaaaagtaatagtttcgggactggagagatggttcagcgggtaagaacactgactgctcttccgaaggtcctgagttcaaatcccagcaaccacatggtggctcactaccacccataatgagatctgatgccctcttctggtgcgtctgaagacagctactgtacctatttataataataaataaatctttgggccagagcaaatagggactgagtgagcagagtcgactggagtgagcagggccaactgaagcaagcacaggtcctaaaaattcaattcccaacaattacatgaaggctcacaaccatctatctatacagctacggtgtactcatatacataaaataaataaataaatcttgaaaaaaaagtaatagtttcttaagaaacttccgttctaagcaagtccaggggtaggagatccatggggaaaaaaaaatcagtgtacacgaagtaacaataactactatagagaaaaaagaagctggttaaaggtaaaattagtcattgtttggtagaatgtcacctgggaacatgttcagaagctgacataaggatggcttatttgtaaggaagtaccagattaggtgacttgggagagaaaaaaaaaaaacggaactgttccacagttctggaggctgcagaccaaagtcaagctgcccagagaggtaggccttctgctgtaacggcccctccaagcttccctcaagtgtcgttatatcactttccctggagcatgtatgtaaatcgcccctttctaagaacaccagttatctgtatgaggtctcatcttaatgaccttatgttcaaccaattacctttttaaagactccatctcaaggaagttcacgttacaggggttataacttcaatacaaaaactttaaggaacacaattcagttcctaacagatggtaactaatcttttacaactgaggtcccaagccaatgtctgaagtgagccttgacagtaagtctgctagcacagacaagttccttttgtctcccaacaggtctgcttcagaatcaatccttacaacttcaagaacaggagaagctcttaaagaaaggtcagcaaatttcctcccactaaatgttgctctttctttgcctggggaaaggactacgtgacttctgggggtcccatccactcccgagtctgtgaagtcagggaggtaggggaacgttctgagaaatgatcactggcctggacacttcagccagccacctgctctgggaggtatataaactgtggggaagggtttctactttctctgaaaacatgtgtctctgtcgaacatttcaataaattgattttgaactcaggatttcatgtcagtttttacacagttgactttacaaatcacatccaactcctcaacccaaccatacagcatacaagagtcctcccactccaaccctaaccattctgggtccaaccttgctaaggactcatcagccacagagaggctccagagtctcctcagctatccacaacacacagtctgttgttttattctcacgacgattaggtgtaatacaggagagtgtagaaatgagtgtgccctcacaacatggataagaccataaagagctctgatcagacaattgaacaactgaactaaagcaatagcccagaacttgacttgagtccagtgctgttttcagcaaaactaggacctcaaggtggcagaaacccagctttaaagtattaagaggtaagactagaatgactttcattttcaggtcttggaaatgagggtgcaaaggtcacagaagaatcactaagcaaacctacatgaggaactagatgctttatgactaatgaaaaccatttcaatttgtaaacatccacgaaaagtatcagatccaaagaaaatcaagacaaattttaaaaagtcaaccttgcttccaggagtccaaactgcagctgtgtgtctaagccatagggtacaccagaatacgtttgtttgtttgtttgttttttccatacagtgtctcactatgtagctctggctgtcctggaaatctcagagacccacctatctctgcctcccaatctctgggattgacggccttcatgtgctgctgtgccagcacaccagttatttaattcagaatgttctactccattcagcgaagccacagacacacacacaccatctcccttctctgcaaatgctaagggttctcacgaagcatcagaatcagccctcacaaaggcctcactgttactgtgactctggctgcttttttagatcagggtctgcctgtgtggaatccaaagctctcccttgatgaagtgaagcctgagggcacaagaaaggagaaagaggaggagctcagagaccaactacaaaaggagacatttcagctccaagtcaaggaaaaggaggtgaggaggggacctcagagtgtgaggctcatccagactgttagtgctcatccagattgtgagggttcattgagattggtatggggtgggagtggggcagagaacccttctaggggcaatggaaagcaggaatttccaagcttaaattgttactggatgaccacaagtgttcattttcttctataaatgtctttgctcttggattgacttgcgatctttctccttcctaatttataacaacccctattaaaggatacattggtaaccaattaggagatcaatcagaacacaaaaatatttagtaaacacattaactgcttatattgtcatatactaagtatcagaatgctttattttatgttgtatcttttaaataacaaacactttcctaggaacattctttcaaactcacactcttggaagtgtgcagaagcaactagacaccaaggaagagaggcatgtcctccagtgctgaagaacttatttctttctttatttgtttatttattagtttgcccacatacagagcattttcacaaagtcacatgaaagcatttacaagtcctggggccaataagctggcttagtaggtaaaggtacctgctgccaagcctgatgccctgagttcaatccctgggacctaccatagagatggcaggaaagaagtgactcgaagagttgtcttctgacttacacacacatgtacaagatattagcatacatacacacacactcacaaccctaacaatgaataaataatgcagaataattgaaagtgtttctatgtgtaaaatgtaacagatgcatcataaccaatcttataactcaacatactcacaataaactatatgataggaagaagactaaaatctctgagaaatttgggttagaaaatagttcacttaaaacaagtgaaggagtatagtactcagggcagtcctcttccagaattctgttggaaagagaactgggggctggagagatggctcactggtgaagagcattggctgttcttccagaggtcctgagttcaattcccagcaaccacatgagggctcacaaccatctgtaatgggatctgatgcactcttctggtgtaacttatatacatataataaataaatctttaaaaaagaaagaaaagaaggaaagagagaaagagagagagagagagagagagagagagagagagagaatgagctgatgacaccttgctatgctctccccagtgcagagaactgcattcagaatagacatcctcaatgagaagtacctttcttttttgcaaaagctacatcacagtcaagaagcactgaggcacagccaggagccatttcccagagtaagaagggccatccccctctacagccctacatcacagtggggtagttccttttggtggtggtggtggtggtggatttttttctttcttttttttttttctttgagacagggtttctctgtgtagccttggctgtcctggaactcactctgtagaccaagctgacctcgaactcagaaatccacctgcatctgcctcccaagtgctgtgattaaaggtgtgtgccaccactgcccagctgaatagttcttttttaagcctagtgttacagataaaatatatcagtccacaccaacatctggtcatcctgtcccattccacttgatttacactatgccaacaatacagcaaacatggaagaaacactgtccactattcaccccatttctatgcacctctcgagtctggaagacactagattgagcactcctgctatggaaacctgacatgttctagatccagaacacaccatgcacaaagaagcacaatgctcaaaagaatcaaatgatttcaggacatttggtattcagatgtctttttattacgcctgctcaactggtaaacaaatactaatactactactacaaatactaatacaaatactaaacaaatactaatgggaaaaaaaaagacaaaatttgaatgagtcctaatcccaagcatttcagaaaaaggatattcagcctgtattggttcaagcatgaaagagtacttttttgatttattgtaaacataatgacaagggcagaggaggactgcaaaagtattgaggcgtgtacaaagagtgttattctgctgagttaatttccacctcattcagatcagcatttaaatatctgtcccctgtcagatatgagtctctaggccactagtaaactggttttatctagtggaaatgacaaaaagtgagggagacactgaagagaaaaaaaaaaaaaaagccccttctgccaccagtgtgaggtcttctactgggttaaaatgccaaaggactattcttgcccatactttctccagctaattcatagctgctctctcctgtctccacctccttccatacagctgcagtgtggtcaatggctcccagtgctgatggtggtgattgctacagcactggcagtgttcctggcaaacaaaggcaacctggtcatctgaagaacttctggcatctatctgaagtaaaactcagatgcaaacaactccatgaaaaccttgagttctggtactttataacttgggtttccctccaaatgaatccggactcttagttttatttttttttcaccaggttgtaaataaactttatctcacaagactactctttagaactgtgtattcctgagaaataagccacaagtgtaacccttaagcatcattgtctcgcaccctacttcagttagagttccatacatagattacctagtcattctccttccctctaaggcacaatccaccagggaaggccaccatcccagggtacactcatgtctccacaatgctccttttccatctctcattcaatgaaaaataaacagacacctcggctaaggacctaggaactcctaatataaagactgaaatcatactactgctgccaacgactctccccattcacacgtgttcaattgactgcacaacattcatcgtaattgacattcattgataccttctcaacggacagagttaactcagagggccacagcaggaagtgtgaccacctcagaggagatgctgaggtcagcaaaggcattctgagccctaaatcgggttctgagttccttctcccaggcacttagaaaagtttttcagggctgggaacaaactctctggaacactaaaggagtacagcagaattgatggttgaccaggcagccacgaaatccgggcagtaaacacccgcaggggagtcatggttaagcagttgtcatcttcacggttcaggtcaaatgtgtaagagactggatatcccaggagtatcccaaatacagtgcagagattccagtctgaggaatgtagcctggtgtaggagactccctgagacacatctttcttaagtcctcgaaaacgtgtgatgacgtcagctatgagagatttcaagtccgggagctggtccaccgaccggacagaaggatgaggttgggagcgggaaacgtccacgaaagctacagtaccaagcagtgtctgttccaaatgctgacaggcatactcaggactgacaataaagttattctctccaatctcaagaatgtgaagtcctggctccaggaagcccagcccctgtagttcctccagataactttggagcgccaatactcctgcagagttgcaatcatagagtacagctggcttcagcccgcgggccacagccagcacctctcctgccaggtgaaggcaggtagctcgagatgggcattttctcttgcccatgcccagagtctgctgagcagctgccaccagcagctgagggcttggtgttgacataagatctggaagttacatgacatatggcctccttagctagccacagttcctttccctgggccacacacagttcagctcccagcacttgagaaagatcctagaaacaatatggtagggggaaatcgttaatactgtcaagatggggtcaccaatgctgcaccccatttctctggcagacttaagtttacgaaatcgtccttctagtcacatttacattgtctctggcttcgattctaacttttacctggtgcaatttatgctctgggattcaaaccttacagcaaaagttaccacttctcccaaaactgtccaactgggacagaactctgggctctaaacttcagcgcctgtaagctctccattgccagctcctcagacagatctccacagagcgctcacagcagcctgatcaaaccagcataagctacaacgcggagtaatcaccgcctcaccctgcgacactcaggtaagagaagacgctagaactggggcacgagccagtttaacacttgctggaccctcttcccttctaggaaggcacgctcccaccgccacacctacccacacgtgcctacgcggtggtagactagttacaaaaggaagcgctctgcctcaagacactcggctagcatttccgccgcaggttcgggggcgcaggaagcccttccgcctgcccgccagcggcgtagtgccctcccacgccccacactcggtactgtgaaaacccgacagtgtgtgcagaagcccagggaaagacagcctgacgtgcatgcgcactggcttactccgcctttccgtgacgtcatttgaaaagcaaacgcaagccagaacctttgacgaggctgcggacggagtgggaggtaaagccaccttagacccgccccttccggtagagcccctgcgggcgggccttgcgaggcggaagtggaagtgggggagaagccgctgggaccgctagttgtcagtccgcggaataagggacacctctcctgtgggcaatgctgtaaagctttattttttattattatttttttaatgtacctaaattctgaacttgacaggtatgccaaggccatgcatattcactccttttttaaaaatcgccttattgtgtgggcgtgcacaatggcgccctgtcagctctcgcttccaccttgtaagagggtccgaggtactgaactcaggaagccagcctgctgagcaagtgccattaactgctgagccagtactgttgtactatgtgttgcaggggctggcccggaacgggacttctcgttctctggtttatgccgcgttggggattgagctctggaattcacgcgtgccaaacactactaactgtatgtctgcagcctgagtattcactctcagtgtgccgaggtactgcattgtaccttcttcatggagctcaaagcccgagagtccagtttgctgatcatcttattttaaaagattgatttttatttccattcataagtttgtgcaggtgcccaggaagccagaaaagggagtagggtcacctggagctgaataagttaaaaatattgtgagctgcctaacacgggctttgggaacggaattcaaatctttgggagaaaaagcaggtctcatctctacagccacactgttgtggtggggatttgtttgttgagacaatgtcttgctatgtattcctcaaacatgacaatcctcctgcctcagcctcggaagttctgaggttagagtctaccctaattgaatgatacctcaaggagttatctatacctcaaggaggctgggcaaaactaaggaggggaacaccatctaggaagccaaaggtgagttaacatccttactggccgcttcaaggccacccatgcccctgaccataacctctgacccactgctttgtaagtaaacctaatggactccttggtaccccagattgaactttggtggaactgtaccctcatctgccattaggaccttagaaagtgccttgttcctttctccagagaagtcttacagcagataggaaggtcaaatgttgacataaggaatttgcctatatcttctgtgaaggaaatcttaagaaaactctagcctggacaaatggccccaagttatgggcagcaaaatggagacccagactggaggttttacagtggtgctatgctggtaccttcataccaaaaaggaccagcagtgtgttaaagacagacagacagtatgtaaggaggatcagtttgtagggcctgccagtctaacttaggttctcagctcagggggagtcagtactaaaaattgatagaaccagtactctagctttatatttttttcttcccaagtttattttacgttctcatgatagttagcaataaatctccaaattgaaagacgtaggtcatttattacagcacaaatatcttagaacacactgtatcagacactgctaaagacctggcaataaatctaagacaaacagttttgactttccaagttggcagtcagtcaagcagaacatagatgcggagcaatttacaaacgacacagttactcttaaagtttaagatgctacatgaacatacaactgagaactgtggagaggagatgagattcagcatctgccttcagggtttatctgtagtggttcttttaacattggagttaatctggagtgcacagtaaggaaaaggaggaactgggggaaatcctcctcccttctgagtcttcaaatgaaggcaggaagaagacagctggagagtgaatgggagcattgggaaacttagagctcctggggacttggtatctactaaaaccagagaaagcttactgaatatgacaagagaagatcctgcatgtagtgtgtgctcccagcattccgaaaaagatgcaagacaagaaactggactgcctagataggaccacacaaaatcatgcattgtcccaacatatttgtcaatttttcattatggtcacacactaataactcaatccatagccctcagaacatatttttcaacattctttaccagatcctgttgtctggacattcctcatagcctgctgacttgtcacagaagggaaaggaaatgtcccctattccacagctaccctcccactttctctgtaatgggttacttttaactctgagcttccagatggagcatccacacatcaagactccctcacttcatctcaccaaatgatgctactaattcctccaaaaaagaataaagtccctagccttgcatgattcctggtctataaaagcctaacttttaaacttctacctaaacttctctttaaacatttttagttagcatacaaagagttttactctgacatgttcatactatggccatgtgtataaaattatactttgctcttattcacagagacacctgcctttcctaactcacccagatttctcttggtcctccttttaataatctctaagagaactttaaaccaaatcttaagcatcctaagtaagtctcactgccaccaaaattaggttgagctgttagactttaaatgcatcccaactttcagtggctagaaaagcaaaaggtgctacctttagtgtaagggcagcagactgtacagagaggcatatccctgtgacatgaaacagatagacaccagtattcaagaggattgaggctataaccagagagacccatcttacttttcatctaagtcttggaattcaaattatgagaagggactggagcagacactctatgagacataactgcactgttcttcactgtctccatggctcacaacaagtgatataagcaggtttgagccttccccagaagagcactatccagacgtttaatatatgaaacacctcattttcataaatggaaaaatctgaatgtcagactcttgaaagtctctgaacaagaacggtcaattttgttgtcagagcatatcacagatgcccgactccctccagatggtctttgagaagaaaataaggaagaggagagtgtctgccatgaggcacatggaatcatagttgctcatcaacttcacatataagatggtgtgagtggtgacaaggtatgtggctggtgacaattctcccatggagtccctccactgacaaccattcttactctcgtggaatcctttggctttccatgtcaccatcttctcctttaatacttactttatgagcttttactccacacacaggttgggtgactttcagaccttggcaccatctctatttagatatcaagactggttgctaggcaaccaatcagctcctctcttacttcctccagcagggagccagctgactgtactagcagaacaggtcaaacagagctcaattcagatcagatcagtgttcaaggaacttggatgaaagcaagaaggggaaaccatgtggtctaaacacaatgcagaagggtcctgttcaggcagttttgtcttaaacaagtagaggaaaataatcgagtcagagttttaaggccaaatgcaattttgggcatcattccaaaccttttttatttacaagtgatgcatctgatgccctccagttaaacgatctgtctaacgtcagacggaaacacagctgcagttagagttctggtgtctaaacttcgacatcaaatctcctacaccaaccatgggaagatctaaaaggaacccctcaggggatgataccttgataagttagaggaacttttaaaactaggcatatttggaaagtctcagacttctaatgaggttatagaaaggagatttaaaaattgactaaacctgaacttaaaaaaaatccttatgtacaatataaaaatgagagaggagagaagaggacacgcacagcagtctgggtcactgggcaggcagagcctgtggcagctgcatgctgggggcaggctgcatgggctgccagctctcctgggtttgaaggatgcggtacagctgcttgagctgagcaacgatgttatctttgatgtctggagtggagatctgcaggcgaacgctgccactgtcaaaggaccgggtaaaatcaccagaaaacatctcatagatcatgcgagccaccactgggatgacctgttcaggcaagagcacacaagtttccactgaagaacaggcatttttaagtagcaggagaggccccgacattgatgaagaagctctgaggccctgagaagcactcggcttccccaccaacatctagatactagtgaacagctatatctcactagtcaaggtttaccttagatgttggttaattcaaagaaaggaacctggatgtagcatcattccacatgcctagctaggtggtggcttacttagcaaaactgtgaatcaagaggcatccactgcctatcttggtgtataagtccatgcaaaaccccaagtagacttgcaaccatccccagaacagttacatcttacaaacatggccaaaatgttttataagaagatatagaaaatgttacttcttataaggtcttagcaagatcctaacatcagcaggagaatgaaaggtgaagtgtccgttaaattgtccatccatgttaagaatgtggtactgtacaacacagtacctactgtgcaaaacttaagtctgctgcctcacccaagggcattaaaatacacataggtcagtggatgctcaaccaggactcatcccagaccaatgggtaaagcaccagcagaaagaagagttgctgtgatggacttatctcctcacctggaccaagatgagcttcctctccaggggctttccatctggccactcttccccaaagcataagtagatctcaaaaggcggctgcttctctatctgtcctttctggtgggcaatgagctctgcagaagatggaaaagcactcctggattattctctgcctgcgccaatcaatgttgccttccatgcagcccaatacaatacccgtaatccatgtgtggctattgattttaaattaattaaaattaaatcactccttggtcataccagtcacatttacatgttcaccagacacaggtgaccagtgtctaccaaactgaacatcacaaaataaaacttgtctatcatttcagagggttctactggaaactagggatatagacttgggattcaaaacacactatagatttatagctcaatgatttttctaaacctgcctccttaaattaactactcaaacatttcctgaaagaagagtttgagttttgctatgatgaacaaggttaccttccaaagtgaacgataatcaaacagttggggagagaagtgctggcaagactgttttttctgtgcccgaaggagccataaccaacctcaaaacacctttcatgtagatagtcctggagctcaactccctttgtgactgtccttgaccttttgttacaccaggaaagcttaggtggggtgggagaagaaggaagaggaggaaagagaggaagaggaggaggagcaggaacaggaggaggagaaaggagaaagacctttagggaacatctcctagtatcaatcttctaaaaacagactcaccactcaggaaggtttccagacaaaacaacttgaccttcttctgcctctcaatcaggttaggagcagcaagcgagggagcacatggccctgaccagtacactttgcactggcacagcctgatggcataaatggcatgtccgctgacctccaggatcagtcccctgtccatgacatccaacagcttgctggtgaacagcttctgcttctcgttggtgatatgctctggacctgggaacttgacctgctccaggctgacaggaccaaagagctcctcctggtcgggcatggggcccaggtccccatagaagagccggcagccctgggggttgctcaccgtcatagtttgcccatactccttcccacgatactgaaatttgatgtccaagtcagtcactacaaggtgagagatgagagtgagtcctgctgctctgctttgtctgtctatccctaagactcatgtgagtccaccaagatcaagccatcatctttcaaccagctttcaggaaggtcattgccttagttatccttcctgcaataaagggaggtatcaacatatcccaggggagtcacacagaaggacaccttgcagcagagcttaaggtccagatgtactctctgctcagttgccacacccttgggactagaatctaactccacatactgatggtcctggtatcccaggtcacactatagtaaagataaattggcaacatctgagggggatggcaagactgtctccctccaatatgggtaactgcttgccacatgtgtgcaccaagaacatgtgtgatgaatgtgaccaaggatctatttgatgtcaattaatttaaattgataatcacatgtgactagtagctactttattgtgcatcatggaaggtgtttactgaacgaagagagagtggccacatctttagagaataggcaacagtgtctggtttgcacttcactttttttttttctgagacaggatctcacataacccaaactaaacttaaactccctatgtagcaaagaatggccttgaactcctaatcctcctacctccagttcctgaatgctgggattataggtgtattaaaccttacccagttttatttagtgctagaaatcaaaaccagggtttcctgtatcataggcaagcatactattgactgggctacacccttagccctgcatctcactttttaaagtaactggaggaacaagaaaaaataccaagccatccttctgaaatcctacatgctagtacacaccctgaacctgttctacacatgctataaaaggaggctcactgagaagtacattttcactcagcacgtctcccctgaccccaacaggccttatcaaagctacacagcttcttggacaagattttaggttcatgtctcatcatgtagagtgtgaaaaggtgacgggggaaaagagttaattcttcatcaagataaacgtgtacctaattcagagagtccctaaagtccctcaaaattaagagccttgggtgactaaatccatgccgtggcctagcacttccctgtcttagagcagaccttgtcaccaaatccccaagaacagcaataattaacttgtacctcttaccaatcaggacaactgaacagacaagaagggatgggcaaacatttctgtacttccctagtaacacatctcacagttcgtaaggatacagagagcacatgggcggggcaggtagctattctagacatttcaaaaaaataaggtagacaaggtctggggatgtgactcagtggtgttttcctagcactcaaaaggctctggtttgattctctgcacttgaggaaaagaacagagaaggaggtaggggataagggaggaaaagccatgcaataagagattaagccccagcaatacaaagcaggcccgcttactggggagagagctgatccatagctctggagaactgtagaagggttgaatgggtgcctggggtacttccatctccagaggttctgttttgggccacactgattcggggctgcagtttcccacactgcagttgcccacgctggctggcgccatgggagaacctagaacagaagaaagtgggtaagcacacagggcacaatatcatctggcctgaggctcagagaacaagcaaggtagctatagaggagtcgccgaaccataacctggtatgacctcccagcctagcacagatctcatgactcagtagctacacagctcctgattcccagccgttttatttctcccataagctcattgctttgaaaccctttatttgctaaagatcagatggaaacaatgtaacttcctctgattcagacagc

SEQ ID NO: 638 - DNA, 1891 bp, Mus musculus
cgaaaataacgtcagtataagaagaaaatggtgagggggtttagaaacttcttcagaaactcggcttgacagcttccccagccttctgagaccagagagacctagaaagaaagggctgaaggctctcctgagacacttgagacagaacctgggacttgagggatccctgtaacaggctcttcagctcccgctgagaactctgaactaagaaggccagattcgtgtaggaagccacccatcatctcctctgcatacacagccaggagatccaagcagctgttcaagggaaagtaagccaaacacaacaggtgctcggggaggccaccatgatcagctcagactcgaggtcctcccctggcttggctcggtgggctgagagctatgaggccaagtgtgagcgacgtcaggagacccgagaaaaccgtcgccgccgccgcaatgagaccacttgccgccagccagggaaggtgctgaggacccaacacaaggaacggcttcagggagctcggcagctacagttcctcaaaaggagaaacctggaagaagagaagaaaggccaagccagggaacaagggccctccagcaagacagatggaggaacaggccaagtgtctatcctcaaggagtccttgcctggtgccaacaaggcctctttccctggacagcaggtgcgatatggagataatgctgctccagggccgggggtggggggtggggggagaagggcggtatctgcaagctgtggagttgctgtcctagacaaggacatcattcaactctcggaatacctcaaagaagccttacatagggagctgatcctaaaaaagaaaatggtgattctccaggacctcctgcctgccctgatccgggcctctgacagctcctggaagggacagcttaatgaagacaagctgaagggcaaactaagatccctagaaaaccagctctacacctgcctgcagaaacactccccctggggaatgaaaaaggtgctgctggagatggaagaccagagaagcagctatgagcagaaggctaaggcgtcactgcagaaagtgctggaggagaaaatgtgtgcagagcagcagctacagagggcacagctgtccctggctttggcagagcagaagtgtcaggagtggaagagtcagtacgaggctctgaaggaggactggaggaccctaggggaccagcacagagagctggagagccaactgcatgtgcttcagtccaaactacagggagcagacagcagagactcacagatgagccaggccctgcagcttttagaaaatgagcaccaggagctgcagaccaaactcgagagcctgcagggagacggagagcagcagagctctgagacccaggacctacaagatcaactaaagaagtcagaggaagagaaacaggccctggtgagcaaagtacaacagctacagagtctgcttcagaatcaatccttacaacttcaagaacaggagaagctcttaaagaaagatcagggtctgcctgtgtggaatccaaagctctcccttgatgaagtgaagcctgagggcacaagaaaggagaaagaggaggagctcagagaccaactacaaaaggagacatttcagctccaagtcaaggaaaaggagctgcagtgtggtcaatggctcccagtgctgatggtggtgattgctacagcactggcagtgttcctggcaaacaaaggcaacctggtcatctgaagaacttctggcatctatctgaagtaaaactcagatgcaaacaactccatgaaaaccttgagttctggtactttataacttgggtttccctccaaatgaatccggactcttagttttatttttttttcaccaggttgtaaataaactttatctcacaagactac

SEQ ID NO: 639 - protein, 499 aa, Mus musculus
EATHHLLCIHSQEIQAAVQGKVSQTQQVLGEATMISSDSRSSPGLARWAESYEAKCERRQETRENRRRRRNETTCRQPGKVLRTQHKERLQGARQLQFLKRRNLEEEKKGQAREQGPSSKTDGGTGQVSILKESLPGANKASFPGQQVRYGDNAAPGPGVGGGGRRAVSASCGVAVLDKDIIQLSEYLKEALHRELILKKKMVILQDLLPALIRASDSSWKGQLNEDKLKGKLRSLENQLYTCLQKHSPWGMKKVLLEMEDQRSSYEQKAKASLQKVLEEKMCAEQQLQRAQLSLALAEQKCQEWKSQYEALKEDWRTLGDQHRELESQLHVLQSKLQGADSRDSQMSQALQLLENEHQELQTKLESLQGDGEQQSSETQDLQDQLKKSEEEKQALVSKVQQLQSLLQNQSLQLQEQEKLLKKDQGLPVWNPKLSLDEVKPEGTRKEKEEELRDQLQKETFQLQVKEKELQCGQWLPVLMVVIATALAVFLANKGNLVI

SEQ ID NO: 640 - DNA, 46143 bp, Homo sapiens
agtcagatacagaaagaaaaatattgcattatctcacttaaaaaaaaaaaagaaaaacttgaatatatagaaacagagagtagaaaggtggttggggtacagggatgatggggagacagcggtcaaagggcacaaagtttcagttatgtaaaataaataagcctagagatctaatgtacaatataggggcagcaaaactccacctccattctcagagagtcctggctgagcccaagaattaaactgatataagacagattaacagaagacaagcaaacaaatttatttaatagaaattttgcatggcacaggagaacctcataaggaaataaagacccaaagaagcagttagagtcagttacaaactcagtatactgaatttgacaaagaatagcacactgtgaaatgtgataaggcaagtggcttgggctagggtatttaattgggtagagatgcaactaggaagataagggttagtttaacaaggtttgtttgtacagatttctcttggcttcagcttctcatccttgatgataagactgttcctttttttttcctactacagggaggatgtctttcccatgagaatgtcatctgcttttaagaaacagctcaaaggtcagagtgatcttcttgcacttgctgttttttaagtgcccttaactcaaatagtcaatatgccagaatggcatatctttaactcctgaaacatcacgaggactatagttaatagtattgcatcatatactggaaataacagagtagattttacgtacttttaccacaataaaaaaaaaaggtgactatgtgagatgatgaatatgttaacttgcttgactgtagccattatttcactatgtaaatgtacagtcatgcatggcttaacaacggggataagaccggagaaatgcatcacagttgactccatcattgttccaacatcatagagtgtatttacacatacctagctgatagaacctaccacacacctaggctgcatggtataccttccgctcctcggctacaaacctgtgcaacatgttaccatactgaatactgcaggcaattgtaacacaatggcaaatatttgtgtatctaaacatatctaagcatagaaaatgtagagtaaaaatacaatattataatcttataggaccactatcgtatatacggtccatcattgaccaaaacatcattatgctatgcatgactgcatatcaaaaaatcaatttttaaaagatggaaaagtaccagatgagcactggctgatttggggaggctttctgggaaggatgataggaaacagcaaccctaggggaggacacattggtacaccgcataacctggaatcagagggtggaaactggggactggcccaaaagacccttaacaatgaggggctgaggcccaagggacacaatgacagagcgttcgagcatctctctgctgagcgactcgctgccccgggaccgctggggtggtgtgcgtcaggggctccctcacaccgtccttgaacagtaccgtggaccacaaaagagcaaggctgtcctaaggaaagactttgcctcttcgccggcctccctttgggccgtcagggtggcagcgccaccccgtggctgaatgtggtggtgtaccacgcttcacgcaatctccttgcccagtgcgtatcaggttctaccccagggcggccaccacctgcacaccagcgtgcctaccagtgagtcatcgcttagggccctgaactgacctagaggcggggctggactccggcgtccggtaactccgcccggctgctggggcctacgtttggcattgagccgtggggaactagacctgttcaatagcgacagctagtggtcaccctcaaaaacaaggtgctctgaacctcgcggggaaagcgctgtcaagatatgggaaaatcaggacagatgattggccttgagtggaagctggcacattttcgaagccactcttgggtaaaatggtctgtcgaaaacccaaacgctttaaagtgatgtacaacgaccttggctgcctctccagccacatctcgggccacctgccttgcttttgattccccaaggacaaagaactgccagtcctctgaagcaccctgatgatcccactgtgtgttggccatgccatctcctctgccctgagcgctcttcactctccccattgcatggttaactcctgggcctcctttaaggttaggcccaaccattacctcctccaggaaaacttccttcccttccacccggtccacctctcaaggctggggcaagtgagctcccacctctatcccatgcctctacagttttctgtatttgtttatcacttgagtttatcacactttttaaatttacctgaaaattgccttgtgtgtctgtaactaagagaagatactgactatattgtactcattgttgcatctctagtactgagtgcaattttaggcatttagaaggtatttaatgtttaagaaataaagaactcatagaccctcatactgggaaaggctttagaagaaacggagacccacaggggcaaaacagccttgcatttcaacagagaggcggagacggatctaaaagtcagctcactggattccagtcattgcctgttgccctacaccacgctgtttttgccccctgctgacacccaatgcactgagctctcaagctggtgagagagccttccagctctactgaccctgccatctccaccatgccctaaagcccagcttgattccctcccacccacttcctggaaatctttgctctcagaactaacctacttcttcactaaacttctccagcaaacccactccaaggttttatcctaaagaaagtattttaaaagaagaaaaacaaataaatgcatgcatgaagatacccattggcagcattatctgtaaaagctaaaaattagaaatgacaaaaatctccatataattaaataaaattaaattcctctatataatttccacatgaataaaattcctaattatatcatgcaaactaaaacgagtttcactgcaacattggaatatttttatttttactttattgtgttaccaaacacttccatagtatttactatatttaggaactattctactgaatattaactaatttaaatcatcaaaagagccctatgagacaggtgctattgtgattctcattattagtcagaacacatttgttttggtctaacttaaaatggaatttaaatgacacacagtgagaaacactacgagccacttcaaatgtttttcttccatggagaacagtgcaagacacattctttaaaaaacttagttaaatgagttttaaaacttacaagtttagatcagacaaaatgcattgactcactgaaactactccattttcacacagccacagatctgcaagtccatttcatcataaccattaataaatcacaagacagatgctccaaattgcaggtgttgctaatagtgatagctcacatttcttaatgctttacaagtattatatctggtaatcctataacaattctgtaaagtagatattatcggttatagccattttacagaggagggaactgagatgcaaagacctcaaacgtagtgttcatgcactctaagctcaaacagatagtaaggggcaaagccaggcttcacacccaggcagtctgacttctggtgtccctgcccatctagccccaggctgccactcaggacagcttcagagtgagcaacagtcttgaagtatagatgacagatgtgatagataaagtaatcctgttacaaagttaaacataatcacagctctgaattattacaattacagaaaattattataacatattaatttttattatgtatattaagttgtatttgcattgtatttgccagtggctaattattatcctgagcaatgctgggtcacgtggctactggttaatgataaggaaattactaaacacgttgtggtacactaatattatgaaagaccatgacgatgtgaaagctaaaaaaatggaaaaaatgtaaaagcaaaaaatatttataatatagtattaagcgaaaaaacaaacacacaattcatataattacatattacaaaaatgtagatttcactatgcttaaaatattattaaaaagaaatgcatattatcaaaaactagaaggtagtgtgaaaaatatgaaactaatttgtctttgggtagtaggttaagataattatttttctattttaaaaatcttttagtaatattatattaaaatttgtataaatctgaaaaaaaaaaaaagaaaatccgaatgctttccaactcatttctctgtccatctgcctttagttttctaagcaaaccctaaagtttctctctgcaggcgggggcgagggcgtgtgcagggagtgctgatggcaatctaatatgtgagcacttttggtgaaatcagtttggttcagtgttacagcatcaatttaatattctttgttatggatgataaatcatactgagtataaaacagattctaaaggtttgtgtagaaatgtataaaatgtatagaaaagtctctggaagatatctcagtttggaatgtgaaggcatttgtgaaataattaggatagtttaactgaggctgtgccaagagatgacaatttaactaggaaggaaaattgtcagtttcagaaagaggatcacactattaaatgacctaattttgttagacggccaacatccccaatatcggagtattcatgagtacagttactagtgctgaggctctcagaattcttagctaaagacattgatcatggctctgactgcctaggctatgtgaaaaaacatgacgtacaaaaagtaagtagaagtatattttaatcaacagaaacctcatatttgttatttctgttgaatgataatttttggaaactcagtaatttacgtaagaatatcttttaaataaagaatgtgggccagtcacggtggctcacacctgtaatcccagtactttgggaggccgaggcaagtggatcacttgaggtcaggagtttgagaccagcctggccaacatggcaaaaccccgtctctactttaaaaaatacaaaaattagccagcatggtggcgtgtgcctataatcccagctactcgggaggctgaggtgggagaatcacttgaacccagaggcagaggttgcagtgagccaagatcgtgccactgcactccagcctgggcaacagagcaagactccatctcaaaaaagaatgtgattttttagccacaaactaggagtcctatttattggaaaactcacacatacactagggagaggagggtggtgcttcggctgagctctaaaaagcagtaatttttcatttataaaagggcattttatgagtagaagacaagtcattatgatatttaactcaggaacagccctatttcatattctggcaggagtcaagggtacagaacctcaaatgaaggataaagaagagaaatgaaagctctctgaagattaacttgtggtttgtcctttccgtccaaatagagatgggtgcctgggaggcccccctttttctgttctacattactctttccttttctgtttcctaatatacatacactcctacctctatacctaccccaccttcacccccaagcctgaggctgcagcctgtcaaggcccttcaatgtcacagccagtgagaccacctttcttatgagcctacaacaaaaagtaacttgtcccttgctcaatgctggacccacaagaacggatccacagttatttgagccttatggttaggcctttcagattcttagaatctaaacaacagataaatctcttgctaatattgaaagtctcttacagcataaatttgaggtttcattacacgaaaaggctctctaccaacaatgatgatacaaagcaagcaaagacaagaggaggacttagaactctgtcctgccacaaatgtacagtcataactcgacagagcagcaaccttgcaaacgtaggagtcaaggaaatacttgtcttcctcctggtgagtttagactgtatcatctctgagaatgaatatttgtctttgggatgtttgtgtggacatctgagtaaacagttaccagctagacacttggaaaactaaggaggagagtctgcaagtcacctgataaggagaacttgaacttgaatgcgaacagacttaagtatgcctgccctgagctgttctgcaaaatttggagtgccaaggccgctgtggactatcctattaagagtgtctgcagcactattctagaatgaataacttagacttgaggaatgcggtgctgaagaaaccttgtcaggagtgtagggaaggattctaaggcaagaacaactcttatgaatgaggttgccatttcccagaagataggtaggagtcaccctgtagagtggaaagaggagtgggattagaactggtaacacccatgaggggacccccataaagtgtttaacttcatggtggctcatgcctgtaatcctagtactttgggaggctaaggcaggtggatcacttaaggtcaggagttcgagaccagccgggccaacattgcaaaaccccgtctctactaaaaatacaaaaaattagccagacgtggtggtgcatgcctataatcccagctactccagaggctgaggcacccgggaggcagaggttgcagtgagctgagatcatgccactgcactccagcttgggcaacagagcgaaactccatctcaagaaaaaaaaaaatttttttaactccttagtgctgtctcttggagtatgggagaagtcatattagcatatagtttagttaccccaactgtacaataaaatctgataatcttacacatgcttgtgtggtattgtgaagcaaccaggctataaaggaaagggtagcttaccccatactcatcgcctcatgggggactacacagggcccagcatctatcaaggaaactgtttcagaatatgaccatcaaaaaagggagccgttgttcccattgaacctggaaatgatgaggagaagcaaaggatactggccactaaaagcctggtgcccagctcaagagcagcctgaattaaaccctctattggaggccagctgatgattacactacaaatctctacttgagcttaatttggtaaattcattttcttaaatccattttatctagattttaaaaatcattagcatagttacacaaatgactctctataattaatttccaccgtatcgtggctactttccatgtatcattcctaaacttttataatgtcttttctcttttttaaattgatttggctcgctgatattttattttattgattttgttttctatttgtatgtctaccattcctccccctgccagatgcacacacaaaactgaattttttttatcaattttaaacaggattctaacttattatatattctccttttatcatttcaaaattctcacctcctttttttctgatcattttttagcaattcatttgaaaataaatgaataggaaatttatttttaatcttcttgatttaggtaatgaaaatgtttaaagctaggaattttccttgcattctgcttggccatacctcacagattttcctcataatgttgccactatcaccgttttcaatgcattcttaattgcagatttgaaattccctctatcttttcagagtaaatgggaagaatttttttccaagaagttaaagtgtttctttcttccatcttttgttatttatttcaattgtattgtactgtggtcagaaaatcctgccataatagatcaacttttcaaaacatatactgaggtttactttttgatccatatggtcaatttttttaatgtctcgtgggcatttgaaaataaggtatattttctattctcaaagttctgtgtgtgtgtgtgtgtctttttcaatatagatagataggtatgacaaccttattaattgttttgttctcagaacacaatgttaagggctcaaacctactgtcaagcaaacctgggtccaacactttctgtgtgatcttgagcatatcattgaccactctaaatcccagttatcatgggattagtatcccaatgactgcggagctttgtagacatttctttctgatgtttaatggagtccaaatagtaggtctctataggaactcctattaaaatctcctgtctttctttacgctctaatgccctgaactcccagaatcttctcactcttctatgccaataaaaattctctggccaggcgtggtggctcatgcctgtgatcgcagcactttgggaggccgaggcaggtggatcacctgaggtcagtagtttgagtccagcctgactaacatggttgaaaccccatttctactaaatacaaaaaattatccaggcatggtggcgtatgcctgtaatcccagctactcaggaggctgaggcaggagaattgcttgaacctgggaggcggaggttgcagtgaaccgagatcgcgcaattgcactccagcttaggcaacaagagtgaaactccgtctcactctgtcgcccaggctagagtgcagtggcacattcttggctcactgcaacctctgcctcccaggttcaagcgattcttgtgcctcagcctcccaagtagctgggtttacaggcacatgccatgacatccggctaattttttatatttttggtagagatggggtttcaccatgttggccaggctagtcttgaactcttgacctcaagtgatccacccacctggacctcccaaagtgctgggattacaggtgtgagccactgtgcccggccaaaattctctttttctgacatcttgggctccccaagccctctgtcctctactcattcccatctctatgtgtcaagctccagacacagggccttgagctgttgtctctcatcctgagtaaatgccacttgtcttcagtcctagtgcttgagaatccatcctctgcttttccctgccgattccttgtcctttttctcctcaaagaacagagaaagaagcagaagcagagaaaatggtgacaaactctccacatgttaataaatgttatcacagctatttttaagtctcattacctgcctcacatgtgtcaaaccttagaattccaaagagccacatacatcacccaactaccacagtgagtagcatccagacaaggtgaattttacaaggttacaaagctgctcagttaacttgtcccaatccagtttcctctccactattttagcctgaacttcttgggaatttcctggctgcatcatttgtgatggcttcatcttaatgcatgcaaatcagttccctttagtttttccctaaatttcctagtccggttgaccagataaaaaaatgtgtagaagactctgccttctattccttccttcatcccccagctacccacctttacactccctcctcattgctccagaaaggagcaaatccagagttggtctcattccagaatctgagaaagacaccacctacttcagaagagcagaaactctttacaacaccaggattgggaagaggtggctaaagaaaaaggaaaatccttacacaaagaactacctgatacacatgaaagcctacactgagaacatctcatctaggtcttaccaccaaaaaggcatttttttccctctcatagaaaccacaaaggtctgaatctgacccagaggactatccttttctaatcatggaaaggaatcttgacttgaaactgtccaagagctccaaccaatccagtagcaagagaaagggtggccggggtgcctactgatgggaggagctcctgagcccagccctggaggcctcagagttcaggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggaggtaactgagaaggaggatgcttttgtgtccaggtttgggaactccaacttcggggtagggcagaagatgctctaccatcccagctcccctgggtggagagtgggtggcatagtttaagggtgtcaggggtttgggtaaccaagaaagtatcctgtattggtttcctgtggcgctagccatggcacagggtacagcttgcaccactcctctgttccagtagattagattacattagattaggagtgagtcaaacgacttagagttcaggctacccagtgatatgggcatgaattaaatgaccttttacagttttcttcaaagcagggatccctgaacacaagactgccttcccagcagcttaagcgcaggcccctctcccctcagttcacactgagagctctgggccaggaaggccaacccatgcaggaagccattcattgtctccattacaaacatggccaggaagtaaaagcgagactcagaaaggcatgtcaagccacagtcaggtgaggagccatgccctgttctctctctgcagcctgagagaccaggctgagccttcccagccagtaaaccttcttcctccaagctctaagtgagcccagtcatgctgccaggggggaacctgagagatgccagaaagcctgggcagtggccaagtgatctttctttgaaccctacagggaccagttcccttttctttagcagcctacccctgtcagccgtcccacataccttcttgttttcaagcaagtcagtagggtccagatatcccagaaacctgggtagggttctatgcagcatgctgcaccaaatcctagcaggtgtggtagccaaggcatctgggaacactcccctctctaaggagccatttccactgcagctcctttcttgggtaagaaggctccatgtctgccccaaggaagcagagagcagagcagctgtgtgtttcagtggactaaggttggtggcctgggtggagagcccagagagacctcatctcaggcactgtcttctcccccacagccctttcctcttcgcggcaagaaggtaggaggattctcaatgttctgcctccactacaaaacctgtggggaagctgagccaaacagggaggggacctcacaccttatgtgtgacacaggcagaccccatctcttccttacctttcggcttggtgtaattgggatggcaattatgtccagaccacagagaagcctttctccttatagcccaaacccagaggtcagaagtaaatgtgacttcagcctggggccagcatcccctcaatctggtaaacaatatactctgtcaaagagagagagggttgagaggatgagagaaggcattcttggtcctagaagtgctagtttagcttggagcctttgtcttacagcaccaagtcttcaatatccaacatcggcataacaaggataatattcgcaattacttttgcaccaacctaataggaatactttatgtctttattattaaaaggtaacatttattgtgtgctccatgccaggtgcatggcctgcattttgtcatttaatccttataacctacaaggcaggtcctagccccattttataaatgaggagactggggcttagagatgtttaatagcttatctaaaaacacacacaggttgtaggtgacagagccaggacatgagtccacgcagtgtgactccaagagccagggttctccactgcaatccatggcagaatagccaggggctgtggctcagggatgctgtgagtgtaggttctagacatggagttcacatgcacataatcctgcgtctcctccattcagtcatttataacaatagacatgggtctctcagaccctttcttttaagtctttaaataaagaaagtggcagggaagaagtcaagggaccaccccctatgcccactcccacccttatccgagaagaagaagtaaggaaaaacaaagaagagagccattcagaatgggtatgtagaggacaaacattaataacctcacatttctgcttggaatcaatgctgcctgacaccagagtatgcccctccaaccctcaagagtcaggcatttgagtgtccagggcttgaccacacaaaactcctctcagggaagaagactgccccacccatgaccctggggaatgagtggtaggatcagagagaaaacaagaatcctgcagagaattccagactgagccagagtagcgaagtcccagtaaaggggcagagagtctgctacctgttgagtctgtttggcctataaataaaccccaaggggttagagctagcaaatgcctgctagttggtgaagctgagataccctcctcccagggtggtgggtaatgaggtcgtgggaggaagagaagcagcagcagctgtgagggggagtccctcttccttcatcagtccctggtctgactccagtgatcagaggaggcaggacacagaatttccaacgctcaggatccagctcatccaaatccagcccaactcagcaaagtgaccagagggttctaggaggataaactacagaaggtaggtggggaagagtaggaaagagaaaggcacagagaaggaaaaggggattcaggtctaggtgctatgtgaatatcaggtaaggccatgcagagggtcatcctgtggcccctacaccaagcctggctccctggaaacttctgattactgtctttgttttgtttcttttctgtttgcagcagccttattgaggtacaattcatgtgcttgtgggtttggatggcacaatctgtgtctgggctaaggaaagcagacttggcaccaacattaaccctgacaggttggtaatcctaaagaaatggaaccctcagccccaacagtattggagccagatgctctgaaatgggttttggccagcactaggcatgtggcagatgctcagtcaatattgattggacttgatctgcacctgagagacacagcccagtcctgagcttggagtggggggcccatggaccattgtcaggacagcaggttggaggaattagggtagggtttccctcctaaaccatgccaggtccaggctcacaagctcgttgctaaaagtcaagaagagagcagtgggtgctggtcacaggactggtcaccacctgagggggtgtggttagccctccagatccttgagaagtgtcactcaactatgttagtgacagcttggaccaagagaccagtaaagatactgactttccttttcaactgggggataagagggcagattggctcaacttagctgcttctctagaagtctggaaaatgaacacacacctgccatccaagaggctataagctcattatgattttaatcaattatttctcatgttcccctgactcagaggcatggtaagatgttcagtcaaggagtaagtggcagccatagagacccttttactttacaaaggggaaacatcggctagagaaaagcaggaattcacttttataagactgtattagttcattagagactgagcccaagagtcctgactcccactttgataccaccatgtcctcagttttcaacccacatggatggaactctgtgctatttctgccccctggtctagggagatagtcatttttctgcccatcttctgacccctccccttctcctccctcttggcatttggcagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgggccgtgtcaagggacatactgctgtgtgctctgggaccctctctggacaaggagggtgggtgggctcaaggtcactaaaaagtgacctaaatcaagtccttcttcctcagtcatatagtaaagttgccaagagctacttatagtaaagttgccaacagctacttattcagagatttttgctgttgtgttttcgtttgtttagctctttttgttctgcacttgacttataagagagaaaaaataatttttaaaaacaatttcaggctgggcatgttggcttatacctgtaatcccagtactttgggaggccaaggcaggaggatcacttgaggccaggagttcgagaccagccttttgatagagacaagaccctgtctctatcaaaaactttacaaactaaccaggcatggtggtgcacacctgtagtcctaactaatcaggaggcaaagatgggaggattacttgaacccaggagtttgaagctgcaataagctatgatcacaccattgcactccagcctgggcaagagagggagaccctatctctaaaaaacttaaaaataaaataaataaaaataattccaaagctaatgcctatatcagttcaaatttaggcaatatacacatgtcttctacagctatcttacagcattcattcatccatcagtcatcaaatatttactgaaagcttattatatgccaagcacacaggccagtcttcttgacacacacacagacatatctgtcctcttttcttctgcaaggctgttgtgcccactcttctcacttcctcttgtgtcattccaattctattaaatcacttgactatagcctcatctggtccaggaagctttccctggcttctccaggccacctctgctgtctatgggccttgtgaggttaaaatcttctaagattgtgtaacccttagagggcccattagtctggcctggaaaggaacaatgttggcaaaaaccagggtatgctgagatgaccttggccagcaaaccatcttcctactgaagttgtgagcatgttgacagcagggatgtgtccactatgttccatggtaatgcttggcattgttccctacccagagtgggtactccatcagggcttcttaactagtggatctgttatgctcaataggagatgctgttcagagaaatgatcctagagcccagttgcaaaagaaaaggaactgtatactaaagcaaaaaaccttcccacaactccccactttacctagtcttcacacaaaacctcaatgattttctagctgttactaagagaaaggaggctttcctttgaatatggaaggaaccttatggattatctattccaaactcctcactacacagacagaagactgagacctagaaaagatgggatctgaacccagatcccctcactccccactcagaccagttctctttccacatcaccatgctggctatgtaagtggccataaccaaacaaggtagagagagaaaaaaaaacaacaactagagattctagagagaaaacctggagaaaagtacagctccacatatgcctggcctgaggaggaccatttctgccagtcaggacaaggatatcaggagcaggagaagcctgtgtggctctgaaagcttgagtgggctactttggttttgtggatctgaaacattgtcttcgtcctgtaatgaattaccacagactgggtggcttaaataacagaaatttatttcttacaattctggagtctggagttctaaacccatggattctgcagatctggtgtctgatgagagcactcttcccactatgcagatggccttcttctcattgtgtcctcacaaggcagagagcagagagagaaagcaagctctctcgtgtctcttctaataatggcactaatcccattcatgagggctacctgctctgacctaattatttctcaaagtctccacctcctaatactatcacattgggagataggatttcaacacacagatttgggcggggggacaataaacactcagtccataacaaacatgatggttagttcttccttccgaaatcatcaggagagtctttcaagaggctccaggcagtggttttcagcattccccacttgccttccaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtaagagcagagcctccctcactccacagggcctgcagagaatcctgagacaactgtcccagctcactggcaatggagagtccctgtccctccccacttccctcacttcctccctgtaagttctaaatcaacttatcctccatctctcaggtactcagacaaaggcagaaggaccaacaattaagaacgatgccagtcagcaaaccaagtgagttcctgaccctaaccctctcacatcccatccattcctctctagagagaacacaatgaatttccatgtccgccttaattaagaaagaggaagcccttccccaccctactggctcttcagaaggaatcaacccactgcctcctgacttgattctttggtccattatcattatttttaatttcttctctttccagttacggagttgcagttctggataaggtaagcacatattcactttgaaggggtcaaatcagaaagtattaagctctgacattctggaattccatgataaacttggctgggatggaggggcatcttcttcctggatggcaagggggtactgagcatagacatggggactaaagggaccctgtcagagccaaagcagaagaggtttgctctacacaagccagcccaggctctggttctatatcccagggtttcaggggacttacagacattttgaatacccttgttctttctctccaggaaatcatccagctttctgattacctcaaagtaagtggcatgtgacccctcccctcagttcctccatccacttacccccgatcctccaggttaatcttaccctcttgcactttgtgcccgcacccccaggaggccctacaaagggagctggtcctaaaacagaaaatggtgattctccaagacctactgtccactctgattcaggcctctgacagctcttggaaggtaagggaatgaaattctttttgaacaaagcttgggcttctatgtgttcccatctcatttttctttccacatcatcacagtaagagaaggggttttctcactactgaaaagtaagctgggaagaggcaggagatgagggggatggtgctcagacctagaagtcaaacaggtcacaataaatatatgggtcatcacctgagggtcatggtgctacatatccaaggaagacccagaaacaaaagtggcaagaattcccattttttaatttgttggaaggaatgaaggaagatcccaatatagtttacattactaaatatggtaaatgtcaaatattttcatatgggattcccactgatatttatcgaaaccagcatgccatgtacccactcagtccgaataaaaatatcagagtgggaagggaccttagagacaatctggcctaatactcttattttgcccatgaggaaactgagcttcataggggtcaagtaacttgcgaaaagtcacacagctaggtagtggcagatctgcaactaaaattcaggcctttgattttagtccattcaatgtacaatattcataggttatgtcctctatacagagcactggactagcactagaaataatgagattatttagatagggttcttgctttgagaaggctcacggttttgtaagaaagacacatgactaaacaatacaaaaacatgaaaaataaaagaaatgttttcaagatataggaaaatacaagaaggaatgagtgactccagagaagaaaagagccaggggaatacttatataagcatttgccaggaaaatatggaagaaggaatagtattttagttggggtacaggcaaaggtctaaaggcaaggccgggggtggtggctcacacctgtaatcccagcactttgggagcccgaggcgggtggatcacctgaggtcaggagttcaagaccagcctggccaacatggcgaaaccccgtctctactaaaaatacaaaaatattagctgggtgtggttgcacatgcctgtaatcccagctactcaggaggctgaggcaggagaatcgcttgaaccaagaaggcagaggttgcagtaagctgagatcacctcattgcactccagcctggacaaaagagcgagactccatctcaaaaaaaaaaaaaaaaaatctaaaggcatgacacagtctagtaaaatggttctccaatttttttatttcaggattcctttatactttttaaattattgaaaatatataagaaatgtttatatttaccatactagaaattaaaacagttggccaggtgccgtgcatcatgtctgtaaatcccagcactttggaaggctgatgcaggaagatcacctgaggtcaggaattagagaccagcccggccaacatggcaaaaccctgtctctactaaaaatacaaaaattagccaggcgtggtggtgcacacctgtaatctcagctactccggaggctgggccacgagaatcgcttgagcccaggaagtggaggttgcagtgagcgatgatagtgccactacactccagcctagatgacagagcaggactctgagagacaggagagagagagagagagagagagagagagagagagggagagagagagagaggaaggaaggaaggaaggaaggaaggaaggaaggaaggaaggaaggaaggaaggaaggaagaaattaagatagaaattgagaaagaattattaattttaaaataatgagagtaaaatttttcatgctaacctgaattacatgttttaagaaaaacagtctgggtgcggtggttcacacctgtaatcccagactttgggaggccaaggcaggtggatcacttgagctcaggagttcaagaccagcctgggcaacatggcaaaacctcgtctctactaaaaatacaaaaaattagccaggtacattggcatgcacctgtagtcttaggaactcaggaggctaaggcaggagaatctcttacgtcccaggggtggaggttgcagtgagccaagactgcaccactgcattccagcctgggcgatgggagtgaaactctgtctcaaaaaagaaaaagaaaaagaaccatattttcaaaaacaaaattagtgacaggagtatcattgctttacacttttgcaaatatttttaatgtctggctgaaaaaaaagacagctagcttctcaatttgcttctgtattcaatctattggtttaaacataaagaaaaattcagtttcacacaaatatgtcattagaaaaagtaagactttgctgatcccttaaaagggtcttggggattcccaagtttcctcagaatccccatgttgaaacctgtaaattagtatgtactataaattcatgtattaatatgagctacaagcagcttgacaccaccaaagcataccgcaccgggtggaaagagatggagcacacaacctcaccggcctgtgtgacatctcaccctaccttgaagatggcttgagcagagaaagaaagatgatgggagagtatggaacaaaactgagaagttgcagtgatgtaaaaaagatttcctaagctcagccctgctcctcacgtcagacattgtacctggatttctcaatctgtggtcagagctcctgattgttaggtcattttcattgacagagcaggaacttggggcagacagctgtgcacgtgaggtggtttctggtcctgaactaaattgagatcatctcactcatttgtttgacagtcatttgataagttccaactctgtgctgggccttgtgctacaggggcaaagagcattacagtcctaactcttgaggagctcacagtccagccatgaagacagagacatgtaataaataacaccaaaacagtataataaggctatagcagcagtgcataaagcatgatgcaggaaaaagagaaagaaggcagcaattattccacctgaggtggaacagggaaggctttaaaggaaggaaacctggccaggcacggcagctcatgcctataatcccagcactttgggaggccaaggcaggtggaccacttgaggccaggagttcaagaccagcctggccaacatggcgaaaacccgtctctactaaagatacaaaaattagctgagcgtaatcgtgcatgcctgaagtccgagctactcaggaggctgagacacaagaattgcttgaacccaggaggtggaggttgcagtgagctgagattgtgccactgcactccagcctgggtgacggagcaagattctgtctcaaaaaataaaaataaaggaaagaaaccattttagctgaatcttgaaggatgagtaggagctaaccagtagagaagcaagagtgatgatgagggaaaaaagcagaaagtagaagagtgtttaaggtaaaggaattggaatgattacaggcctatgtatggcaaagaattgggtatagcagagtatggctgaaatgaaggtatgccagagtagtaccaaagaaaggatctcagacaggtctttagaattatgggtcttaaactttttctgttgaacaaggtatctcaaacttgaataatgcatggacccatttttaaaggaaacccatatatgtatatatataaaatcagagatcctttagaatgcatgctacccagcttgagaaacactgctataggtaataagctgagtaagaatggaactatgctttattgaggtataaagtcctacacttagcaatgtctggctcatccttagaaggtatgcaattactatctgaggaaatgacttgtgaatgatcagatctgtgtcttaaaaagttctgtaatttccaactggatgcagtgtctcacacctgtaatcccaacactttggggggccaaggcagaaggatcacttgagtgatcaagaccagcctgggcaacatagtgagacctcatctctattaaaaataaaaaaattagccatgcatggtggtacacacctatagtcacagctacttgggaggctgaggcaggaggatcgcttgagcccaggaggtccaggctgcaccactgtactcctgcatggggtaacagagcaagaccctgtcttgaaaaaaaaaaaagaggggggagggttcaaggattatctaacttgtagcaataagaaccctggctccaagcaggggttgggggagttgagactcttgtaatatcccaggtaagacacaaccagagcttgaatcaaagcaagctttgtgggaatgaggggggatatattaagagacatttctgggtttgtctccaaggaggagtttcaccccatgctccagcccaagagcagaagttcccttggttgtggtttcctccctcccttcttctcacccctcccaatcctcacccttctcttctttgtccctcctccccaccaaccccctagcttccagttttaaagaaaaacagtctcagactttttcagttaacagctattgtttcccctaaaataaggtaattcaactctctatctcttccatgaaagcctcaactccaataaaagtatagccccaaactgtggtatctgggaaaaataattggaagaaagtggccagaactggttcagacctttatttttgccatttgaccttcataaatttgaatttccaacttcacatgctgagaacttaccacaaactccctattagaatcccaaggatcagctccctccgctggcttcacctccggatgtctctgggccttttggataccataggctctggggcactattgagactcctgaggagggtccaaccttcagggcagaaacagctctactagcagagaaagcaagctttcaatattgtgcaatacaaaaacgagagcagggcagccttgggtttgaagatctgcgtcctggaattaagatcttgagatgacagcgcagcggggattggctgaagccctaagcaacctctactagagcagagagatgagctgtgggctggtgcttctgtggtgaggtggtggtgtttctggagagcagatcagaggcaggggaaaaccacgcagaagcaggagctgaagacctcagaccggcaccaggtgtgtatggcctccgccttgctcctctcttcactggggtttatatgccctctgagccctcggctcccggggtctaactgcctagaatgtcagcagtaggcctgtaaaaagtgcttcttcccacatactgtaacactgggcttcagtgtgggggaccctggggctcagaccaggaaactacatgcccgatttgcaacaacttggctgcgacttttatgacgttttggggagtccagaaaagcagagctgtggaaagaggtttcattcaagctccagacttgggtggcccttcatccccactgaagtggctatggtaaattgtcttccgttgcaacacgaatggaaaagtaatttggggttgggccaatacaaaaacagttgaaagaggcaaaatattggattaaagccatactatggaatggggagagaggaggtaccccaaaagggtaggagactgggaaaattttaagaatattgccttaggcctgctatattcccaaaatacagcaagataaaccttaaatttggtaggtttgattgcattctgcatagaaagagtttgggcaaaggcaaatgtgtggaaccgaagatgtgaaccagaggaggtaggtgtagagccagttgatttcaggacctgtggattgacaatgaacaggccacagtggaatgcagccgttttaccagttacttcaaagctcaaacagtagaagtctttgtccacgtcttccatcggtcccaaagccctctgcttattgtagatgccaaatccctgactctctgctctccctcacatgagacgttaggaaaaacattaatagcaggaggcactttaaaaaattatttttggcaacactttttgcttttgcaagccccagctgagtaacacaggaagctgaaagggtgggggcaccccctggctcccatggttagaagaataagccaaacaagatcaaaacaggagctgcgagataccacttcctgcctctcccaggcaccctgaaactcactgagggaggcggacctcaaagccgagccccctcctctacccccagaccattacaaaccggaaatgttataagagatggaaatgtccaggccatctggctgagagagcccatggcgtctcgggcctaaagagaggtggaatttcaagacctcacaagcgtcccacttggcctggttggaaaaagccagagaaaagataggaaaaccggtcactgccctttctctggaaaacttgctctcattgatggctcctccgccccctcccctacacagatacaccctacacaaaactccaggctggaagaacaaaacccctacctgggcaaaaggggcaagtctacaaagggaggggacaaaaaagtggcagggaagctgtagctactaagctgaaatactgaaaaaccgagaaacagattggctcttcatgccggccttgctcccctctcgcccttgagattagcatctttcttggaatgtcgaaaataccattagacagccccagcttatgaataaatagaatgtgactttctgggaagctcccttacaccccctgccgccctcactctgctttaatatctctccgtttcttgctttcttaaagaagttctcatcttgagtctagtatgtacgtgtgcatgtggaaatgtatgtatgcaggtggaggtgtgtgtgtggagatggaagtgtgtatgtccagatggaattgtgcgtgtgcatgtggaggtgtgtgtgtgcaggtggaggtgtgtgtgtgcatgtggaggtgtgtgtgtgcaggtggaggtatgtgtgtgcatgtggaggtgtgtgtgtgcatgtggaagtgtgcgtgtgcatgtgaaagtatgtgtgtgcaggtggaagtgtgcgtgtgcaggtggaggtgtgtgtgtccaggtagaatgtgtgtgcatgtggaggtgtatctgtgcatgtggaggtgtgtgtgcagctggaagttgtgtgcaggtggaggtgcacatgtgcatgtgaaggtgtgtgtgtgcatatggaggtgtgtgtgtgcatgtggaggtgtgtgtgtgcaggtggaggtgtgcgtgtgcaggtggaggtgtgcgtgtgcaggtggaggtgtgcgtgtgcctatggaggtgtgtgtgtgtgcatatggaggtgtgtgtgtgcaggtggaggtgtgtgtctatatagaagtgtgtgtgtgcatgtgaaagtgtgtgtgtgccatgtggaggtgtgcgtgtgcaggtgaaggtgtgcgtgtgcaggtgaaggtgtgcgtgtgcaggtggaggtgtgcgtgtgcatgtggaggggtgcgtgtgcatgtggaggtgtgtgtgtgcaggtggaggtgtgcgtgtgcatgtggatgtgtgtgtgtgctcaggtggaagtgtgcgtgtgcatgtggaggtgtgtgtgcaggtggaggtgtgtgtgtgcaggtggaagtgtgcatgcatgtggaagtgtgcgtgtgcatatggatgtgtgtgcatgtgaaggttgtgtgcatgtggaggtgtgcgtgcgcatgtggaggtgtgcgtgttcatgtgaaggtgtgtgtgtgcatgtgaaggtatgtgtgtgcaggtggaggtgtgtgtccctacggaggtgtgcatctgcatgtgaaggtgtgcgtgtgcatgtgaaggtgtgtgtgtgcatgtggaggtgtatctgtgcatgtggaggtgtgcgtgtgcagctggaggtgtgtgtgcaggtggaagtgtgcatgtgcatgtgaaggtatgcatgtgcaggtggaggtgtgtgcatgtggaggtgtgtgtgcatgtgaaggtgtgcgtgtgcatatggaggtgtgcgtgtgcatgtgaaggtgtgtgtgaaggtgtgtgtgtgcaggtggaggtacgtgtatgcaggtggaggtgtatgtgtgcagtggaagtgtacgtgtgcatgtggaggtgtgtgtgcgcatgtggtgtgcgtgtgcatatggaggtgtgcgtgtgcatgtgaaggtgtgcatgtgaaggtgtgtgttcaggtggaggtacgtgtgtgcaggtggaggtgtatgtgtgcaggtggaagtgtacgtgtgcatgtggaggtgtgtgcgcgcatgtgaaggtgtgtgtgtatatggaggtgtgcgtgtgcatatgcaggtgtgcgtgtgcatgtgaaggtgtgtgtgtgcaggtggaggtacgtgtgtgcaggtggaagtgtacgtgtgcatgtggaggtgtgtgcgcgcatgtgaaggtgtgtgtgtatatggaggtgtgcgtgtgcatatgcaggtgtgcgtgtgcatgtgaaggtgtgtgtgtgcaggtggaggtacgtgtgtgcaggtggaagtgtatgtgtgcaggtggaagtgtacgtgtgcatgtggaggtgtgtgtgcacatgtgaaggtgtgtgtatatggaggtgtgtgtgtgcatgtggaggtgtgtgtggcagggaggggagtgtattaatctcctagggctgctatgacaaagtaccacagtcaggggaacttcaaaaacaaacttattttctcatagttctggaggctaaaagtctgagatcgaggtgtcagcagagttcgtttctcctgcggtctctcttcctggcttacagattgccatctctctctgtgtctccacatggccttcctgcagtgccctgatctcctcttttaataaggacatccatcatattggattagggccagcttaatggcctcattttaacttaactacatctttaaagaccctttctccaaatatggtcacattctggggcactcggggcttaggacttcaacatagaaatgttgaggagatataaatgagctcataaccgagggcaagggagggaataaacattctcccgggaggggagactgcgttagcctcactggcctacattttacagggaaaagtccacgtacaagactgagaagaggtgaggagtgcagaagtgcctagacaggggagggagatagtgagcgaaagggtagcttagaagctttccttccggggcccccctgctatgctaccctgagccatttgataaaaatcgaggtaaaaagaggacttgaggccagtcttattctttcttgtcctagtccagagaaacaggagaagatcctcttctatccagcatcctttgtcatctttgctcctgcctgcctcctgaaagagttcactgtttgagcaccaaccatgtgctgggcagtagaataggaatatagagtcaaactctttgcagactagattttgccccaagctcattaactcatcccatttgctccagggacagcttaatgaagacaaactgaaggggaaactgagatccttagaaaaccagctatacacctgtacccaggtaagcattctgaaggatacttccatctcaggaatctagaattaaatgagaagaatgtttttgaacctcaatcttactttcgagaaacaccaccagatagagaataacacacccattcctacttacccatttctggcttggccatttacactttagtctctaattcactagatcactgtctccatccttcttcctctccctttctcccagtatccttctctttgcaccctggaggaatcccagcactaaccagtttgtcagctccaggggaaccttgagaatacctgacactgtaggggaaggcccttggtaaagactcacatcacccagacagccctttacacatcctaatctttgaacagatgagttagatgttataatgaagtcttacaaaattattttcattccatgggtaacttttttctgttttttctagcaacccctggaagaatgtaaaagctcttttacttggctcttctgtaacaccattttccagcattagtaatctcttgattggcctaatcttggtttataagagatagaaagaaatcagctttcacatttgagaagtgatggatacctgacaggtgggaagatatcaaatcagagaatggggtgaaacaggcagaattctcccatctggagttagagagagaagacagtcctggccacattgatggcgtcttacaggggaagagagtttatggagtctataagtttcttggtccacaactttcattttttcagtataacttgctttgtcaggactaaataatgccaaccaagttcacaggagactaatatataatccagaatgccagtctattcattttcaatagggaataacacataaccagtgcccagcatggatggtcattggatgtccaataactgggacatcccctacatatgacctcaaccaggttaattcctggatctggtttttaatgaaagttccaaaactataagacccactcaaatttaaatccaaaatttcagacaattccaaagctaaatggaaatgatttcatattgatccctaaattgttgtcatctggtctactgcttacacagtaggtaatccagaattgacaataaaatctgcctgccttctccgaaatcacagggcataaagatgaaagaaagggagaaggcaagacccccagtgaatttgcaaagctgcgcttgtgtctccttaatcctgcagccaggaggaattttataatgcaaatgtattaattttaaaacatgaagttcattaggcattgtaaagaagctacaatgatttttttttaaagcagcagcagtatgctccctccctgaaggagtttacaatccagtatgaaagacagatgagtcaatagagtagaataatagaggcatgcaggggatactatgtgaacaccatgaaccctaagaaaagctacctaatccataagacattgtgggatgggggtagttggtcaatttatcagaactgatgatactggactgaatcttgagtattagtagaagttaactggctgtaggcagaagaagctacatgggtaaaggcagagccccaaaaaacagagtgctgggggatctgcaaacatctcagcttaggtggaagtagcatgggatgaaagtctaggcgtgtaagaggagccatgacaaggagtttggatgtgattcttagtatgctgagaatccatggagagatttatacaggaagtggcaagatcagatttgcattttagaaagaaccctctaaatgcagaactgaaaagggactgaagggaggcaagatttgaagaaagggaggctgttgcattaatccacataacactactactagagcctgaactaaggaagcagcagtagggatagagaggagacagatatgagctgttaaggaaattgtcaaggctcaatgaccaactgattagagggggaggaagtgagagagaaaatgaagattgactccctggtttagggtttggaaaagcctggatggatgatgattctggtcactgagataggaaccccaagaaaaaagaacatgtttagaaagatgagtcctgtttagacatcttggattccaagagcttgcagaaggcctcagatataatgcccaggaagcctagggcactgtttattatgccctccactcatctctcattgcctgagggactcttcttgctagctctaccctaaaagaaatggctcactagattactggtatctctgcctgggggaagaaccaacttcttttcatttctgtatcccagctcaggatttggcacacagaagctcaatgtgtatttgttgaattgcatcaaatttacagaaatactccccttggggaatgaaaaaagtactactggagatggaagaccagaaaaacagctatgagcagaaggccaaggagtcactgcagaaagtgctggaggagaaaatgaatgcagagcagcaactacagagcacacaggtatggggatgccacatagacatggggctggggactccaggcagcttggggaacaaggggagccagctgcacaactccctggagccctctcctctctgatctccctcagcgatccctggccctggcagagcagaagtgtgaagagtggaggagccagtatgaggctctgaaggaggactggaggacccttgggacccagcacagggagctggagagccaactccacgtgcttcagtccaaactgcaggtaccaggcactgggggtggggagggaagacagggtatggggaggagggatggtgatgaaagaagctgttctggattagggactccaaaggcagctgacagcatctggctttcagttcctcagtcaccactactttgtaccaaattcactgttttggctctgaaatctaattttgagtttagcaaggatgtctgcattgctcatgcaaatgaactaagcgttcattggaatgacaccatcaccacccaaatgaaaagaactggctggaatattcatcagcctactaatgtcatctcccaacccactctccaaactccatcccaaaaaagcatccagttcagaattgcccactgttggcaaagaaagaatgtcactaatttatttacaggtgagtattaacactttctgccaatgtgtattttaagcaattacatttagcaattacaattagattcttggcatcctcaagggttccatcatcttcaatctgtcctaagcctcagtttccccatctctaaaatgaggataatagtacctacatcataaggtggttctgagtattaagtaagatgatccatgtaaagcacttagcacaatgcctggcacacaaaaacactcagtaaatattagctattattttgcatagatttatttacctggtttggaattttgaggatccacctcaaaagctgatctttgtaattttcctgaagcagggctcagaacagcccacttgataagagacagagtatgtgagtcttatcaaaggagtgaacccagctggtcactctgcgtggtatccacagctcaacctttgttgttttcttcttcccatcacctataaggcaactcctatgaagatttttgtgaggggttttttaactttaaatctttgtggaaaaaaaaagaccctaaccaaaaaaaaaaactgatactgccagaagtagaaaaaagagaaaatgaaaacatccagaaaactaatgactttgtattccttaatttggtgatttaccaaagtgtcaagacatgactcccacaccaatgacaaccacttacatttcccctagaatggcagattttttaacgtactgggtttcctaaagcaattcttattttatatattctaatttatgtacatgaatgtgtcacttagacctgtcactagggatggtttagaaaataaacttacactgcacatgcctcagtccacttcaaaactactggcaaatgcctgtagtcccagctactcagaaggctaagatgggaggattgcttgagcccaagaggtcgaggctgcaatgtgctatgatggcaccactgcactccagtctgggtgacaaagtgagaccccatctctaaaaataaaaataaataaataaaagacgcgagttccttgtgaatatcaaaagtctaatctgctgttataaatatgaggaacaaagcaaagggaagaaataggaaaaaagaaagacttctctattttctcatctccctaacattccttctatctctaaaattccagacttttctacattttcctcttccatggtacccgccccccaacctccaccccaacactgacctccttctatattggcccctcctcctccttacagggagcagatagcagggacttacagatgaaccaggccctgcgatttttggaaaatgagcaccaggaactgcaggccaagattgaatgcctgcaaggggacagagacctgtgcagcttggatacccaggacctacaaggtactcttctccttggaggccttgagtgcatggcagccatggccaagtgagctaagaaaaaagaaactgaattaagagaaaggcttcagccttttatttgtttgcttgattggttgattggctttataatctcattttaccttgagggagaggcaggactgttttaatcatccaaaattgaaaattaatttcactgtagtagatagagtatcttgttgtctgagctctcttttttagcccatccctctgggccagatcacagctgctcccacatcagtcacatatgtcaaggccacagtcctaatttgaaagggaaaggtcagttgaaacacaaggcatagagaaagtctctcagtcacatcctctgtgtccgctgatagagaggactagatagtgtgtaaacacaagcctcaatgcaacccaacattgttgatgcacaaaaacctgaggtacttggcttctggtttacctcttcagaactgggacacgaagatagagcaacttccaatagacacacgttaaagaccatgacaagacagcatctattactaatttccatcctaagtactgagttcattaagtcttgggttcctttattttggcttgcattattgcattttcagatcaactaaaaaggtcagaggcagagaaactcaccctggtgaccagagtacagcagttgcagggtaagttcgctttccagattctgaaagtccacagggttttcctggggtcctggcccacaaaaggcacccagagtagggactaagggcccagtctttggcatatgctctaactctgtgcactttcagaccctcttcttgtaaagtgaggtcatttacatagctctccataaattatgtgttagcctctgttcttttttttctactgttctccttccatgccaatgacaccacttacatttcccctagaactgcagattttttttaaatactgggtttcctaaagcagttcttattttatatattctaatttatgtacatgaatgtgtcacatagacctgtcattagagatggtttagaaaataagcttacactatacgtgcctcaatccacttcaaaactacatattgggcccaaagaggaaaagggacttctcagaagaaaagcagtttctgaaaagctggagaacctgactcaattaatacagctgctggttgcccaccactttaacctctgacacctgatagagaagcttcatgaaagcagcaatgattattaagagagcaaagcaaccacagggaaaagggaaaatcttcaagcaaagacttgaagatagagacatggtagggggagatataaggatgctatattcatagcaaagtaccacagactgggtgccttgaagaacagaaatgtattgtctcacagttctggagactagaaatccaagatgtcagcagggttgtttccttctgagggcgtttagggaaagatctatcccagggctctttccttggctttgtagatggccgtcttctctctgtgtctcttcacattgtctttcccatgaacatatctgtgtccatatttccccttcttataaggacaccagtgatattagattggggcccacctgaatgaccccattttaacttgattatcttttaaagaatctatctccaaataaggtcattatttaaggtactgagggttaggacttcaacatatatattctgggggacaaaattcaacacacagcagatgggaacatatttaataaccaaggttctaagcaaagttctgaaaagaaaactttttgtagtaaatatgctagcatagacaagttccttgtgttttccaacaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataagactggggatacaaagaaaagatcccaatcttgccctcaaggagctcagattccagctgtctgtccaagcttagcaggggcctactggaagttaacctttatgtcagagaatgccatcagtctagccaagagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgccagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagatcagcaaagtcattctgagtcctaaatcgggttctgaggtccttctcccaggtgtttagaatgtccctcaggcctgggaacaaactctctgggacactaaaagaatagagcaggattgggggttgacctagcaaccatgagatccgggcagtgaatactcgtagtggagtcagagctaagcagttgtcatctccctggttcaggtgaaaggtatagggaacaggatagcccaggaggatcccaaatacagtacacagattccagtctgaggaatggagcctgctgtaggagactgctagagataagtccctctgcagcccctgcaaatgtgtgatgatctcagccacgagggccttcaagtcctgaagctggtccagggagcagacagaagggtgacgctggcagctggaaacatccacaaaggctatggtaccaagcagcacctgctccaagtgctgacatacatgctcaggactgacaatcaggctgttttctccaatctcaaggatgtgaagtccaaaagtcaggaagccaagccccttcagctcctccagatagctctggagctctgatgcccctgcacagttgcaatcatagagcacagctggcttcagtccccgggccacagccagcacctctccagctaagtgaaggcagatggcttggggtggactccgtctctttcccatgccaagggtctgctgagcagctgccaccagcagctgagggctcggtgatgacatgagatctagaagcaacatcaagaatggcctccttagctagcccgagttcccttccctgggtggcatctttcagccagacacttgaggaggggcctagaaacaaagcaggagcagggaattattaacagccttcctgttaaatcgcggtatcttccaaaggttattctgtccctccctgctttgaaatggcgacccagcccagacaagatagtttcaccgatgctgcttgatttttctggttgacttggtctccctcaatcataaattcgtgtgtttttctagccttatagctagatttatattccctctggcttttattctaaatttcacctgttgcaaattacgttctctggttcaaaccgtagggaatttggggcagaggcggaggcggggcagtgtttggcaaaattcacagcatttcgcccaaaagcccttctgggacagagctccaagttccaaatgtatcctttccactgacaactcccctactcttcccgccagagaatagttataagaatagtaatttgattaatatacaccagaatgtggactaacaaccatctcaccctgacacataaaaatgaatgaatgaaatccactagaactgcagaagggtagtattttaacttctgctggccccgccttccctttctgtccgacatcaaggaccctcggaagatgagatttctccgatccacacaccccacaccagagcatgttatagtgatttgctaaatgaggcataagtctgtctcacatacgttctttttccacgtccgctacaggttcgggggctcagaaactttttgcggcttcctgcctgctgccagaaaggcagctagtcccccacgcccagccgcaagtaacactggaaaacccgcctgcgctgggaagaccctcgcagcccgctctgctccagtcccgcaggcaccttcttgcgcatgcgcacccactcgagtgccgccctctttccccccattccgtgacgtcatccagccgctcgcgcgcctcgcgttagaatcactagctaggcagccttactgcgcgccggaagtttgggccaccgtgcggcccgccctttccggccagactgaacgcggccccatctgtcggcttaggaactgggaagggcggaagtaaacgagaaaaggcggaacctggtgaaactggtttcccgctgctgccctcattttgcttcgccgaacgtcctccctgtgttatgacgtctggtgtcccacttgactgggaatccagaaacagggcacacagcagttaataaacacctttgatttgtgtctgtggaaatacgttttgtccagacgaaacatacctcaagacaacatattttgcagaatagcctcacctgtgggtggtgctgaaacgttttaattttttttaacttgacttccctaaatcctacatttgagaggcctacaacagctctctagggagggtgtgaaggtgtgagtattcactttgaacaaatatgtgccagtcatgctgctaggccctggaggtactgcagtgagcaaaacagacaaaacccccactttcatggggcttaagttcatgtctactgaatccagtttgctgatttcaaataagaaatgagaagtgatgacacagaggctttccagtcaggtcattacaaagaaaaagtgttatttcacgtaagagttaacacctttttaactaccagcgatttgacccatgccacgaagggaaaggatttcttgagaaaaccccaatatctaaggaaatggccccaatttatttatacttggagcaggacagagattaagggaacagtggacacctacactggagttgtcactcctggatctatcttggtggtgccttcagtccatgaaaagtgaattgtacagtaaagatggggtcagcatgggaggaggaccagcttataggagttaccagcctaaggctgtctggttcttagctcagagggaatcagaagctgagagtagaaagtagtcttctaattttagaacgttttccttccccgcatttatttaattttcccatggtggttaacagtaaatccctaaaagactgatttagttcattcatttattccagcaacaaatatttgagaacacactgtgtcccagacactgttctaaggactggcagcgaagtccaagacaaacagtccctaccttcagcaagtttgcagtcaagcaggatgcggatgctgagcattacaagggaaatgattattctgagagaggaagtatggggtgctatgggaacatacaaccagggacctaattttatgggaaagggaccagcccagatccaacacttgctctcccagtttacctccagtaggttctttttaacttgaactaatcttgtttggtggggtacacagtgaggaaaaagaagagctagtgacaaaatctaactcccttctcagtcttaagcaaggtgaaggcaagggagtagaagatatcaagggagtgagtggtggtagccaccaaaggagatagcagactgaggccctaaaaaaagaaaggaaatctaaatctatccagcaggaccagagaaagagtgctgagggtgattagatggaatccctgcatgtactctcccggcattctgaaaagaagccaaaacaaggaagaaaccggggtatctagttaagacctcacaaatcactcatccattcctctgacatgttcataaactttttatagtggttacgaaccaaaagcttggcatttcttggcacttttccaataccctttaccagctcacattatctgggctcccacccaggctacagatagcctggctgttagcacttcacagaagggatatagactggcccagattcaagagctgcccttctaatttacctacagtgggtttttaactttgagttcccacatagagatggggcagccaaatatcaagcccaaatccctcacttcacctactcaacaaaatgacccccaaaatgtaaagtttctgtgcctttaatgcttcccggtccctaaaagcccaacttttcctcgaagctgggcacctgacctttagccaggtttcttaatcttttcatgcttttcataatagcaaattccactaggtctcttagaaactctaaaaccaaggcttaagcactttaaataaataagtcctcatgtcaccactgattttgaacttttagtttttaaaataaggctagctcaacttttgagtcattttgaaaagttggagatggcctggtttaaaggtaccagactagacatgggcttccttactatgtcccgacacagacagataggcatcactattcaagaggactggggcttgcaaccacagattagcatcttatttgccatttaggtcccagattgcttgagcccaggagttcaagaccagcctgggcaacatagcaagacctcatctctacaaaaataaaaaaaaaattagccaagcatcatagtgcacgactgttgtcccaactactcaggaggctggggcaggacgattgcttgagcccaggagcttaaagctgcagtaagtggtgacttgccactgcactccagcctgggcaacaaagcaagactctgtctcaaaaaagaagagaaagctgaaagggttagagactcagcagatgtttctagataagaccagtttgtgacagatacagctgcattgttctataccactctttaccttcactgttcacactcagatacctccactagtaagggagacaagcaggttcgtgctaggtgagcctttccagaagagtactgcccagcccttcttcatcccagccttaacacactcaacaacccatttcttccaactgcaaaaaatctaaatgatactgtcccttttgtagtcagagaagtacatcttagatccccagctcagtctagctcagagaagaaaacaagaaaaatagagctctttcctcttaaagctaacccctgagtcacatactgtcacctaccccctctccctgccgcccccccaacacacacacactggtatttgagtggtaataaggtaaatgcctgacaacctattcttccacagaatccctaggctttctgtgtcaacagcttccctttagaagccaaatttgtgagctttcactccacaggctgggtgactttcagactttggcacccatttctatttagatatcaagcatagtttctaagcaaccagccagccagctcctctccctctcacttcccccatcagggagccagcttactatactagcagaacaggtcaaacagagctcgatcctggacaaatcagtgcttgaggaaactttaacaaaaccaaggaaaaatgtggtacaagaacaatgcagaaggattctgttccaggcagtttagccttgtacaagtagaagaaggtcattgagtccgttctaaagctggatgcaatttcaggcactactccaatctcttcactttataagcaataaatctgaagcccagaggttaaaggacttgttcaaggtcacattggaagcaaagctgcagctagaactttggtgtccaaactcccaggccaaatctccttctactatgctatatcatactaccattaggagatttgaaaaagaaaagcaaagtctgaagggtgatttttccataaattaaatcagctttaaatctaggcatatttggagaatcacaaacttctaacactgttagagaaaagagagatttaaaagctggttaaatctaaacaataaaaaaatccatatgtacaatattataaaaaagagaaggaagaagatggcattcacaattactggggaggcagggcagggggcagttgcatgctgggggtgggctgcatgggctgccagctctcctgggtttgaaggatgcggtacagctgcttcagctgagcaacgatgttatccttgatgtctggggttgagatctgcaggcggacactgccactatcaaaggatcgtgtgaaatcaccagaaaacatctcgtagatcatccgagccactactggaatgacctgttcaggacacagaacacaggtgtatcctctgaggaaaaggtatttttaaatagcacaatggacccaagattgaaggacagaccaaagaggccctgaggaagaccccattctgatgtctaaatataggatatgccttcatctctctggaccatccttctgccaaggctcactgtggaagttggttcaaatgaaggtaaagaacctagatgtaacattacatcacaggcctaaataaatgactgcttactttgcaagactttttacaaaatatcatctattgcttgccttgctacacaactccaggggcaaagcccaagtggccttgctgccacttcctagaataaatttatattcctaaaagtaactcaaaaggtttttctaagaaaggctggaaagggccaggtatcgtggcttacacccataatctcagcattttgggaggctgagacaggaggatcacttaagcccacgagttccagaccagcatgagcaacatagtgagacctcatctctgctaaaaataaaattaggccaggcatggtagcctgtgcctgttgtcacagctacttgggaggctgaggtgggaggatcacttgaacctgggaggttgaggccacagtgggctgagatggtgccactgcactgcagcctgggcgacacagcaagaccatgtctccaaaaaaaaaaaaaagtgcaatttacattgtgtgtgtgtgtgtgtgtgtgtgtgtatttgtgtgtgaagaaaacctggaaagggtcatatcctgtgaggtttcagcaagactctaaggttagtaagagaatgaaagataagatctccactaaatcaatcacccattttaaggaccctgccttttccagcatgagtcctactgcacaaacctgagtctgttaccccatctgatgagactgaaacctacatgggctgatggatgcttgatgagggctcaacccagacctgggggcttaagcattggcaaaaagatgaagagttgttgacacagccttatcttctcacctgaaccaagatgagtttcctttccaatggtttcccatctggccattcttccccaaagcataagtagatctcaaacggtggctgcttctctatctgtcctttctggtgggcaatgagatctgcagaaagtggaagagcaagtttggtatactgggtcattccacatccactcaacaaataccatcttttatgctgtccattacaatagccactagccacatgtgctcactagttttaaattaattaaacagttcctgggtcacattagtcatatttacatgctcaatagccacatatggcttgtgacaaccatactgaatagcacaaatatattgaacagtacaaattacagagggttctcttggacatcattgatcatgacttgcagttcaaaccacattgtaaaaaattgacatcacggtgctttccctaaaactgcctgcttgaattcaccactcagataattcccaaaagaatatgtgctattctgaacataacaaacaggattaccttccaaagttaaagacacgctggtaacatttgaggtgtaatgacagggctgtctccctcttctgccattgaaggagccacaaccaacttaaaaatagcttccaagtacatagctttggagtgaaactcccttctttgttgcctaggtcacctccaatttttagaaccaaagttctgttctcccttgacctcctccagactaaattttttaagatctttgccatgccaggaaagcaggaaggtgaaagacagggatagtggaaggaatgtacttccagagagtgattcccacgatcaactttctgagaaatgacttaccgctaaggaatgtttccagacaaaatagcttgaccttcttttgtctctcaatcaggttgggagcaacaagtgatggggcacatggcccagaccagtacaccttgcactggcacagcctgatggcataaatggcatgaccgctgacctccaggatcagtcctctgtccatgacgtccagcagcttgctagtgaacagcttctgcttctcattggtaatatgctcaggacctgggaatttgacctgctccaggctgacgggaccaaagagctcctcctggtcaggcatgggacccaggtccccatagaagagtcggcagccctgagggttgctcacggtcatggtctgcccgtactccttcccacggtactgaaacttgatgtccaggtcagtcactgcaaggttagagatgacagtgagagtcctgcttcactgctctgcctgttcatccctgtgactcatgcaagtccattaagatcaagccacctttcaaccagcattcaggaaggccactgccatagttatccttcctgcaataaagggagacatcaacatatccctggaatattcactcaaaaggctgcctgaaagcaaacagttcaaagtccatctcaactatttctgttcaatcaccacaccccaaaggctacaattgcatcaagtaaagtggtcctggtgtccccacgctatactgactgagtcttcacaccaatggtcattggaaggagctaaaaactaaggtatcttgtttgtgtatcatttttagcttattgtttaaagaaacttgaggaagaagaagcaataccaaacaatttttctgaaaatgacatgtgaacacacacactggggatctgctctaataatataccataaaaggacacagttcacatcaaagttaatttttactcagcaaatctccattgaacccaatagcccctatcaaagctacttagcctcttggacaaaattttattaatagcactcacatgcctaccatatgtagtgtgaaagggagacccaagcaatgacattgattcttcattgagataaattcgtaccaaattcagaaagaggtttttttctgtaggtcctaaagcctctcaaaatccaagagcctcctctaccaaatccatggccattaacctccctgttccacaactggccttgtcactaaatccccctgcgtgactgataaatctgggactcctacccacctaagacctgaataacctggagctggagctgtaaccaatcagagcatccctatgggcaagtaagtgtcagccaatgtttttgttgttgttgttgttttagatcatgtctcattctgtcacccagactggagtgcaatggcatgatcagggctcactgcagcctcaaccttctgcattcaagtgatcctcccacctcagcctcccaagtaacagggaccatgggcatgcactgccatgcccagctaattctttaaaaatttttttgtagagagtctcactatgttgccaaggctattctcaaactcctggcctcaagcactcctcccacctcagccttccaaagggctgggattacaggtgtaagccaccacacccagctgggccagtgtttctttacttcttccctggtgactcatgggctagccaggaaacagaaacagaggatgcctctgagacaggtagtttttcaatacatggcaaagaaatgaagttagaaagcaggacaggaaagagtctataatagaagcagaagaccgagcaagaaagataaagtctcacttacttgggagagagctgatccacagttctggagagctatagaagggctgtata

SEQ ID NO: 641 - DNA, 2058 bp, Homo sapiens
gcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctca

SEQ ID NO: 642 - protein, 531 aa, Homo sapiens [sequence omitted]

SEQ ID NO: 643 - DNA, 37498 bp, Mus musculus
caggccctggataaacacaagggctggaagggctgggtcatagccacccaaagagcacttgtgtgctaggcacaaagtgtcaaagagcagctgaagagagacccacagcagcccaaaagggggctggggtctccctttcccacagtgacaagtcataggtctgacttgtggcagggcccactcacccatgtagagtgagagacacatatggtactagtactcccctgttgtaggaaaataattgtagaatcggaggcttaaaagaaccagacatgggctagagagatggctcagtggttaagagcactgactgctcttccaccagtactaagttcaattcctagcaaccacatggtgactcacaaccatctgtaatgggatctgatgccctcttctggtgtgtctgaagacagctatagtgcactcataaaataaataaatcaatcttttaaaaaaaaaaaaaaagaaccagaagctaaagtgggcagtgatggcgcacacctttaattccagcactctggaggtagaggcaacctctgagtttgaggttatcctggtctacagaaacagttctggcacagccaagaactatacagagaaaccctgtcttgaaaagcaagcaagcaaacaaacaaacagacacaacaacaaaacccaaacaaacaaaaaggagccactctatgcagaaatgaaagtccacagaaagaaaggcccctcacggagctttggatccttggacgcggcttgttcacgattggtcatttttcccagcatgacctatgcaggggaggtcctctagctttggtgtcagggatacgggcttgagctgaaggtctgatcgcaagatgctagcatccagaactgttttattctctttgagatgccttgaacttcctacatagcccaggctagcccagaacttatgactttcctgccttctgagtatctgcaattacaggtatgtaccactgcccagacaaacaaacagacacaacaacaaaacccaaacaaacaaaaaggaggccaggactgagatcaaggaaacaaaaaccaattctgggtttctaccgaaacacatgcccacctttatatagaaacatgcatacacacccttctacacacacacacacacacacacacacacacacacacacacacacacacacacgcccttcatactccacagactatctgggcttaagcttgcctcatgttttaccccacaatctcccagtgggtcctggggtctctctaggaagctttctgactctggatccatcaatttttccacctctgcccgctttccctgactcgtaagcccaactcagaagtgtatacactgcgggctcactacaatctgggccatcaatcaaaccgtggagccagatctccccaaccccagcatcctccctatgactggttcctaactggtcctaaagtctcgtgacctcttagatggtcacctccttactaccctgcctgctccttttccaggtcactcctgcatggcatctcttactgtttccttcaaacttgtcaccttggctcatgtcccacaatagtcccatcttagggccacagagaggactgagaggggccccttgtatcgactccaattccccctcttaccctgtaccccaggctggactagaaggcagtcagtgggtttctgacagtgagcccctcccatctttgttctgctggaatggaggacaaacaggtggggttggagcagctcacagacagcaggcaatttgaatgtcagaagcactttattaggccccagggcccttagaagccaccctcatggtctggacaggccacccccagcagctccagctgcacaggaagtgagcgggtgagagaatccacatggctttctctactgtgaaggctcacggaagacgctgagcccacagctgcttccctctcctgcagcccctgctgaccccacacagctacatcagtcttggggtggaaagggaagctcgggccttcagtgcaggaaaccgccttgaaaccagccacctgttctgcttgaacagggaaggggccgtgtgaaaacctgtcactgggaggagaggggacagcagcataaatcctgtccaggagagagagcttgcgggctctcagaatcagactggctcttccccgcaggcccaaagctcctagcttggtcactcagggcaagcgtaaccgacaaagcgaggcacagctaagagggtgggagatggctacatgagtcagttcattcaacatggttccccttgctccaagtcctaggtcaccagtcccgttcagctggctcccggtagggcaggcctaagtgcttgaagacgtccttctccgtgggggtgggcagcacttgtccaggccccaccttgacaccttggctgttccggactacagctgcactgagcgcatgctccgacaggctcatgcccttggtcttggccagagctctcatggaccggttgaagtgggcagagccggtgaagtagagcagggcacaggcaaactcacagtagggtaccacgatgatgtccagtcgccggtggcgcttcccgggccctgggagccggcacacacccaggtatttctgctgttggccgttctcctcctggctcaccaagtcatctgtgaggaaccctggtccaacacaagggatgtctggtagggcagggagccaggcctgatagtctcaccttctcaggttgcctaaggatctttattcccagcataccctgtgcctatttgtgtgttgagttgagtggcctcgcccctctgggcccaattcctcatctgtggaaagcgggcagtgtcatcaggtgagatctgcccctgttttattgtctttggccccaggagaggtaggattcttgcagagccctttcccacccagtctgtctcaaatcgagaacttggaagtgactgctaggaggtggctgcccactggtagcctgctcacccaaagtcaaaatggataccttgctgccgaaggctatcaaggaggcagctgaagatgccccggtgggatcggccatcggggtgagtaatgagtacatccacatccccgcacgtcatcttcccccgtcggtaagagccacaagccacacacagcagcccagggttgaaggcctgggctgatatccggacctggggaagaacagggaggggtgagagtctgaggcctctcccaggacagcacccagccttcgccccagccttcccccgggattcatattaagctgaggggacgtgccggggcactggagaggcaagcctgttagaggcctgaggacattggctctgcctcagcagaaggctcctgtgcaagagccgagtgacactccgtgggttctggcccccgactcacatccagtggccaggcctgtgaaaggcctgccaatcacaaaggccacgcccatgcagctcaagcagcctgtagctgatggctgtgtggaagctcagggtcgaggcctgagcaggtggctggcagacagcctccaacccggctgggagaaaatgaagcacgaaataccactgcacctgtgggaaggggaggccaggagctgcccacaccgttcttggaggggtgaggccggcctgttaaagaaggacctgagagacctagcccgccccctctgcaggacactgcagtttcaggggccctgggtgctcacagccaggacaccccaattgccctgacatagttctgctggtcccttcaatcccttcttggacctcccaggagaatgggaagaggccgtctggttgagcaatcccaccggaatccctacagctggagccctgcttgcaggcagcctgcagtggggaagccggtctcttctgatgggctaggagctggcggctgaccagggcattctctgtgcccggacaccgtagctgagtgcaggggtccgcattagcaccgcagctctgtgatgggtctatccatccagcaccggtcccatagttccatctgtgggcgctggtggaggcttattcttcctcactaggtctctccgatccttctgctaacagactggttcatctgtcactcaccaagacccctgcccatgtaccagcctgctcccaatgccactatacaaatagcagacatctggtataccccgtctctcttgactcaaccctgcacatgaacttacagactcagcccctagctctaagctgaacctttaacttggctaaacctgatttcttggccaactagatgttttttgtttgttttttttttccccctttctgtgatgctgaggatgggcagggtcttaggcatgctcaggagcgctacctctgaacgacatactcaggccttgattgtactcaggccttgaggctgtgcttgccccatgctaggcgactagtgcccagagttcatgcttagtgaccctgagaccagagggctgccactgcagtgcccaccccacctggggttcctggacctacagctctggtagacacaatctctgtcgacctcttaacttccgctgcctgtggggttgcccagctagggcttcaggagctgttggctcgagctgtgcctaccgtctgctcaatttccgcagcctcctccctgggcatgcggtccaggaagtcatcgtagtgcttcaagccaatggcctgctgagcggtcagggagcccaggctttggagatcttctaggtttcggaagccctggaagaaagcaaccagaaaagaggctatgaggacccaggactaataaacaggccagaagtcatgggtggctgtcacagcagctgccatggaagacagaaggcaggaccaatcaagtccagcctctattcagtgggacgtgatctgggcatgctggtccctcattcctcggtctaaaatgggtcagggcttcacgctcactaactcccaagatcattcttggcatggccaagtttgagagccactgttcgagacatggagcccaaagcctgggctcctgagaaagtcccttgctgaagccaggcagatcagcctggtctacatagtaagttctaggttagccagggctacatggtgacatatagtttttaaaacaaacacacacacacacacacaaacacacacacacacacacacacacacacacacacacaaacataacaacagcaaatccctgctggtgtgtgggacagagtaatgtatttattgtttctgtccacaggtcaaggacactaagctacatggctgttctggggacaggagggggaccaatgtgaactctggcatccttgtagttggatttcactcccatgagggcccagggtgggaaaacagagggacccagattcctgcaggtgaacaggaaggggtgtgggcagagactctgtaacagcaatactttaagaggcaggcgggctggcatgacctgatggtaccacatctgggcagtcttcgtcccagctccccagatgttggagaagagctccaagacaggcacactgtcactgatgtggtctagcttccgcagatgcccactctccaggatctccatgaccttctctgccatccgcttgccaattcccgggatgctacaggcctcctagggaggaagtggcacagaggaggatgaggaagaggctaggaagggagagccagaagaggggaatgtggctccttcagcagaatatctgccccaaaggtagcccagcaaccatatggagcttgtcctttggttcccagagaccagcaataagaagtagagaaaatggcctggcaggccttaaatcccagaactcctggaggcagaaaggcagaggcagaggcagaggcagaggcagaggcagaggcagagaggcagagaggcagagaggcagagaggcagaggcagaggcagaggcagaggcagaggcagaggcagaggcagaggcagaggcagagaggcagaggcagaaaggcagaggcagaggaggcagaggcagaggcagagagaggatctgtgagttccagcccagtcagggctgtggagagagactcttgtctctaaaagaaaaaataaaacaaaataaccacaaaaagaggtagagaaaatgacagtgctcatcaccaccaccactgccaccaccacatcacaactctgcatgcacactccctgcgggcccactgtattgcctgcagcgtgtgtgtgtgtgtgtgtgtatgtgtgtgtgtgtgtgtgtgtgtggggtctcgctgcactgcttgcctaggggctccctgtaccacactgcctgactgcaggctcactgcaccacactgcctgggggagggggtcacagcactacctgactgggagcccactgcatcacactacctgagggctcactatacctcactgcctggggcgggggttggggggagtcacagcactgcctgacctgggtggggctcactgcatgacactgcctgttggggtcacagcactgcctgactggggactcactgcaccacactgcctgactgaaggctccctgcaccacactgcctgagggcttactctatgtcattctgtgctactgagatcatcttccaaccttacaaaacccctgtgaatggcctatagttgttcattcctttccagtgattggaaaactgacagagtaactaacttgcctagagtccataatcaatggaccccagagtctaacgtatgaaccaccacgcctggctttaaacttatcatataaaacactcagatgtagaggaaacagtgtatgtaataagcccctaagcacccattttctagtcctaatgctggtctgttttcctcccctcccccttctatcagtttgtctctgtatgtagatcccagccattacaaactcttttttttgtttttgttttttttttttgttttgttttgttttgtttttttgagacagggtttctctgtatagtcctggctgtcctggaactcactttgtagaccaagctggccttgaactcagaaatccgcctgcctctgcctccagagtgctgggattaaaggcgtgtgccaccacgctcggctcattataaactcttaagcactaagtcggacacccactggtaactacagttaaccactagttaatgactagtgctgctgtaaccagtactgagtaaagaagaaacaacccccttcccccacgtacctggtaggagctgacaggcttgtggaagctcttgagagcattgatggcctttgcatagcccagggccctccacttgtctccctggacactgtaggctttagccagcacttccagcttctctgtgatgtgcagattgtagttagttgccttctggctcgagggctgtgcacagacccatttatccagagcttctggtgctgggtcaggcccaccatcttcctcagggggagtggggtagtgcccagtgatcaaggcttgcagatctgctgagctaacctggggcccttctccatcgctggtttcatcctctgagctgagctgcaaatagaagaagagagcgctgtctggtggggaggcgtctcctgctttgactcaaggaaaagaccccagcctggggcagacataactagttgaatgcagaactgaaaaatgttgggaagagatggacaggtgcataattgagagagacctagaattttctgtctaacctccaggtccttccatttctgtgatcagcaccctgggctgggaggctcctcacctgggcttgggttcttgatggcttttctgccgttgggggaggagatacagctctggtgtgaggaggggaaagagaaagggtggtcctgggtaaatcccgctgggtgccaggagcagaagcatcttggcctgacttgctgggctgtggttcatccaaggacctagagggcaggggaggtcacagagagttagggtatcaaattcttacctgtctctgtcccccacccccaccccaatctttctctatacagaaaccttggtttccaaatatgtccaatttaaaaagtacgagtgttttttttttcaataactcaagatggaaactcaaacatcatcaacaaacacctgagaaaggctaagagctgccaacctcttgggcatgggaaggctgaatccttccgtgtctgtcagccttccctcctgcaggcacaagctcagccaggtggacttcaccagctgggcaccagggggtagctggggcaacctgaggagccggagagcccgctcatagtccatgtcttcatccaccacaatgtgagtgactcctggggcctgggcagagcacacctggccgccatggtggataatctgcttctcaaagagttcagcccgggcacgtccaatgccagcgggcataatgtgggctctcagggagctcagccatcctgtggagaggatattcaagtggtatcaccatagctattattattattattaattttattgcactattatttgagatagggtctcatgtagcccaggctggcctcaaactgactatgtagcagaggataaccttgagtttctgattctcctgccttgacctctaagagctgggattacagttgtaggtcagagctataatgaactgttcgaagccacctcccttccttttcctgccatccagagaacaaaataccttcaaagaattctaccgcaaacgtacaacaaacttcctttttttgggggggggtggttagtttcaagacagggtttctctgtgtagccctggctgttctggaactcactctgtagaccaggctggcctcgaactcagaaatctgcctgcctctgcttcccaagtgctgggattaaaggctaaaggcttgcttgctagcgataccccccaggggttttttgtttttgtttttgcttttgttttgttttgtttttttcagcaaacttccttttttgttgttttgttttgcttttcgagtttgaggccaacctgatcttggccacaggttaggtcacttctgttaatctgactctagctgaaaacaagaaggctgaacgttccagtgtgtgagggtggaccggctcacctctagcttctcccacctcccttttgggaatctttgcaagtgcttttgaagatagatctgcatgacttttcttccgcttgggaaaggccttcacgatgccctgagggtccattgaagggcgctggatcctggcctttctgttaaaggattgagagccagcccttaataatttggcatagaggtggggtttaggggtaacaggtccctttctcagaggtctcggaaaccccagttaaacttaagtgatttaatccgagtgccacacacacataccagcctttcaaccctagtcgtactgagggaagccagggaaaggttgggattcttgtgggtgtaggggaggtgtggatcgaaaggaaacaacatggggtgggggtggggggaggaatatagcgcagagtcagcctctgcgtccccttccaagagacttttccaaaatgatgacgggtttgggaaccggactacatctttaggagagtcttcatctccccaacgaattggagtctaagggacatgtcacataaacctcgcatcatctttctctagcctcaatgtgcattcgcagaagaaaacctggggagtgaggcttcagggaaagttgtgggcacgctgcgcacctgtccctgtcgcagcagccccatcgcgcgggtctgagccccgcagctgcagggaggtggagtgcagccgcagcagatgtagggagccctcacagctggaggtgggcaagaccgaagcagacgtgccacatccactgtgagcagctggtgtgaaccagggactcccagctggggccagaagagagttggtgctggatccctaaaagttctgggagcatccccaccccacccggccccaggaccggtccaaagtaggttagaatctcccggcaaagagaaataaactcaccatgggagccaatgaaaacggattgggggaggaaggggtagaggggaaaaaaaaaaaaaaaaatcagttcccagaatacttcccgggtcatccggaagtgatcatcggtcgggtagttgccatggcagtggcccggcgcgttcctgggcggagggaagatggcggtgactagctggttggaggttttgcggtcggccgagaagacggcactgctgcaggatggtaactcgagacccctcgtccttccccccagggcgggctctatgcgcccgctcccccagggagggcctcagcctgggtgggcagagctggacctgtcgcagcagcctacagccatgccagcttcctgcttttgcagaggaaaccggcccagggagatgacccgagtggaacccaagtctttggtcacccacctcaagagttccttatatcatctctccccgctcagagttttgttggtatttcccaataattcattttacattcatcatcgtccctcagggctgtaccaagaggctaattctgcaccccatttgactgacgaggaaactgaaacccaggaaggttttagaccaaacccaggttttgcagataatcaggtataattcgtcatctgggatccatgcagctcaatttgggggtcctattgatgacagcagccccaatggcatagaaaggagacaccagggttttagatcaactctaacatcgattcacctcttcagttgttaggaccccattttcttcaattataaaatgaagtgggtgggctaccagtgttgtttctaaggtccttgttttctttttcttttctttcttttttttattttaaagatttatttatttttttattatatgtaagtacactgtagctgtcttcagacacaccagaagagggagtcagatctcgttacggatggttgtgagccaccatgtggttgccgggatttgaactcaggaccttcagaagagcagtcgggtgctcttacctgttgagccatctcaccagcccaggtccttgttttctaactatgttttgtttatgatgtggattttaaattgccccctgatctttaggggagatagagcaagggctaaggtctaaatgactaagaacaggagcttgagatgtcagcttttcctcatcctgcaagtggccagtttaagtgccctgtgcccctgaggtctttcacagacccacccacctggcagccagggtgccttaggtctgaattcctgaggctttaaagctaacagctagctttaaaacatccacaggcaggtgcctgaagtttacagaaattaaaatcaggtttcatttgctcctaccctacagcatttagggaacccattgccatgtgccaaattctgtgctagagcagatagaaaaaacagacaatagcaaagttaaaacaaacaagaagacgacaaccatggcttatgctttcctgggatcataaaattatcaagaaaaaaatatgtaaggaaatagcagcttgtattaaatagaggttgggatcttagaaaggcaaggatagccccatgcctgccatctctgcactcaggaggtcaaggcaggagactcaggaaggaatgaaggaaggaaggaagggagggaggagggagggaggaagtcaggcagacagacaggaaggaaggaaagattgagatagtctgtgaaatgctaagaaagcacagaggtgaaaataattttctctttggataatcactaaatagaagaggtgatattctagcccctaaggaatttttaatagttacttggtaagtggagatgaaggaatcacacatagagacaaaagaagtgtgcacatgtataagtgtgagagtgtatggcaaaatgtcaagtattaggaaagaaggcaccattcggggactgcctgcacagcatccggggccagatacagggaaaataggctgtaagaggaagtgggagaaaatggagagatgcagactgatggccatgtgtcacagccacacagtatgcagctttgggacacactttacaagacagaggtctttttctttgagacagggtctcactatgtagtcttggctgctctgagctggccttgaatacattccggcctaagccatgtactgtcatgcctgacccagttttggttttttggtttttcgagacagggtttctctgtatagccctggctgtcctggaactccctttgtagaccaggctggcctcgaactcagaaattcgccttcctctgcctcccgagtgcgccaccacacctggctcccagtttttgtttttattttatataacacacacatacatacatacagcacaaaatgtactgtcacaatcaattttaggtgtgtagttaggggtcactaaggacggtcctgctgtttgcacctgtcaccaatatctagctccaaaagttttcattctcaaagccaatactctgcacccagaaaacacaactccacacccctcttcctcagcccctagctactttgtatttcaattaaattgactaagagatttatgtaaatggaatcaaataatatttaattatgtcacagagcaaaaggttttcagagttcatcaatgtcatcatgtgtatccaaatttcctttttaatttttttttttttttttgtgtgtgcttatgtggaggccagatgtcagactagggtgtctttcctcacagttgccacggtggtttttactctttaaacatttgtgtgtgtgtgtgtgtgtgtgtgtgtgcgtgcgtgtgtgtgtgtgctgcgtctgcgtcccccagtggaggaattatatgttcatgtcactgccccagtctatggatgctggggatccatcaggccctcaaacttgaatggcaagctctctgctgactgcattccacccctgccctgcccccaacatcatccttctgttttcaagctattccactgtaggtgtgtactcctgatctctgttccttcgtctatggacgggtgcttgggtagctcctgccatttgattgttgtgaatagtgctgctttgaacgtgaacatgccagtgcgtgtaaaatctgcttctgctgctttgggtcatgaggtagtatttgtggggtgtgtgatgctctcatgtgagttgcaggagcacaaagacagggtgtcacgtgtgtgaagtccaggcctttgctttaatcctctgttactctctgcctagggcagcctttcactgaagcagcagctccgttttggctttggggacctgcctgtctctgcccaccaatgctggggttacaggcatgcactgccacacctagctatgtagggtgctgatgagtccaactcagttcctcatgcctgcagagcaagtactcgtatctgtgaatcagatttttaagggtgctgaaacgtagggtctgccaagagaccttgcaagtttggggtcagtggactgaaataccagttagcaatgactcggggaactgtgtcctagaagagtgagttacacaggacaaagccacctcagggttcctgttcttgaagctgatggagggtacacgtccactgcctaggaagaccctttgtcagtcttcccgaggaggctgcctgtatccatttacctgcctgtaagaaaaagaagaaattacacagctctgcccttgagcgagtgcttgtgggctgggggactcccctgagttcccttatcttttagtggttggtacattaatgctttttcattcttgtggagagcatttgagttcctgttataacaggtacagtggctgacctcgggaaaccatgggcaccaaacacatcccgtccaatagaagagacaaacaataaccaaagactcacacaagagacatagaaatcataaaccaagcgtgtggggggaagaaaatacacgatggtattttcttgggctctgccaggaatggccatgagatgtgtcaaggaaggctgggtggcagtgtggccaggaagaattgcctgtcaggggacccagctcgcatcagagcatggagccctggttgcagaagtgcagagagaaatgcacttgtctcagatgctggtaacactatcgtggtgggtagacgctctgctgtgagctagactccaaccctgaggggcacaggggaagaagccctcgctatgcttgtagctgcaaggaaggggtgacggggacttcccagggaaagtgacatttgaactgggttttaaagagtgagccaagttccacagttgggaagaagcagccatgtccagaaaaaggaagggagtctggggcccatgtaaagcaagccttggtggccacgagtcagcttctggtagacattcttggggccgctgctgtttcacagtgtacgggggcagacatctcagtgtgcaggggacaaggcagaggaaggcctgaggtaaggtgctctcctctctgtgtgcagggaagaggatggtgcactatttgttcccagacgggaaggaaatggcagaagaatatgacgagaagaccagtgaactccttggtaagtgtgggcctgggaggggtgtgtgtgtgtgtggggggggtgagactgagataagttgaacgcatctggccttaggcttgaggtgggatctcagcatgcagtgtgcatggtaggaaaatggaggtcgttgggggcaagactgtctctgagaacagtgtgaacgtcagaagcccagtggagttgtttacctggtatagcctgtcccccacctccagacaaatgagaggaccagtgagcctcttgctcaggccgagcgttatagaaacaactggaaaagcatatcacggaggaggctgtgtagaaggggacgggagggaggcaaggcttgcacttcaagcgttttgctggcttgttcttttgcttcctgaagccacaccatcagaggtggcaagctctgaccttgcctcctagacgtcaccatgacaccgtattaaatatgaccctcatcttgaaaatggatgagaactgggtgggagtggtgcgtttgcggctccgatgcttttgttcctgcaggttccccctccttctgagtaggctcataagtaggagccccagctcggatttcaggggattatttgatttgctcggtctgttcccaggtacaaacggcagcagtaactgacttcccagagctggtgaccagctctgtgacccagggcccaaagctggccgccacgagagctggtctctttattaagttgcacctgaaatgctaagaccaatgacggaatcatgggctgggatattttcatgtccttattcttgacttttcatttcttcctggggtctgatcgacaggtagtattggtgagggaatttcgttttcccttctcctgacagctcataaatgtctccagctgacaacgtggggtatactggtttgcatattctctcattctccagtcttaaggtgtgtgtgccctgcgcatgctcagttgcagtcaaagtattgagccttacttattatgagctgcttgggctccaatcccaattggtttagtctggcgctattaaaaatcttgatgtgtttagcatatgacactgattcgttggaaagcaatacagtagtaatatcctcacaatgcattgtaatttatagtgctcccaggggggtgacagccttggaatgccagacaggggagaccttatgaaagcagaggtcacgtgagctagccacagccaccaccaccaccactcgcccacccgtccagccacagctcttgcccagacctgcacatcagttcttttttttccatacagcaaacaaagcaggcagagctgccgaggctacagaagcgcacagacaaacccagcccttgccgtggttgttgtgatattacaatgaagaacaagactgcctgcctgctctgttgtcccacatctccttcagttctggtggtggtgggtttggctagaccttcaaagttccttcgctttagcagcaaggatggaggaaggctacaattcaccatttggctgcttaacctaacgatgacatttgcacgttaactgggcttcatgccaggggctccacatggatcacctccgctgacatcttccttaaagccccacaatgtagacactgttggcccccatttctcagtggagggagtaggctcagaggaggtgagtgccacgctgagaaccccaaagtcagatggtatcttagtcagcctggagcttggccctgaccccgcggcagagctggagtgtttaaatcctgctcactttggttggctttctttactcaagatgtgcctctcctctgcagcctggggcttcctgtgcatcctgggcagggccagccctcccaaaagagcctcccagagctgaggttaaagtgtgcgcctgcaggcccagccctgagacccgtttcttactttctatctcccctagccttcacctagctatcatgcaaaaatactctccaatattagttcttgtttgtttgtttgtttgtttttgagataggatctctatgcattgcctagactagccttaaactcgtgggctcaagtgccctctggcctcctttcccacgtagctgggaccgcaggcacatgccacaatgcctggttactaatgtataaatatcatctcggggccggagctagctctgtgcttgcgcatactgtgaagtaaaatatggatatggtttttgtggcagtaagtaaaatagtttccattttttttccccagctaatatacaaatttgataattggtcaaacaggttttctattagaaaaaaaaaaaagctcagaaagtaatttacagagtagcacttgctggtaggtgtgcatctgtctgggacgaagttcctccagccggtgttaataaacatgttagtgtcatctttttttctaccctcccggggctgttcattcccaccccccacaatgaacgctgtatgtattcatagaggaaagagctgaagggccttgtaacaatgatcggaacatcaaaccaacccccagaagaacacagcatgtccagggggccgcggctgaagggcagaccgtcccccggcgattacatttggattacctcttaatctgctttggtatttgaccgccagcctgaccaccgcaggccgcattcggaggatatggagcactttcatccccaggcacttgagcgcctttataaatgacccactcgaatccctccagcctcctcagggatgggccaggcagctgtttaatagccacggagcagtgttgcagtgttttagggcagaaaagaagaatcctgcatccagtttaagctgcagggagtatttaggaaaggggaatgtaattatccgtattggaagagggccaggccttggagctttggggaaagaggccttttaggatctccacttcccagcccacctgaaagatggggctgctttcagcagtctggggcgtcagcctgcttcctgctgacttgggaaaggccccccgggcactgtctccttcatccatcctgcagtcagacccttacagggtcattggaagtcttctttccaaagaccggccctgactcagtccagaagagaggacggagtcccagggagctgccttgtacacaccagtttgggtttaacgtataatcaaatcaggacgacatcaggtggagcagtcctccgctgcctgccttaggagctgtccttgagttcgggaacaaagacgggaccagaaagcccaagactgtgtgtgcacacgtgcacatgcgtacccgaaccacggaacaagtaaggagttcagaatctttcattagatctttccgcttgaaaggctggaaaggaaacgtgtcacattcttacatagatgtgattccctagggcgttttacaaaaatgagagccaagagcaccaagctgccacagcccgaggaacattgaaaggagagagaagagagccagcgggtctgtgctttccccttcttagggtgcgtttctgaggaagactgagttggccgtccttaaagaggaggaccaggtgggaagtcctgcagtggttctcgcctctagggcccatactggtgatgtccccagggcaaagagtgtaacagagcccatgattatcttgcttttccagcccaggtctataaaaattcatcatattgctccttcagataaccaaacctggcctttaaatacagaactagaagctgggtatggagagggccacctttagtcccagtacccaggaggttgaggcaggatgatctcaaagtatctttgtctattttaagacgggattttgttatctagcccaggatagcatataacctccatcctaccagcctaagtgtgcatgtgtagcactgtgatctgtagacctggatcttaactgttacgtttggatctcatttttcctcagtaattctaccgggtcccctggagaatagaggtgaaggaagggggcaggtgaggaagaaatgccttcttctcaataaacaaataaaaatagagccgttagactagctgtgtcctaagtgactgcctccttaggccagtgatgactatgctctgccattcagtgtcgccagggtgacacagggccaggcggtggtgacacacacctttgacctcaggacttgggaggcagaggcaggcgaatctgtgagttcacagcctgccttctctacacagtgtgttctagaactttcagagttacatagtaagaccctatcttaaagacaccaaatggtgcatgggtggttgtatcctgccctgtgagctgtcctctgatactactgtcagtgtgtcgggggcgggggggaggacgtactttcccgcctcatttttctatatgcagctgctgctgggcttccctggcccttctccttctgagtgctgagggtcaaacccatggcctcatgcatgctaggtgcaggctctaccactaagctgcaccccaggctgcagagcattttatacatggcttgaggatccagggtgatccttgctctcatggggagtaggtttcatcatcatgacatggtgagctgctgctaggaggtgtctgttacttgtttgtagctgtgacggagaccccagaggctggcttccagttgtctgaggtattaccgtggctaggtttgcatatactcctggtcacagtccattcacttaaggaagtatttgtgggtgtaagaagttgcctagaaagcgtatttctaagttttactcttccttattaattttcattataaacttgcagatgtgtttctagggagaatcttggccctgagatgtaataaaaccacagtgcagagtgcagcagaccttataaaaagcccacgttcaagggaaagttctaagtttacatgaggcttctgtgttcggcttttgtgctcacagtggtcccagctgatgaaaagcccccaggcctgatgctgccccaccccggaaacggccgtggcccccaccaggcctttcagagttgctcagctcctagagtggctgcaggaggctgcaggagtttagcgctgactgctcagctcttgcagcaggacgcccaaactccacagcccccatcttcttaacagagcaggaatggaagggtggaaggtggagggagagggtggagggcggaggttactcctcagcagagcccctctgccactggcaggtgacactgcagccaccagcacagcactcagtggggctcattcccagtgctgccgacaggactcccgtctggatttatgacttccataaaatatgtgccttggtttaaaagacaacgagaaaaactagacctggtagcacaggtctgtaaaccgagcacccatgatgctaagccaggaagatagccgtaagatcagcagtagcctaggctactgaatgattttcatcaaaagcaaacctaaaggggtgtagggcagaggctaaaaacaatatcatcaacaacaaaagaaccctttcacaaatatctgccttataaaacctgggaaactgaaaatcattatttgcattatcaagttataaatgtaaggatctattattattttacaaaaaactccacatttataatccgtacattgtaggctaatatttttgtgcactgtgtataaggttgtccttgtgttatttaaatactgatttctctgccctcatgtcttgtttcaatctggacgcagcattgaaatgtgtacaccaagaatctcctgtctcaagtttgtgtaagcagttcttaccatctattctctgccttgtcactaaatgctgaccacccagtggctgggcagaagggagaatagggtgggatgtctgccaaccagacgaaggagagaaaggagagagagggggagattcagatcggctggagggaggatttgaagccatgaggaagggatctggagagagatcatggaaacactcctggagcccagagagcgagagttgtaatcacatacaaatatcgtggggtggggtgggaggccgcaggttagcaaggcggttactgctaacctgagagtgatgcgcagttcttggtaaagcaatacggttgtcagatcttttcacttgtttacatttatattaaaaacagttcacttagagtccgtttaaaatgtagtgtacaaatgcagaccaagcacataaaacaaacataaacaaatctaagaatccagtgtatgccgaagactttatgtgttcattgcgatgctggaggtcagccctagtacttgggaaactgtcagtgagtcccactccagcctgagactacatttaaatacaacgttggtgctatcagggtttttgttgttggtcgttgttttaaggcagatgtacctgaaataagtgaatgtcttgatttggactttatgaatcatgaagcaaaaacagctttcactcaattcatttttttctttgcatggcattctagaggggggaaaatgcacccaaaggtgggtgtgcaggttcaaggatgtgctggtgtgtgggtgtgtgggtgcaaggatgtgttggtgtggaggtgtgcaggcacactctgaaatacaagcacctgaggccaagacacaaggaatagtttgaaaacagccttggctatctagtacaactgtgtctcaagaaataacagcaaagcacaactagaattccatctggagacctagatgtcccgtttccagaaatggctgttatcgcctctttgccttcttccgggtgctctcggagcttcatccctggtccagttgtgtgcccgcctttgaaatggactttgcaagttacctgctgctggaatgccccatgtgatttccccaggtttgtgatgattcctggctcaaatacacaaggcccggcattgagaccaaagcctgggcttctcccgttccagttatccaacgtcttgtcagctttggcagcagcgagctttaatccattatatgtttctctttgcagtgaggaagtggcgtgtgaaaaatgccctgggagccttgggccagtggcagcttgaagtgggagagccagtgccctcaggagctgggagcctgggatccgagctcatcaaagaaagtaatgccaatgtatgtctgtttgtccagggtcttacggggattgggaggagactcctgacccctaagggcagggtctataatttgttcaccttatatatactatgcccacctagccacagtaggtttgtgtgtacatctgaagggtctgtcacagcctcagcagctgcttcaggtggggggccatggagaagagcagaggagcttcctgtttgactctgggaggagtttagggatggggaggagccaagcctttgtacctttccccatgaatggtccttgataggctgggcatcataccacaagcctataatcccagcactggggaggtggaggctggagagccaaaaggtcatcttcctacacagtgagtccaaggccaacctgggctgatttgcttttcatagcccatcttcatgcgcaaggacaccaaaacaagtttccagtggcggattcgaaatctcccctacccgaaggatgtgtatagtgtgtctgtggcccagaaggagcgctgcgtcattgttagaacgacaaacaaaaagtgagtagggtggtgggcgcctgtttactgtgtgcggagaggagtggattggagtgagcgctcaggctgctccgtatctgggaggcgggtgctcagagtaaccagctaactgtgcggctccatcgaggcagcagaactcagccagtgtctgatttcctaggtggcatatgctgggcctcacaagactgttgttgaacaacgagtgaggagtaatcacatagccattacttgtagtctctggtagttttactctaaggttgttatgtccttggtctggtgagcttggcttggtgacatcactgcattggcagggagtcacgtcctggaaggtacacctgcttgccttggtggcaatttgagactttaagtctcagacaatgaggtagtaaacccccgtccctccccagactgagagaaagtgggcagacgttgggctctccgaaatctctgcgatggcgtttcagattctctctgtggtctgctgggtgaaggcagtgggtggtcaggtttgagaggagatggccggggtgggatcacattttgtttctgccgctctggctcatcacagtggaagagcctggcaatgaatctgtttcagcctgatcgagaaagagggtgtggccacctccaccctggggcttcattttgtttctgttttatcttcttatccacaagctgccaaactggccagcttgatgctcgggtgcagagcctagccccatgggccactgtatcatttaccacactctccttcaggtggtgtggtaggtacagtctccgttcccctaagaggcctgcctacagggaagtggggagtgtggtggtggggaacctccccaaccacctccagcgcagccctgagtcctgtcctcctcttagcaccccacaccctgtcattttggcagggttaaagggacaagggaaagggagagatgaatgaattaatttcaggattattgctgtacacgcagccagcagcccctgtagtggaccttgtctataaatacagagtcataataataagggtttacgtttataaagtgcgctgaagtcctaagataaaaggccgtttattcccgttattgttctcatcattaacaggagtcagtgcctaaagtggaatttagcaatttcagacaacagagaaattgcctgtaggaaaacaaactccatgcttcagcaagcattccctggcgggagaggccctgggtccaaactgggaacaaaagtgcttctgatagcacttgaatctgcggcttagcactttgtggagctggctgctgcctccttttcatcccccagaggtcactgtcgaatacagatatcagacagaaatgtgattacaagcgagtgctacaagaaaggctagctagctcaccaaaaaaattcatctgtgagcagatcctctgggccccatctcctgcacacatataccgtatataccgtaggtggcgctgttggccaggggctctgtagctagtggggcattccagcacccagtggcacccagtggcggggactggggacattgcagagatgctggtggaggcaaggtaggatgggagtgctatcctggaggggtgggcttcccacaaaggggaatggtattttagtgctcactttgagactgagtttctgagccctaaccaggctcagccctgccccctgcaggtccatcagataggaagctagagaggcggccagatgtgacctatgctttcaacaaagcacaatagtgtttttatatgtgcagggtctaattttttttcagaatactttaaaaatctctttcctggtcatcatatcatccacagcagacatgcagtgtatgaatagatgtagaaaggcatgtaagaagtcggcaccacatgacctgtgcagagaagaatgtggcctccttgctgagcacctgggcatctgtaacacaccccaccatggcactttccttcccctggcgctgtgccctcattttagtattccagcatgcagttcccagccaaagctgcagctgccttgctggtatctgcctggcccctggagaatgtggttagccacttgtttaaagaagtgatttcagggtcctgtggtggtcctccgcctcagtattgctaggatgggctggggaaggaaggaactgtttctacatgattctggtgtggtacatctggtcccgataagacctcagcctggaagctggcagctgttaaggggaaagatggagtgtgctggactaggaagatgctggcttaaatctagcctctgccatgtgactgtggtatttaggccagcttctcacgtaggagaacggtgcttatactacctcaacgattgtttgaggaatttgacaatatcagatacctgcgtgctccctgtcctgtggtcaaggtgccaaagcatgggatctgaagaaagcctggctaactgcactcactgtatggtgatgatgctgtgacagccctagaagccaggactcggtggtcagataacttgcacaccgccagactcacttgagtgtgggcctgtacattatgactctgggagtggcaggaagtagggctgccatgtgcccgggacaggaagtagggctgcagcagctctcgggctgaagccctctttggttacccgccaagcccttgtgcaggctggaggagcgtggggcagcgcgcatggacctttcctcagcagccccgctcttgcctcagccctccctcagggatgttcactgagcctgcaaagggaagggaccggtgagggggtcacagggaatacaagcaaagcaggccgagaaggcactctgactgtgtcagaagcacggtgggttcctctcatccaggccctggggacagttcaagttcagttattgttgcagcaaaccctgagtaggtgaggtggggtggctgtgcatgggggaacccggaaggtactgcactttaaggagttgttgaacctcacccagtgtttgcgctgctggcactggctgcctccgcttcccagactcgtggcaagggtaggttaaggaaggggtcgacgtccccgggatcctgaggttgcctgggatggggacaaaccttgggctgcttctccttcattggcccctcctgggagtgggtgtggaaggcgcttctctgttggttctgctttctgtgtatatttgccaggaagatgttaacacttcctacccggcctttgtgttcacctaatctctgctgtttaacctttgaccctctgctattatcagcgtctgccacctttgctggccagaccagggccccaggaaaagccctcgctcagcctgttggctaggaagaggatgaagcaggcattccaccctgttgcaggcagatggatcgcctttccctggggcagagctttggaaaggaaagaaacttgcggtaccattagggtcccccgcccccactccttttgaactgtcagtctttaagtaaacattcttttcctgcgttgggtcccagcacttgtggggagaggggaacctgggaagagacccccccccaagcctcttctgaactgagggatttgggcagggaggacaggccagaagtgctgcattgatgtcaactctctgagtccctggggcatcagggcttttgaagtggactcagtgtagctgtcaccacaagggccaggaccctctgaagtattgaaagccattctctctgggcccagctcttaagcatgttgtacctgcctaaggcatttccctccttggcccacacagcctctccctctgcaaaaaagggaccccttgtccaagtgaaggctccggcagcccctggccagtgcccagcccacacagccaccaaggagactgccaaatgagactgtttgagaggaagggcctttccttaggctctggtctaataagtgtgtggggaaatctccgacctccccccagcctcccccatccccacctcaccctgactcctacagcactgacaactgaccagggcagcagcagcagcgcctcaccccactctgctgcatttcctccagggaagcctgggatctgtgcttggttggtttgggttttactctatgtgaaaatggaaggctggagtactgagggcaggaaaagggtccaggtctgggatccagggtcctttagcgtcatagctcgtctccctggggagatagatggctctgtgtgctgtgctttccctctgagaaggccccctgaggcttggggtgctctttgtgtagttgggagttcccgccctgcatggggagcccctctgcccctggttctgctcaccgttggctctgaggccactaccgttcttttagaacctcagactcaaccaggcctttctgcaggctctccctgtttcctctcgagctttacagaaaatgggggagagctgtggagggcctagtgtctcccgactgtcggggtcgctgtgctggttcctcagcagcctcttgtgtccccacaggtactacaagaagttctccatccctgacctagacagacaccagcttcctctagaggattctgcgttgagctttgcgcacgccaactgcaccctgataatctctgtaaggtttgcccagacttggcatcaggaagaagtttctcatccctctcccacgtcccaggatccaagcatcccaaacacttagtgtgcttgttagagaaccggcatctcctattcatctgggggggggggggtgcaggaggagaccaagagagagccacaccccaaagctctcgaggtggggcagtggtggtaatcacaagccttaagttgtcaccttggtcttcccctccccagccacaggagctgaggaagtccttcagacccggcacgcctaggtttcctcccatacaaggaggctcttggagagccagagtgagagtgtggagggagaatctagtaactgagttatggtttctccctggttccctccacagtatcagaagccaaaggaggtcatggcggctgagtcagagttacagaaggagttaaagaaggtaaagacggcccacggcagtgctggggactgtaagacgcagtagctgtcctgagccttgcacctccagtgaggaggaaactgtgagacttccggcgtgggttttatggcgcgggcagcctcttctcttctaagaactacagagcccctagaactggctcgtggggaacagcttgcttccacctgtggctctgttcctgagtaaagtcatttgcagttgctctagaaggactgactgcccctttctctacttctgtgtattgcccgctcctggataccctgccttcttagggaagatggtggtgtgacaacccaccccaccttcccatcctggggaccttccagctaacgggggagcagagtgggaacaggctgggcatcttggaactcctgtgtgctggcttgccttatacaagagactcaggaaaaactcctctgaggcaggggtgggcaaaagggaagtttaaacatccagctatcttggaaacagcacagaacgttaagacactatggttaaaagaacatggttacagtactgtcaaaggtgtgtgtatggtaggacagaggcgaaaggtcaccatagctcaacagcctagagtcctccgacagttccttgtctaccccctgaggaggttcttggggacacagagccatagttttgtcctttccctgtacactgccttcctggagccacttagaatgacctaaccaccaaagaaccagatttgtcaacaattaaattttatttttataaaaattacaatggtagcatgtttcccatagcaggactgaggaacagctagtccggaaccccaagctgacaggctttctttgtccttccttcgtttcaaagcaaagcagactggtacctcaggcacgagcccagctccaagatgttggccagagttaccatctgactgaggaggtggctgggaccagcacaagttctagcaactgcatctctttctgtccgggatggtgagagccctcatttcactctgtaggctgcagtagtgctgggaagggctcaggagaaggcctgaccctactgtaaacacctaagttcaggtacattctcctaagagcacaggagggcccacgtcagagtcagcccagcgtccaggactcagtgcttcaggtgccagggcatggtggccagagacctaggagctcactcagcagggctgggaagaagagtgaggtatcccctcacctgccaggcaggagaggtccctgagtagctgacttgcccagccccctaagcagggctgctctgtcatgggttctgaaagtctaagacgtggaggttgtaagacagcgcagcatagagatgcctagtggtgaaccgcaggcagtacacagggctgctgagtggggtcgacgtcaatgagaaggcctgcaagggagacacaggagtgatgagaacctctcaagtgggagatggggtgctcttgctagggaggagtttagaccagtgaaacttaatgacgacagccggctttaggtacaccttgggctcgtcacccgctctcagatgcaacccacaatgaatcttgccatcccagaggcatacactgggcagaacacttacatgcaggcaagcccgctggcgtcggtcccacagccgcacgagaccgtagtaggaggagcctgtggccagcaggtggttgccgtctgtctgtaggcagtagaaggtactgtcatgaggctcctcccactccatgacacatttcctgtccaggaagagagagtgatacaggtaggtttggacgccctctacctagcccagctcagggatagagactggttagggacccctaatgggctcaagtgatgtgaagccttactcaaccaaacctaacggagccttgggccaccgaggcagcacatcctcatctgtgtttcccggcagacgacctgatagaggacccattgtagaggctctaagaaatgtctgctttttcagtctccctggccacagtgaccagagctgccgaagggtagggaatctgaccttgatatggccttgctggcacggagtctctgtgccctgggctgactcaagactaaaaagagcctgcacccatgccaggcccctctccccccacccccagcacactcaccgtgtacttgtgcggaggtcccaatagcgaacataggtgtcataaccacaggacagcagtgtagagggggactcatacatgacatctagcaccccagcccctgggggaaagtcactgcccagatgtgtgatcagctgcccactggaagaaaaaaggagggcagccggtgaaaggtgtccacctgggccgtgctggcacctgggtgctcctgaagaggagggctcagggaagatatggcaagccactggacctccaaatagcaacatggcccacccctcccccagccccccagccccccagtcccaagccaaagcctcagtggggcaatgcggcagccgtcctccatcacacctgcatgccggctgcctgctccctctggggcaatgaatgggtcttgctgaaggggtcggcccccctcagaagcacacacttggttactttatactccttgatctggcaggtcatgcagttctgagctgtctgagtccagtgccttaattcttgcctgtaatctcgggctcaaaccttattggggataaagaccacacaaagggagaaaggagagtcctaggaaatgttaaaacaagtaaacacctttgtgtccagggacagaaatagctgagaaagcagcttagtgtgctggtccctggtgttctcggtctctggcccccagcccagggctaacacgcctctatgatcacagcccccagcctgctgggctccagcctgcccccccacccgtaccccgcccccccgcccggtggccgagaacagattactgagaagaacaatttctttgtgactgtgtaattccctccgtgaccgcggcagtgggcagacctctcaccccatgccagacccctagcaaccacgtaggggggcctcttggccctagcaactgcccctcaacatcaagtgcacccgctaatccttgtggccaggggatgggtggatgtattgagcttctgcagaatgtctggggggaacgatggaggagaggcaccctctaggcctaatgcctcagcctcctctttaaggccctcctccatggtatgacaggagaaacaaggccatagacacattacaggatcgctcaggtaagaggcctgagcagttgtcagcaaagggcttgaaacaggcgtggctgccagccatgtgtctaaaggtagacgaggtccaagctgtccccatcactcagactcttacccagccaactccccccaaaaagacatcatcttgcaaagtattgacacgggagactgggactctctctttacctacgtggcctttcactgtgaacactgaaggcttctaaggttcactattgctatccactgaatggttacatcccagattggcacctctgtgcccagccaccttcccagggatattcttgacatatgcagcggcccagtgttggcctgaggagataaagacaggcttgtagcagggtggtgatggcacacacctttgatcccagcactcaaggggcagaggcaggtggatctctctgagcttgatgctagcctgggctacaaaatgagttccaggaagccagggctctcacacaaagaaaccctgtcttgaaaaaaacaacacacaactaaaaaaaaaaacaaaacaaccaggctgtcttccagggactagggtagacattttctccccaggtcaatgtctgatagagaccctgggctttgctcccagagaggccctgcctttctagaccaaccaccaagcaccttggccgtgggaggtgggaggagtctctgtctctgggtgcacttgggtttgtgtacaccagggggagctgctgcgctccacacttctccctttcctgactgcgggcctgcccactccattagtaaagctgtaagggatgattgaggaagtctcccctttaatctgtggaagtaatttcatgtttgtttgaaatagaagatgaaagacttggggtagggtggagtctagtggagccccatctgcccaccctgttctgagagaatgagacctgggcatccactgctagtggggttagcaacgagggggcacatccacattgaaccactaatctggatcctgctcactgcccaagaagcccccagaacagcataggccaaggggtctgggcgggggggggggggtgggaaacggacccttggcctagcctgagaagtgtctgctttcctttctctagaactctcaagtggccacacacactttaaaccaccaataaaaagatacactttctttggccttgaggctcaggaccctcgaggctctgttgtaaagcactgcaaggttaagttcagagcatcaactgacacaccaggctctgggaaatggcctgtctcttctaatagtggcccagcagtgccacgggagccctgctgggactttgatttgggaaaacaaacagaaatggcaccatgggcccttcaggttcccaccccaggcccaatttccgtagaaagctgtagtgctgtggtgctgagggagaggctggtcaacaatagcccagcagcctgtgtctctgtcccctcctgccctgctgttctcactgcaagtgtgttcttgtaaaaacgattagattgcaatttgtataacgtggtgacccccaaattcagacatttcaccccttttctctggaaagaatgttaagaatgcgactcagcttctcactgtagggggcagaggggggcggcgtgcgcagagccttggctgtcccacaacttgtgtgggaacagggctgcagctcagagccccaggccaagacaggagcacaaactgggcttgtcactatagagtcagacaacaaaaccccttctcttccagctctgtagacaaagccgaggtctccaggagctgctgcgggctggggacccccacaccctagcctcctgagtctgacttcagcaattctctctccacccagggaaagataaagacagatggggtggcccacagggcgagcctgatgaatgaatgacagaggccaagtatgcatgctgaaggagccctgctccctggcacagccactgcagctgtctctgtgaggctctagtacctgggcaggaagaagcaagctaagtgggaccatctccctgaggagtctctcagaacagaaggcagggctcctggacctggctcaccctgctgaccaagagaaagagaaatttaataatgtattgccattaaccactgtggcccagttgacagaggcatttccctgccccaaggctggaccctgcagaatctaaacactatgccatatttcactctcgtgtgtgtgtgtgtgtgtgtgtgtgtgtgtgtgtgtgtgtgtgtgtgtgtgtgtaggggaggtgggagggtggtcctactgtgtagccctggctgtcctggaactcactctgtagatcaggctggcttctaactcagagacccacttaggatttgaggcgtgggatgccgccgatgctgcccaacagccccgcttcactctcagccctggcccacacaccacaggcccctgtactagaaaccctctgaggctccatgccacagtgacatgagcttgtggctctcacattttcagctacttgtaacatcctgacgtatgagcgggctccctggagtctgtgcatgggtgctgtgcttctctttggaatcaggactcatctggcacgtgctaccttgaaccggaacagtggttttgggggaaagaagcctggcaagctgacatcctcgctccaagggcaaatggcctgaaggttacatcaggcccaggatcattaaagaaagtaaaaggggccctcttttttcttcccttaacaattaaccgagcaccttcttctatatgcaaactatcatgctttaacagaaattacagagatgtgagctgcactataaaggacgtactgtccctcttttcagtgagtattctgtccaacgagggagagaagtctaaatttatactcacaaacagagaaaaacaactttctatgaggaaaatcagcattttgggtgaggggaatgagtgattctttagttagtgatgggactgtgacaggcaatgagaaggaaagtcattgatggaggtgatgaggcttgagtggggagggcacgccagagtctctggcacccagaccacaggcctgtggatacacagccctacctgccatagagcaccgtgaggctttggggcagagtagcagtctcagatcagccctcggattatgaataaagaagccagagctacagagaaaataccttcaggttcacacaccaagaaaacagaccaggaaagctgcaaccgcagcctggtagcctcgtgagaggagtggagatggctctgcaggctcgggtggcagatagctgccacctctacagcagctcacgtggctgagtccctgtgtctgggaggcactacacacagtgcttcatagactcggctcatggagtccttagcatgggcctggggtctcctaacaccactgtacagatgagtaagccaaggcacaggttgcccctggtaaccagaagtcaagatcatggattcaagcctgcctgctctactgcactctcttgctggtggccttcccacttttctctcatacacacaggaccttagatatcatccgtagttggcctaccccagtggacacaaggaccagcttcaggccctcacttgtgctttgcgggcctctgcacctcacgagtgcctaagggtctggtcctcattgggaatatgtcctgaatttaaaagaaaaaaaaaattcacatggttcttagaaaggtaccatgtgggtaccacggtgcacttatagaagttggggcaatttcaaggactcagttatctcttgccatgtagggtctgaatatcaaactcaagttgtcaggcttgatgaaaagacactttctgcccactgagcacttgccccagaccccaaatgtaacagtggagatgtaggataaagagatgatgctgaagggtttcgcccctgccacatcaggtctgaggagaagacacatggtatctgtcacatgtatgtatgtgtgtgagcatctgtgtgtgtgagcatgtatgtatgtgagcatgtgtgtgtgagcatgtgtgtgtgtgagcatatatgtgtgtgagagcatgtgtgtgtatgagcatgtgtgtgtatgagcatatatgtgtgtgagcatgtgtgtgtgtgagcatgtgtgtgtatgagcatgtatgtatgtgagcatgtgtgtgtgtaagcatgtgtgtgtgagagcatgtatcccctctcggcacccaccagagcacacgtgttcagacacactggctcaaaggccaggcagccaggcagcccactttgtactgctaacaaggcgacataattacaggaaagggcagccgggcagataaaaggatacaaaatttcaacatctgttgccataaagggataaggagaagtgaaacgcaaagtatcagtttggtgtcagcaggcagagagccaatttcaaagagttgagggggacagaggggacaagaaagcaaaaccaaggggggagaaagaaaaagaaattacagggttccttaaagaagtaaagaaaagggagaatgaaaaagctgtcagtaatactttcaaaggagaaggcaggtactttcaagaggggcagtcccataatcaccctgactgaaggccaggcccctgtacggggcgggggagaggaaggcctgggcagacaaagccacatctgggtgggatggggcatgtgtgatgtccttagcataccagcctgggctgaccatagtttccatctccatccatgtgaccctgccgttctgatgtcagccctgtgttcatatcctgtgctcagcacaagctgaagccacgttcccagatacctgggattaaccaggtagccctggtcagtaggctagctcaggactcagtagaagaggccatggggacagatcagggaaagcttcatgaggggacagtattagtgctgacctggaaggtctccttaggcagagattggttccagtatggggctgccctgagcaaagcccaggtgggtgggaaacccactctgcccgttccctgcagagaagagatttagtgggttccttcagtagaggaagaaaagcataacagagaacagtggtggccccggcctcaggggacagagataaagggtttgtatagcgacatgtgaatacacacctgcgaggtggactatccagagagctcaatacctctcaacagtgaagtcagcaaaagcccctacctgcttccctccctagcagtccctaggattgcttatgtccaagggctggaccctctgtgataccttcaggtctgtagtcatagtagcttacctgtccctagccacaggggacccagagtgctctgctcttagggaccaatgctaaatgcagccagctcaaatgccccctggtagaaaatgcaagtcctaaagcaaaagcagagtcagtggtggaaggtgatgtcaggccactctgaccttctccaacctccagtagctagagatgtgtgcacccctggggactagccaagtgctttgttgaaatgcagacagaggacgcaaactctaacgtctccgggcttcaagctaagggatggctttgcaaagcacagtccctcagagcctaacaagactacctcaaaggttggatgtcactaggaggtgttggcagttgaaaatgaatactgggcctggagactatcagaaatcaagttctgtgcacctcgaagctatgctgtgagaaagatgccccatcttcctcattggaaatcccccctccttgggcttaactttacagtgctgttccaatagaggaaaaggctgaaaaggagataccaggcaacctcgaccagccccttcctcgcccctcttccctgcttggctcctgagtaccctgaaagggctgtgccgtccctctgaccacagtggtgggtacctgggagatgaatgtggcaacagctctaaaggggacacaactggtgtccagtggggtagctgtacttcctgggtgtcccagcccccaccatcacctcagggtagctcagatgccgagagctaccctacaccccaagtcagcacacacataaaaggaaattcaggctgtgctcaggtttcggcggtgacaggttaaaagcaaagcatccaggcagtggcacattccgcccagccagcgtcctgccggcaataccactccacctcgcagattgcctgtcactcaggctttggtgttattgaaagatcaaacttggtcctgcctgttcattaccttaatcctgttttctacacggctttattatctgcttgggcttctttaggcaagacagcttcagagctgccctggccatccatttcctccaccagggcatctccgtaccccctggcctgctcagttctctaagctgagcacaattctggatacagggtagatgtctgctcaaggtctggctcctcctatgggtgatgagggcagtctggggctagagaagaggcaataccatgtgatactagggtggccctgtcacaggcagagcccagaagttggcagagaatacagtgacaataactcatttggttccaggacaatcagagacctcagttgtcttgtgcccattcttttttttttttttggtgtgtgtgtgtggttttgagacagggtttctctgtgtagccctggctgtcctggaactcactctgtagatcaggctggcctcgaactcagaaatctgcctgcctctgcctcccaagtgctgggattaaaggcgtgcaccaccactgcccagccctgtgcctatacttatttgtgtttggggttgatgacatctagagatttcatgaaaatggcagtgccccttagaacaccatcctgaccctagtgcctccaaggcagccacaggcagcttgaagatcatccagttgagatgttggttgctaggccatggtggtgtactcagaccacagtctgcgagccaggcccaggcagagatgattgtcatgagctacagctgtgtggctgactgaagctgctggcacaaatgccatcccaaaccacagccctcctggcaagatcctccttgctgtggggctggcagttccctctaccctggccagaggccacaggtattctgggaattgagaggtgagatcctcacaaaccctttggttctgagggagaaagcaaaggtgtcaggcagttggggggggggggcatttttcaggtatccagtcacaactacttctggagttggggacacactgcattcccatttttcagttcccactgtggaaagcaaagttcagagaggtcctagatgaggctggtaagtgacagtacagttttgattgggatactactgcttccagcacacagccctctgagagagggctcctcttgccttggccat

SEQ ID NO: 644 - DNA, 1177 bp, Mus musculus
cccgggtcatccggaagtgatcatcggtcgggtagttgccatggcagtggcccggcgcgttcctgggcggagggaagatggcggtgactagctggttggaggttttgcggtcggccgagaagacggcactgctgcaggatgggaagaggatggtgcactatttgttcccagacgggaaggaaatggcagaagaatatgacgagaagaccagtgaactccttgtgaggaagtggcgtgtgaaaaatgccctgggagccttgggccagtggcagcttgaagtgggagagccagtgccctcaggagctgggagcctgggatccgagctcatcaaagaaagtaatgccaatcccatcttcatgcgcaaggacaccaaaacaagtttccagtggcggattcgaaatctcccctacccgaaggatgtgtatagtgtgtctgtggcccagaaggagcgctgcgtcattgttagaacgacaaacaaaaagtactacaagaagttctccatccctgacctagacagacaccagcttcctctagaggattctgcgttgagctttgcgcacgccaactgcaccctgataatctcttatcagaagccaaaggaggtcatggcggctgagtcagagttacagaaggagttaaagaaggtaaagacggcccacggcagtgctggggactgtaagacgcagtagctgtcctgagccttgcacctccagtgaggaggaaactgtgagacttccggcgtgggttttatggcgcgggcagcctcttctcttctaagaactacagagcccctagaactggctcgtggggaacagcttgcttccacctgtggctctgttcctgagtaaagtcatttgcagttgctctagaaggactgactgcccctttctctacttctgtgtattgcccgctcctggataccctgccttcttagggaagatggtggtgtgacaacccaccccaccttcccatcctggggaccttccagctaacgggggagcagagtgggaacaggctgggcatcttggaactcctgtgtgctggcttgccttatacaagagactcaggaaaaactcctctgaggcaggggtgggcaaaagggaagtttaaacatccagctatcttggaaacagcacagaacgttaagacactatggttaaaagaacatggttacagt

SEQ ID NO: 645 - protein, 217 aa, Mus musculus
LPWQWPGAFLGGGKMAVTSWLEVLRSAEKTALLQDGKRMVHYLFPDGKEMAEEYDEKTSELLVRKWRVKNALGALGQWQLEVGEPVPSGAGSLGSELIKESNANPIFMRKDTKTSFQWRIRNLPYPKDVYSVSVAQKERCVIVRTTNKKYYKKFSIPDLDRHQLPLEDSALSFAHANCTLIISYQKPKEVMAAESELQKELKKVKTAHGSAGDCKTQ

SEQ ID NO: 646 - DNA, 49152 bp, Homo sapiens
  misc_feature (1)...(49152): n = A,T,C or G
tcccgcccactcggtgttctcaccccacctgatctcccagtttagaacatccaggatcaaggacagaacacacccacggggaaactgaggcacagagccctgaccagggttgagtgtggagaatggggtcccaccggattcagcaccaaagtcaccagtcccagctccgctgtctcagctcccggcggggtgacggggaggctctacccccttcgaagggcacgccaggccccttcgggccgcctcctgcagagaggagcgggggctcgcgctgcagcagcgcagtggggacccttccgccccaccccactccaccccactccactctcacgcccgagatcggagagaagcccggccgcgggtttcttgccccgcacccaccgcaccctcaaccacaccccacccaggccttccgcgcggccggacctcttcgccggtcctcgcgcgccctctgctggcggcttccaggaagcgcgcccgtggcctccaatacccgccccgcccccagccaggccccgcagcccggcaggccccgcacccgtccccaaggacgccccacggagcactccccatcccgccatccccgtttcagtgcggccgctcccatttcggatcccagaggcccgtttgttcccagagggtggagggtgttaggatcaggaaggcagagcctgaagctagagtnnnnnnnnnnnnnnnnnnnngcctctgggttctcctctggggccacgcccgaggccctcggctccctccccgttaggcagctcgggaggaaggggaacaggccgggggatgatccccttacaaggtgctgtctggctgacaggtagggagggtagctcgaccagaggctatgctcaaactggccccaaagtgctccacagaatgctgggtccaaggtcaggatgatgagggaggattcctcagcggacgcctggagctgtggggaggcgacgtctcaggccaggcgaggcccccatcaggccctgaggtggagttggcatggggacaagtgaggcatgtgtgggctgtggggccggaccgggtgtgtgcagggacatgaggccaagggctgaggggaaagggtcaggtgtgtgcaggcccgctggggccatgggggacagggcagacacgtagggatgtctgtgagctacagagcccggacccctgcctccagcagggctgtagcttaggagtgctcaggcattggagccctcgacaccactaattcccaaatggaggtggagaggtcaggagaccccacctcagggcaagcgggcgactgctgattccaaaccccaggcttcagggccggggactgtgtccttcaacatcagcacaggaaccctccacagactgaaaagctcaggctccttgcttcagataagggggaaggagggaaagaggttaggacagaaagcccagttacatttgggatggatcgaaccagtcccagagaggagccaggaaaaccagctgggcttcccaggtcacacagatctgagctgaaacccagctctgttcttcatatggtgtgtgacttagaactagtaaatgaacctctctgggcctcactttcatcatctgcaaaatggggataatacaactatcagagggctgttgggaagcctacatgatataatccatgtgcagaatgggttaagggtggactggccaggctcaggagtcaataaatgacggtgaaactctgctgaaacaaaccagaaatagtgtacagctaactcctcactggaggctcctttcataacctgaaaaatgtgccttggtcttctccaacctccatagaagctgttgccttctatctagtaggaatcaaaaacatctttggccgggtgcggtggctcacgcctataatcccagcactttgggaggccgaggcgggcagatcatgaggtcaggagttcgagaccagcctgaccaacatggtgaaaccctgtctctactaaaaatacaaaaattagctgggcatggtggcatgcacctgtaatcccagctacacaggaggctgaggcaggagaatcgcttgaacccgggagatggaggttgtagtcagctgagatcgcgccattgcacactccagcctgggcaacaagagcgaaacgccatctcaaaacaaacaaacaaaaaacatcttttactggcaccaatccaggcaccatgaatatatacatttgaaaaactctggtttgggaggaggaagggaactctggtttgaaagggcatcagattagcctgcctggagtgcccataacctagaaggctctacctgagccaatgccacagaaactcctcttgtcaaggacccactcctgtgagagggaagctcactgctcaccacgcaggggcccagactccacctgggcaagagtcacaaatgtaaatgcttacagggttcggtcccagttacagcagtagggagtggtgaggactttgggtccagtcagttactaccatgtgggaatataggggaaggatggcattaggacagagcacccagccctctcccaacttcatcccctgcccacctcctaggagcttcctaagacacccttcccctaggccctatgagtctgtttcctactgctgcataacagattatcacaaactctgccccttaaaccaacaccaacttatgatctcacagtgctgtaggtcagcagtctgagcaggctcagcccagttctctgcttagggtcccacaaggctgaaatccaggtgttgccagcctgggctcttcgctggtggctctgggaaaggctgcatccacacacattcttgttgctggtggaattcagttccttgtggctgtaggactgtttccctgctggctgtcagccagggctgcttttcaaggatgctctctggcctttctcctgcttcaaatctctctgactgcccttctgctaccagccagagaaagctctttgcttttaaagagttcatgtgattagactaggtccttttgccgtataatgtgacatgaccacatgagtgacacctcatcacagtcatacccacactcaaacgggagataatccaaaggcaaagataactgggggtgatcctttgaatcctgcccagcacacttagcttctggggtggtgtggaagcatgccttactcctaggtccagccctcctgacctctgagagaccttgaaccagggcatatcccatctctgggcctcagtttcctcttttataaatggggtaagggggctggatggcatctaaaattcctcccaggtcccaaatactaactgtgacacaggggatggggaattcagatcccttgactggggggccccactgaccatggaagagcaggactgtgttgccctccagcagcacccccatcccaacctcccacagggccttgctagggacagcaggatcggtgacagccacacagcacagcaaaggtgcccagcataaggcggccagctcccccgctgagctgagctgtgggcaagtggagaggctgcttctgtagccagagaccacagtgcctgtgaggccccatagaccatgatgggtctattatggagcctgcacagggcaaggtgggctggatgtacttgggagtggggtggggcaaagtccatgttgggtgggcaacaaccctcctacctctccactcaagctggtttccaggctcctctcccagatccatctcatcagtcctgatctcagcttctgcatctccaaaagggccttctcaggctcctcctgcccctcccacctggccctagctggacaaggggcattgacttcagcatcctaggccctctgagagtcccaatcatccagccccacctgcttcactcctcatctttctcccaggcccctcctaccctccccaggtgccactttcagttctgcctacaagctgcccttcaggggtccccattcccccaggctcccaccaaggcccagcagagggggctggaaggagcccctccccaactccatccaagcgcgggagctgggtaagaggcggggaaatgaatattaatttatcatgattaggcaaatccggcagggagagccgattccggcggaggaggctaaaaagatgaatttcagcaataaaattaaataaggacggacgggcagcccctcctccctcccgctttgctgatctctctctttcttacaatttatgaggccaattatgaagatgaggttggaagttcctggaacttcactaaatgcaaacggcggtccctgctgttcccatcaaattaattaaccgcgcgctattgatggccgctcaaggctgacgcaggcggcccaccctgcggcctcctccatggacacgaggacacagggtccgggggcccagccaggactccacctgcagtagggactccagcaccactggggacttccagggaccccccacctccttctacccaaggccttgcctgagcccttaacaacgcagggcctccaccaagacctaaacagacagggccacacggtcacatgcccagggttgagcacacacacactcagatacaaaatcatgaacatacagcacagacgcaggggccgggaatgtgcattaggcacacacatgcccctgcagtggaacatgaacacacatatgcaggggcactacacacacaacaacaaccacccagctgagggaaccggagcaaaggatgggggaggtgcgctgtgtctggggctctgggcctgctccgtcagggccaggctgagtccagcagggcaaaggtgccaccattgctaagaggctccactcaagcaacggccagtagcctgccttccctggggtccgtactgccctccaggggcaacctcgggcccctacccatggcccctcagcccctggggccttgcttcatctccaggcctggggccttcttcagggatgttccctgcagtgtggggaccaggtcttgccgaacagagcctcaggccagtttgggacttcatccctgaggactccccagttccagagctcagaagcagtactccccagtggctcaagagttctggaaaactaagggcagagcagacatagggccaaaggcacctgcggctgagcccatcaaggcctgcaagcctggtagcagcaggtgccccaacagcagtaacttgcatgggaggccactccctcagataacaggggagggcctggaaaggggcgcccctgtttggggagcccaagtcttctccaagccacagtcctccatcctggcaagaggcatcccattccatttaaagggagagtaattccatgattctcctggagaagcaagacaatgggcctgggtttgcctttcccagccattggaactgtaggatgggacacagctagacttgcctaccttgtcatgcccactccaggtgatgcctgggaagcccctgtcccatgcccacacctgccctgtgagcagctggaacccaggaggaaaggccagggcctgtctcgctcccctttcccggtgcccacgtctgccttgtgagcagctggaacccaggaggaaaggccggggcctgtcttgctccccttttagtgtaggtctaaggtcaagactgaggtccccaccccaggccctgggaaaagatgaagctccaagctcagtaggggtggggcagagcagcccagcggggacttgcatcttgcacagtgtcaagaagaaactgaaattagggaggctcagactgaacatgtggcagccctgggctcatgtgaggctcccccttccccacacacttcagaggatgccctctacctcacagcagggcctgctcacacttgctgtccctctgcctttgtacagggagagcccaacacgcactcggtctattgggtttctgcagtcacattaacaaattacaccaacttactggcttaaacaccacagtcattatctcacagttccaccagctcaaaatccaacagggctccctgagataaggccagacatcagcagagctgccatccttctggaggctctagagtagaagctgttccttggcttctctgactcttagaggctgctcacacttggctggagacctttccccatcttcaaagccagaaacttcgcatctctctgacctttcctcgtcaagtctctctttgattgtagattgtagcttttttttttttttttttttttttttgagacagggtctcactctgttacaactcaggctggagtgcagtggtgtaatctcagctcattggaacctctgcacctctgcctcccaggctcaggtgatcctcccacttcagcctcccaagtagctgggattataggcaccactaggtctggccatgcctagttaacttttgaattttttttttttttttttggtagagatggggttttgccatgttgaccaggctggtctcaaactcccaggctcaagcaatcaacccgccttggcctcgcaaagtgttgggattacaggcgtcagccaccacacccggctctgactgtagctcttaagaactcatgtttacactgggcccacaggattactcagcataatcacctcatctcaaaatgcttaagcttcatcacaactgcaaagtccctctagccaactaaggtgacatattcacaggttccagggattaagacatggacatcttcagtggaccattattctgcctgccacacgtggcctgtccaaggacaaccctggctcagggacagagtgatgaagaactgggctggagcagggagcaggcttgtggggtctctctgcccactccaggccaggtggtgactgggtggtaggtgtgcggggtgctcagctgctggacaggaccccagttaccaccagggccctgaaatggagtctctctccattcaggatgaatgggagactgggctgaaagcctgttcgagaacctggttcagcgctaaagtgcctgggaacccccaatattcatattccttgcttacttggactcagagaacctcatttcacctcattttacctccaaactgggcagcctttctcaagactcagaaatccctccattagctcctctgcctcagtggctcttctcctgggcttctgtgtcagactgggcagctgaagggacacccagatgggtcactggaggtggggcatgctccctctttatcccacgactttgtgttgccctggccaggaggtgggaccaagagtctgcatggtttcaaggcagtctctgaattctgagtctcctgggggaaggagttaaggcagatggggagggatgtcaagaatggaggtcagaccctgatttcagacaaagaagtaagcggcatccctccctgcagttctgggacctccctgtgtgtaggaaaacttgggcgagctactctatggcctgctgcacactggttccctccacccccagccctggaggtcctgttccttgggcctggagcaggctgcggcaaaaggagagaagcaacttccacatttggacccagacacgcatctttggacttctgctgactccaactcttgctggggacagcagcaggcactgagggaccagtccagagtgggaccaaaagcaagccttcacacccgggggcccaggctttccccagcccctctcctatctacccaggcccccactgtggctcttggcagccatgtgtccctggcagtagacactctcaggggagaggctcgcccctctagaaggcttctgggcttttgattggccatctcttgggttggtgctgagctgcgaaagggccctccaggtcctgtgggcttctgattcctttcccaacatgatcagtgctgggaagaccccctgacttacacttcaggggtatgagcttgagttggggggcctactcccaggctgctaggatcccatgatcgagaccaggcagacaaaggctggctccgggactctgcaagttaccaacagaaatgtagcccacccagcacactcaaggtgggatccccctgtggagccaaagctgccctcacgcgtcaccacccaactcccagcatggggcctctccaggctcctcctccaatacagtctccttctgactctgtgcccactcctcctcatacctgggctgcctgaagctccttccatgaccccactcccccaccaagtctccctgccctgtgaaacagcctcaggaagacatcccgcactccccagcgggacctgctcctgtctgctctatcaaaccaagctctgcttccagtcctctgccagcccagcctgctcctgactcccagcacacagtgtcctctctaaagctgttccttaattgtccccaaacagagcctgctgactcctctcagaggcaatttccctgccagtctgcctctctcctcctccgggaagccttccctggccgcccatccctgtgtacacggtcaccatttagttgttcctaatggtttcctgagtcttgtcacttttgctcatgtcccctgatagcctggtctaaggtagggcctgcagaagatgctgatgactagataggagctctgggtgcctggctccaacattctccctggtcacagccactgctgtccttgctgtgagtttaggagctgactcaggccagtcctgtctggagggcagttaacacagcctttctgggctcctcttttcagttcccatctctgtcgtccctgcctgggtggaacaaggtagccagaggctgcagcagctcagacaccaggcaggttcaatgtcaaatgcactttactgggcccctgggcctcccaacactgtcctcaccaaggctggggcaccccattcccagcaccaccagctgcccaggaagcaggacggatagagggaacacatgtggaatggctgttctcctaccccagagggtgccggatgatgttgacagcacggctgcttccctctcccctgcagcttctgtccccacccagcagcttggcctttcccatagcagggaagggggatacctggggcttcaaaccagccacctgctcctgcttaaaatggggcaaggggccatttgcaaaattcttcgaggggcagtggtgaggtagaaggggtggcagcctgctcctgtctgggagagggctgggcagacactgggagccgggcagacactgggagccgggctggctcttgcttcaggcccagagccctgggccctgctcgctgaggaagctggtggttggagcggcgaggttcagccagctgaggctggagggagtactgggtggccaggaggggtagccagtccaactcggctctcctcagcacccccagccatgggtcaccagtcccgctcagcaggttctcggtaggggaggcctaagagcctgaagacatccttctcagtgggagtgggcagcactcggccaggccccaccttgcagccatgggtgttccggaccacagcagtgctgagggcatgttctgacagactcatgcccttggttttggccagggctcgcatggagcggttgaagtgtgcagagccggtgaagtagagcagggcacaggcaaactcgctatagggcaccacgatgatgtgccaggcgccggtgccgccgccctggccctgggagccggcacacccccaagtacttctgttgctgaccattctcctcttggctcaccaagtcatctgtgaggaaccctggcccaacagaggggactgctgggagggcagggaaccaggcctgggctgtcccatcctcccaggtctctcctgatgtctaagctggggcttgcccaggtattagctgggtgacactaccctctctgggcccttctccttttctgtaaaacatggatagtaattcccatctcccccatagtgtcacagaaagatcagatgagatacttggcctgcagggttcactgagcacctccacataggtgtggcggggctgttccatctctccctggagaggattccggccccgatagagagatgggatgctggcaaagcactgttcccctgcttcctgcctcaggactggaacttctgaggttctccctctgagggggcccccagacctgtgctgccctctgtcaacctgctcacccagagatggagcttataccttcctgccgaagactgtcaaggaggcggctgaagataccccggtgggaccggccatctgggtgagtgatgagcacgtcgacatcaccacaggtcgcctttccccgtcggtatgaaccacatgccacacacagcagcccagagttaaaggcctgggctgctttctggacctgggaaagagagcggtgacaggtgaggggctgtgcgtggggagctcctctcccacagcagtacaagggccttcccagactcgggcccacaccctcagcttatgcccattccagatgcctgctgcaagcccaggggaatccaccctgaggagctgctgttctttcccttcgctaggacaggagagaagaaaaagctcactgtgcaggaggcaagcctgaggagagacgggagaaggtgccggctctgcttctgagagtgggcactgagcttgccctgtggagctctttaagagtagggagacacagactctctctgcccctgccccagcccacgtgcccaggtctgtgaaactccacttaggacaaggggccaggtgctgaaagccctcagccaggtctaggcagccccagatatctactgatttggagctaaaggtttggaatatgtgagctggggtttgaggactgagcaggtggctggcagcatgcgccaggcccaggcccaggagaaagtggagcacagaaatacagctgcacctgtgggaaaggagaggaaagaaagcaaagagggggcagttctgagccaacacccacatcctttcttggtggggagggagctgagacagcaactgccagctgaaggattgtccctctgaggaaaaataaacccattagcctccacccctgagacactgaggttctttcatatgcagatggcctcctgcctccaccccaggacactgaaaattctggggccccggacacctcaagtatcctgacaggagggctccgctaatccccttactcccttcttgagcctcccaagagaatggaaggaggaggtccacgtgagtaatcccatcaaaactcctatggctggagcccttaaatgggggcacaggaggccaggtgggaagcctcttttgttccaatgggctgggtactgactgaggcattctccatgcccggacaccatggctgagtgacggtgtcatcactagcaccaaggcctggtgatgggcagacaaagaggcctgtccatccatctcataccggcctcatagccttgtggcctggaatggagctgggggctgatttcaatcaaactaggccagtctccatgggatcccactctatcagaatccctgaccaaagtgagcaaaacttgcctattacaagcagctcctaatcctaatgcccattgaacaaatgatacatctagccctaaatgcagtccagtgtctctctaatctagcttttacatgaacctaatcgctaacccaactctaaaccaaacccaaatcttatttcttggacaactacaaatcttaacttaaaagcaaccaacattaagaaaatcctacgcctaattaaagcctaactttaactcaatctttttttttttttcagacagagtcttgctctgttgcccaggctagagtgcagtggcacaatcttggctcgctgcaacctccgcctcccaggttcaagcaaatctcccacctcagcctcccaagaaactgggattataggcatgagccacggcacccgcctaacttttttgtatttttagtagagacggggtttcgccatgtttgccaggctggaaatttttgtatgttttatagagacagggtttcaccacgttggccaggctggtctcgagctcctgagctcagatgatctgtccaccctgttctcccaatgtgctgggattaaaggcataagccactgtgcctggtcttaactccatcttgatggagctttcttccagccccaaaccaaatcctactgacactgtgcttttacaccaactctaccccaaatcctgagccagccttgcgtgggctttagaaggtccatacatctggaaaaagacataaacctttgcacatttgtgcattttggggagaaaacagtccacagttttcatcaggttctcaaagaagttggtgaaataaaaaaaaaagataaaataaaatattaaaaccctctgccctgacccaccctaacctcagtacagatataattcacctgtaatctaaccctaacattaacccaatcctaacaccaatcagtctagaattgaatccaatcctaataggcctgactactgagaaccagaatctagagggctggtgttacagctctttcctcccaaagctccccacccccacctctgggcctggagcttcagtcttaacttgctctgtgctcaacctctggtgatccacagtttcctctgcctgctgtcctccccagctgaggagttgggggttcttggctttgacccaagaccttacagcaggacctggctgtcctcactgctctgggacacctgcttactgtctgctcaatctctgtagcctcctccctgggcatacgttccaggaagtcactgtaatgcttcaggccgatggcctgctgggttgtcagggaggcctggctgcggatgtcttccagacttcggaagccctggaaaaaagcagccagatgggaagctgtaaggatccaggaccaatgaagaggcatgagtgagcacacacacaaggcttccatcgccccagactctagggaaggctagaggcaggaccaacctaggggcagttgggtctgtactcagcaggacttgggaaaggcagggagcatgggaaacatgccatcatccagccctgccactatcctaagatgctcgttcatgattccatcagtctgaggatggaccttgtcatcttcatccttaccaagctgccctggtgattgtgggcagagccaggattgggaaccactgctctagacacgcagtgtcaaggcctggcctcctcaggaaggcccttgctggtctggggagactgagaaacatacttcttgtccctgtctactccttcttaaggataccaagcaacaaggctgttctgggagctgaggggtctatatgagtcctggtccgcttgaaaaatggtctccctatactgtgggtgcattcccatcagagcacagcatagggatctggggcagagcacagcacacatctggggcaggaactctgagacacagcaaaactgaagtaggggctgagccagggtgtgacctgttggtaccacatctgggcagtcttggtcccagctccccagatgttggagaagagctccaagacaggcacgctctcactgatatggtccagcttccgcaaatgcccgctctccaggatctctatgattttctcagccatccgcttcccaatcccagggatactgcaggcctcctagaggaggaggaggcagaggcaagaaagaagagtgaggagatggaagaggtagagccagtggaaaggaagctgactcctctagcagatgctgacataaaagccagcctggctgcttggcaactgtgtggctgtgtaaagcttgggtgtagttgaagatgagaattttggatagaatgagggctgggtaatttgtcttttggttcccagaaggatggagaccagcagtaagaagtagaaaataatgatgatattagtcaccaccaccaccaccaccatcatcatcattccaacagcaagagctaacatttactgagggcttactctatgtcaggtcctgtgctacagggaccatttcatttaatagtagcccctttttactaatgagaaaactgatgctttgagagtttaagtaacttgtctggagtcacacagttagtgaatgacaggaaccagagttcaaaccctggtctgttaggcttcagagtccaaacttcttttaaacaactttttaggcgggacacaagggctcatggctgtaatcccagcactttgcagggctgagccgagggtagattgcttgagcccaggagttcaagaccagcctgggtaacacggcaaaacaccatctctgctaaataaatgaataaataaataaataaacaaaattaaaaataaaaaacttttaattatgttaaaaaattcaaaagtagagagatccatataacccccaagtatcgtacatctcccagcttcaacaactatcaagattttgccaatctgctttcatcaattttccttttttttcttttgtgcaagtcctagaccccataaaatcttcaccactgtacctgaaccccactggggttactaaccactggccagtaaagacccctcctcccactctagcccctgggtacctggtacgaggtgacaggcttatggaagctcttgagggcattgatggccttggcatagcccagggccctccacttgtctccctgaacactgtaggctttggccagaacttccagcttctctgtgatatggaggttgtgattggtcgccttctggcttgagggctgtgcacagacccacttatccaggacagcaggggctgggctaggctcacaatctccctcaagggaggtggggtagtggccactgatgagggcttccagatcagctgcactaacctgggtttcttccccatcactggcttcatcatcagagatgggcttgggatagagaagaaaagaaaacaataaattcttgttctccaagagaagggatccttaaaggtgggggtcatcttctttgtgcggggggagggtcttctagtcagacctaagaatgaggcggggccttctgcatcagacttggatctccttgggtgtgaggccacgttccctttggctccacgcagtgcctagccctaggatccccagtggtatgtgttagatatggcctagataaatgcagcagtgatgagtgttgggaagagctaaatggcttcacaatagagccctcctctctcaggggcctgggactttctgaacagccaccaggcccaccccatttctgtgatctgcttcctaggggaagggagttctgagggatgggaggctcctgacctgggcttgggtgtttggtgcctcttttgccttttggggaggagacacaggcctggtgggaggaggaggaggagaaagggctgtctgaagcagggcctcatgggtgccaggaggaatagaagcatcctgctctgccttgctgggctgtggatggtccaagtacctgtggggatggtgatgggaggttaagacaccaaaggtctcaccctgtatctgtccccagtccttctgtactctgaaatacttggtttcccagtgtgtccaattaagaaaacgagttttttgaggtttttggagtttctcttgagacagggtcttgctctgtcacccaggctggagtacagtggtacgatcaaggctcactgcagccttaacctccctggctcaatcaatcctcccacctaaacctcttatagctgggactacaggcacaccccaccatgcctggctaattttttaattaatgatagttatttttaataattcaagaaaagagctcaagatgctactagaaaacatttgaaaaaaagactgggatcagcccacctactggggatgaagatgctgaatccagctacatccaccagcctcctctcctgaaggcacaagctcagccaggctgacttcaccagctgagcacccgggggcagctggggtagtctgagaaggcggagggctcgctcatagtccatgccttcatccaccacaatgtgagtgacacctgggccctgggcagggcatagctggccgccatgctgaacaatctgcttctcaaagagttctgcccgggctcgtccaatgccagtgcgcacaacatgggcccgaagggagctcagccactctgtggaaggaacatccagatgactactgttgtaactttttaatttttatctgccaccccctggccacgacataacttctaacatgatctgaatgacgtgttcacagtcccctaccctgaaaataagcatttcccttccatccagacagctttccttctacatatagcaaattttctcacaggccagcacttgaatgtaagggacaaggattttcatacgtcctgttccttggtgcaatctagaagtgtctggcacattgtaagtaacctgtaaatatttgtttaatgaatgcctcctcccttcttactttgttttttgtttgtttgttttgttttcttttgttttgtttttgtttggagacagtctcactctgtcgcccaggctggagtacagtggcatcgtcttggctcactgcaacctccatctcccgagttcaagcgattctcatgcctcagcctcccgagtagctgggattaccggcgtgtgccaccatgcctggctaattttttgtatttttagtagagacagggtttcgccatgttgcccaagctggtctcgaactcctgagcacaggtgatctgcctgcctcggcctcccaaagtgctgagattacaggcaagagccaccgcgcccagcctctctccatactttgaatcctttatcatttattctttcaacaaagcgcgtttcttgcccttacagtctgacagacccgacaaccctgcctccaaagcctctgccatttatttgccaatttggctgcaaaacaactaacaacaagcctgggtaatggaggggggtttctgtcccagtcctcagggcaaaaattatactggtcattccctgagggcccagggagtcttttctgatggatagaggtcttcgggtagaaaagaaggtaacacagcaaatagcctgtccaagacccaggaccaagcttagcacaaggtagatacaaacagacctgcaggccctggacaggcagagtcagctccaatatctgattctggacataaacaacgtagggctgaagcacatgaaggctgtgggttcaagcacacgagggttctgagactgggtcagctcaccttctgcttcttctccctcttccctcctaggaatctttgcaagtacttttgatgatgcatcagcatgaattttctgccgcttgggaaatgccttcaagatacccctgggatccattgaagtatggctggatcccggcctattggagcgttggtcagggctgctgcacgtggaaatccagaattgaggccctccaacccctttgcctatggaggtagggtctttcctgaccaggctttgggggtagcagcccagtttggggaagcgggtcgggggagggggtctcttcaaacccggttaaacttcagtggtttagcctagcttcacactccccagcctttcgaagttggagtattacgggaaatgaggggaaggctggtgccatcgggggtacttttgaggagtaggaaacgacaccattcctcagaggggttgcgctaaagattcagcacagccctgctgcggcccacttcgaagggctttaccaaatgggatgctgggctaggaaatggagctttaggggatggagcggagcctggggaggacctgcacataaaccccacatactatttctctacctccaacacagactcgcagaggaaggaggaggactttcgggggtgagtgggaacgccctgcacctgtcctggtctcagcctctcgacatgggggtgctcagcgccgcagctgcggggagatggggcacggccgcagcaggtgtggggagccctccgggaatggaggagtctcgcagctgcgggtgaagtcccgggcaggtgcggtgtactcgccgtgtacgcagctggcgcaggccagggaatcccagctcggggctagaagaaagctggagtgcccgaccccggccccaagagtctctccaacccccagagtcggtccccgggtggggtcgactactggccaagctagtcacccgggggtgggcaggaatagaccacttaccagcagagccaatgagagcggacgaaggggggaaggagggcaaatggccagaatagcttccgagtcagccggaagtgaccctctggaacggttgccatggcagcggctgggcgtgctgcttagcaggggaaagatggcggtgacgggctggttggagagtctgcggacagcccagaagactgcgctgctgcaggacggtaactcgagggtccccacgggctccttcgtttttttccctcagggtccggccctccgggaagggcctcagggcctgggtcggcagagctggaagggtctcggcggtcagccgggccaggtcctgcatttgcagatgaggagactgaggttcacagagatgacatgactggaacacatgtctccggacaccccttagattcctctacaccatctcgctccgctctgatttctgttgctaatatagtaatttcttttacattcattatctcatttgctcctcaccactgtcctgagaggctaattttcaccccgttttacagaagaggaaactgaaatccaagaatgttttagactttagagaggagagaggcctgggctctagttccgactgtgccattaattcaccacgggcgcttcagtcggctcctttacttgtttgggcctcactttcctcatctataaaatgaagtggatggactaccattgttatctctgaggtcctttccagctgtaatatttttgttaagtgaacttctaaatattttctgtgtctttaggggagctagagcaagaaccaagggctgtgcctggaagaagtgggcacaggggcatggatacctaacttttccccaccctaggattggccgatgccggcccctttgtgcacttgggtcctttctggacccactgggtagccaggatgaattgcgtctgaagttcctgaggctttcaagataacaactggtgactcatgttcacaggcaggggccaatcagggaagcctggagtttgtggaaattaaaatcatttactcgttcgtgcaacatttaggaagacttttactatgtgccaagctctaaactagaacagaaagaaaaagatatgttgtcccaggactcagagtggttgggaaaaacatgtacttaaataataagaagcgttaaatagaggttgtagtcttgtataaaatggtaggaaagagtgaaggtgtaagtgacatctctttggaggaagacccaacagaagtgatgatgtttctgggtcctaaagaattaataaggtcaggcacagtggctcacgcccgtaattccagcactctgggaggccaaagtgggcggatcatttgagctcaggagttcgagaccagcttgggcaacatggccaaacctcatctctacaaaaaatacggaaattatggccggatgtggtggttcacgcctgtaatcccagcatgttgggaggccgagtgggcggatcccttgaggccaggagttcgagaccagcctagccaacatgatgaaaccaccccatcgctactaaaaatacaaaaaaattagccaggtgtggtggtgcgcacccgtaattccagctactctggaggctgaggcaggagaatcgcttgaacccgggagatggaggttgcagtgaactgagatcacaccactgcattccagcctgggtgacagagtgagtgagactgtgtctcagacaaaaaaataaataagccgtgcatcatgggcacatgccctgtannnnnnnnnnnnnnnnnnnnccagcttgggcgacagagcgagaccctgtctcaaaaaaactggaaaaaaaaaaaaaaaaagaattaataggcgtttgctgagtgaagaagaggggatagctattcaaagaacaactcacatataaggaccctatgtgaaggtgtgaaggtacgtgcctgattactagaggaataacaaaatgtttagtaatgttaaagcagtcactcagtcagaacaaaccacctataactatgtcaggtactattctaggtgccaggatggaagcgagaataaaaaggtcccttttctcaaggagcaatgaggggaagttgtggaaaatgaagagagatgacagataagttgggacatattgtgatagatctcttatgccttgctaaagatttaggacattttctcataggacagtggtttttgtttttattgtggtaataaatacataacagaatttagcattttaatcatttttaagtgtacagttctgtggcattaagtacattcacattgttgtgcaactatcaccaccatcttcagaactttttaatctttctcaacggaaattctttttttttttttttttttagagacagggtcttgctctgtcacccaggctgtggggtacgatcatagctcactgcagccttgaactcctaggctcatgtagtcctcccacctcagcctcttgaatagctgggactacaggcatgtgccactacactcagctcaagtgaaattctgtacccaccaaatgccaactcctcattccctcctcctcccatcccctggcaaccaccattctactttctgtctatgaatttgactgctctaggaacctcgtctaagtggaatcatacaatatttgtctttctgtaactggtgtatttcacttagtgtaacgcttcaaggttcatccatgttgccacagttggatacttccagctgtgccattaattcaccacaggatctctagttggcccctttacttgtttggatcctttccagctgtaatatcgttcataaagtaaacctctaaatgttccctgtgtttttaggggagatagagcaaggaccaagggctgtgcctggaagaggtgggcacagaggtatggatattgtagcatgtgtcaaaattttgctcctttttaaggctgagtgatatccattgtatgtctacactgcattctgtttatttattcatctgttgatggacacctgggttgcttccaccttttgggtattgtggataatgctgctctgaacatgagtatacaaatatccacttgagtccctgctttcactgtttttggtcacagaagtttttaaacaaatattttatcagccaggattttgttaagttcttttgttagtagcatcacaaaatgatattgttaagattccaccctatccccagactgaaaaacaactcagtattgcatatgtggttaagccttgtcaaacctgcagatttacccctgggtgtgtaggaggggtgtggggagtaggggggaggttactcccttccaccaagaatcatggctattgatatcttgggctggataatgagactccattttacttttgtttttttaagaaataattacattcattgtggaaatatgaaaaataaagaagtcaaatataatattaccacccagataatcataatttacttttttttttgagacaagtttcactcttgttgcccaaactggagtgcaatggcgcaatctcggcgcactgcaacctttgcctgctgggttcaagcgattctcctatctcagtctcctgagtagctgggattataggcgcccgccaccaagcccggctaattttttttttaatttttagtagagacagggtttcaccatgttaaccaggctggtctcaaactccagaccttaggtgatccgcctgcatcggcttcccaaagggctgagattacaggcgtgagccgcctcgcccagcccataatttatatttttatacataaacttctatattatttcatgcatacactcacagttatttttcttttacaaaaatatactaatatacttaataatttatatatacatttatttctagaataaatatactattaaaacaaagtatagataagtatcgaataatcattgggtaagggaagatgctctgagtgcaacttctaaggcagtaaccacaaagaaagaaaatatatagttggctttataaaaactaaacacctgtgttgggtacctgtaatcccagctactggggaaactgaggcaggaagctcacttgaggccagaagtttgaggctgtagtgtgctataatcatgcctgtgaatagccactgcactccagcctagggaacatagccagacactcttaaaaaacaaaaacacttgtttgggaaaacccactttaaacaaagttaagggccaggcgtggtggctcacacctgtattctcaacactttgagaggccaaggcaggaggatcacttgagctcaggagtttgagatcagtctgggtaacatagtaagaccccatctctacaaagaaatttaaaaattagctgggcatggtggtgtgcaaccatggtcccagctactcgggagtctgaggtggaggatcacttgagcccaggaggcagaggttgcagtgagccgagatcacaccactgcactccagccttggcaacagagcaagacactctaaaaaaaagcctcagttggccgggcgtggtggctcatgcctgtaatcccagccctttgggaggctgagatgggcagatcacgagctcaggagattgaaaccatcctagccaaaatggtgaagccctgtgtctactaaaaatacaaaaattagctgggtgtggtagcattcacctgtagtcccagctactcaggaggctgaggcaggagaattgcttaaacccgggaggcagaggttgcagtgagccgagatcacaccactgcactccagcctggcgacagagcgagactctgtcaaaaaaaaaaaccctcacttttcctcatctatgaaatacaggtaatgaaaacacataggattattgtgagaattaaatttgataagacatgtgaaatgcctggatttagtaagcgctgcatcctgcctggactcaaggctggatgccaaggggagaagatggtcaggcaagaccccctcagctcctcccaggcagtaccttggatcccgctcctgacaggagagccctttctaatgcctgtgagccatccaaatgattaagggtggtattacctagggctctgctagaggccctgcaaatttaggggtgagtttatgcagaatacagattaggaatggctcaagggaactgtatcccagagaagtgaattggacaggaaaaaggcaccttggggctcttattcatcaagcatacatagggtacttgtctactggatgttagtgctctgttactagttttactgaggagtctgcctgtatctacttccctacctataaaaagaaaggggaaattacatagccactcttaagcaaatgctccaggggtagaggaattgggctaggagactcccttagtttcttcttcttctttttttttagacagagtctcactctgttgcccaggctggagtgcagtggcacaatctcagctcactgaaacctccgcctcccgggttcaagcaattctcctgcctcagactcctgagtagctgggactacaggcacctaccaccatgcccagctaacttttttgtatttttagtagagatggggtttcaccatgttggccaggctggtcttgaactcctggcctcccttagtttcttctgttctttcaacggatagtgcatcagtgtttattcatcctttcaatcagtatttagttgagctcctagtatatgccaggagccacacttggtctttaggaaaccatagcatggggataaaacccctcctatctagtagaagagataggcagtaatcaaagagtcacataaaaagatgtaaaatcataaccaaattaagtgccatgaagaaaatacatggggacttaacattgtgttactgtgtgataggaatggcctggagatatgcagaagaaggcagggcactggcatggctagagggagtgcttggtcaggaaacccaattcaatgtcctgaacacatagagagataaatacgatgtcattcatgggaagacaaatgcttttaaaagtatcatggtatgtagtaaatgctccactatggatacgagtaaaacattagggaggcacacatgaggatgtgattaatcctaccaaagtggctggaggtgatagtggaggaagacttcccagtggaagtgacatttgagctggattttgaagggcaaagaagagttccacagataggaaaaaatatggagctgttgctggtagaggaaacagcagggcaaagatgttcaaggaaagcttcagaaagggagagagtctcaggacacgttttaaagtaatggtgggtggtggttggcaaggagtttggggaggtcctggctgggttcctcagtactcccaaggctggcactgtttcccaggtaggccccttgatctgcaagggacagggcaaggggagactttgaggtaaggcattctctgttttgtgcatagggagaaggaaggttcactatttattcccagacggcaaggaaatggctgaagaatatgacgagaagacgagtgaactacttggtaagtgacagaggctcccagtgggcctttagtaatacttggggctgacataagcacaatgaacactcctagccttaggcttgaggtaggagcccagatcaaatgtagaggctgggagagacggaagccctcgagacaacaacgttcctgagcataatctgggcaccaaaagtggaatgcgagtccttttgaccagtaaaattcatccccacccctcaccccagacaaatgagagagggagtaattctaagatgtagagaaacagttgggaaaaaactttacagaggaggtggtattggaagtgagccttgtaggtttaggagggataagggcagactttcacaatttgtttttccttgtttttttgtttgtttgttttgttttctaaagccacaccaggagcaagcgagtatcagaggcagagcttctgagcttgcctcaaaggcaacactataaaatatggtccttattttgaagaacatctcagtcaaagagggtcaaaacagtgattttgcagcgtggtcactttcattcctgcagcgcctttcctctaagaacaggctcatgggtaggggctccagctcagatttctgggaattatttgatttgtccactctgttcccaggtgtgcacatcagcattaaccagcttcccagagctaggtggctggctctttgacccagggcccaaggctgtcagcagtgggagttggtctctttattaagttccatctgaaatgctaagaccaatgatggaatcacaggctggtttattttcttgtcattattcttggctttaatttcttcctgggcctgatcgacaggtagtattggtgagggaatttctttttccttttttctgacagctcataaatgtctagaaccgacaacatggattacacgggcttgcattccctcagtctccagtcttaaaatgtttgtcctgcgcatgttcagtcgcacagtgaagtgttgatccctccttattatgagctgcttgggctccagtcccagttggtttagtctggtgctattaaaaatcttgatgtgtttagcatatgacactgattcggtggaaaccaatacagtagtaatatcctcacaatgcattgtaatttatagtgctcccaggggatgacagccttggaatgcctaacaggggagaacttatgaaagcagaggtcacgtggactagccaccaccataaccaggccagagaatagccgcagctcctcactcccagccccccgtgccacttctctactcctccacacagagcaaataaaacagctatagctgctgcggctgtaaaaacaaacaaataaaacccaggcctctttgttgtgcttggatatgaaactgaaattaaaaacaagtccaggtttcttcatttgtagcaccatgtgccctgatatcccttattaacctgtcacttctcctagtggcaggtggggaatagaccatggcttccaaactcctctttcttaaaagcagaaatggagaagactgttcacaggagaacactgtttggctaaagttgacctaataatgatattaatagcgtgactcttactgggcaccatgctaagtgctctacgtgaattacctcatttactcgtcctcgttaaagccctatgaggtagatactcttgtctccattttacatttggaaaaaatggaagctcaaagaggttaagcaccttgttgagaattatgtagctagtttctaagccaggatttaagcctagttctgtccaattaagagcccatgctttagtcctcaacaacatagtgctgggagttgagaacacttaaatccaactttcttttcttcttactgtttttctttccccagaaaggcctgagtgtggactgatgggcagacaggaggacctcacttgagccactgggcccaggtctagaacagcagatctttttcttactcttcttcctatccaccactgctgccctggcaaaatactctccattattaatttttaagtataaataatcccaggggttgagctggcttttgcttgtgcattctatgaagtaaagtagggacatggtttttgtggcaataaataggaatagtttccatttttctagctaagtatacaaatttgataattagccaaaccagttttctgttagaaaaattcaaagtaatttacagaggaagaattgccaataggtgtgcgtcagtctgggacagagttcctcccgtcggtgttaataagcatgttagtgtcctgtttttttcctaccctctcagtgctattcattcccaccccccacaatgattgctgcatgtattcatagaggaaaaaactgaaggccccacaacaatgatcggaacatcaaaccagcctgagaagaacacagcatgtccaagggggctgaggctgaagggcaggccatcccccagcgattacattcggattaccgacttaatctgctttggtatttgaccgccagcctaaccaccccaggctgcatttggaggatattgagcactttcatccccaagcacttcactggctttataaatgacccactcgattcccttcggcctcctctgggatgggacatggcagctgtttaattgccacatagcaatgttgcagtgttttaaggcagaaaagaagaatcctgcatccagttgaagctgcagggaacatttagggaaggggaatgtaattatccacattggaagtgggccagggtttggagctttggggaaagaggcctttaggacttctactttccagcccacctgaaagatggggcctcctttcagcagtctgggacatcagcctgcttcctgctgatttaggaaaaagcccccaggcgccacctcctttatatattccccatcagactcttcaccggggtggaaagtctcttttccaaggtctggctggggctcagctgggaagatatgacagcgtcccgggaagctgcctcacaccagtttgggtttaacatataatcaaatcagagtgacagcagatggaaacagtcttctgttgccgcaggagccgtccttgagttcagaaacaaagacgggggcaagaaagacaagacaaagtgtgcatttgtacatgtgtgttcacacccatgcacttgtgcataggaaaaataagaaggacttccccaaaatcttttattgggtcttatctctagagggaatgggaaaggagactttcttctacattctaacaaagaatttaattctcaaggtgtttaaacaaaaaataaaggtgaagcagccagaggtgtcaagttccctgagtggtttttaaggtcagaagtaaggaaatcagcagctgactttcttccttctttgagtacttcttgggaagttttctgtgtaaaactcaaaattttttggagtaaaagtgcacagaaaaccctggggtggttgtcgtccctccaggccaccttggtgcattattatgcattaggacacccattttagcaaggcccatgacttacaggggcacctcacttatccagccctaggtcgtgaggtagtcctcataatttactttttcagataatcaaagcttaccctttaaaggccaaatataaaaaataaattgagctacttaaaaaaaaacagaaacctttcaaaatattacatgtgcttattgaacactttcagaataaagttttattaataattcaaattctggatttggagttaggagacctggagtttagccgtggcatttgtaagattgtctccttgagcctcagtaattcttcatagtctgtttcctagagagtagtggcaagggttgaaagagagcagtcagggaaaaaatgctatttctcattttaaaaatacagacattgggtagatgctttcttttttttttttttttttttttttttttttgagacggagtttcactcttgttgcccaggctggagtgcaatggcacaatctcagctcaccacagcctccacctcccaggttcaagcgattctcctgcctcagcctccccagtagctgggactacaggcgtgtgccaccacacccagctaatgttttatttttagtagagacggggtttctccatgttggccaggctggtctcgaactccctcaggtgatccgcccgccttggcctcccaaagtgctgggattacaggcatgagccaccacgcccggcctggagtagatgctttctaaaggaacttccacctttaaaatctgtgatggttgtgttctattataaagtggcaccattggagtctaagggtgcttgtttgcccttacactaagtggtcccaagtgtttatgtggttctgacactgccgtccagtgtgagttgtccccgataccattgtcaatatgcctgagaaaaaaagtaatttcctgccttattctacacacagcattttatacctagtctgagcgagaatctgagagtgatctttcctatagtatagagtagggtacatggatcttttcacaataagctgctgctcggaggcatttgtcacttctgagtttgcaactgtgtcagaggcccccagaaggctgcttccagtgaagtgaggtattaacactgaatagatttggatatactcctggtcacagtccgttcacttaagagagaagtatttgtgggggaaaaaagttgcctataaagcatatttccaagttttactcttccttattaattttcattataaacttggaaatgtgtttctagggagaatttttggccctaagaggtaataaaatcacactgcagaatgcagcagaccttataaaagcacatatttaagggaaaattctaattttacagcacacttttgtgttcagcttgtgtgccttacttataccggtgagggcgtttggatttgacacagctgctcaaaaggtctaaagtaaaaccgccggctgcctagtgctgagaacctgactgtagctctcaactcctacctggaaaaagacacaaacagaaacaactgtaactgagtactgtgcactttttgagttgtttagctccttaaacagctacagaggctgctggtctttagcaccagctgggctcctcaggctggaggataccatagtgggcagccccggattccaaatgcagcaggaagggaaaggaactgggggataggaggtcatggctcagaaaagatccccctgcagtgatggaccgcatggttcctgaaaatgaaaatctcagcaggggttttcaggtagtccattcaactagtttcttgatttataattttcataatatatgtgccttaaaatcttatgcaagcatctgggttatgaaacaaggtaaaatagagatggttatttgcattctagaaggattcccttttacaaaaaattcacattagatcttttataaaccgtgcatttaaaatatggcatgtgcctacgattttgtttaaatgcagctttggagcgtttttttgtttttgcttttttctttttttttaagcaaggtatacctgaaaagagtgaatttctatatttggactttctgaatcatgatacagacctgccgaacagctttcaccctcttaattattttttcctctgcatgtttttgagggaaaaagtgtgcttcaactcctttttgggatccaaattttctccattaccagaaacaacccttttcctaatcttcacatcttctccttgcttgaagccacacctgagggtttcttgactccacttggctcttctcagagcttcattccagttccttttgcctgagcacccatgagatgcgctttgagggttgtctaatgttgaaatgctctactgaaatttcagaagttgtgaggtccctccttagattaacaaagctgagagtaaaggcccaacactcccactttcatcttgtgctagttacctagtgtggtgccggtgattcagcagaaaagagcagagaccctctcttcactctcatcctgatgcttgcttctcatcccgatgcttgcttctctccccagtgagaaagtggcgtgtgaaaagtgccctgggagccatgggccagtggcagcttgaagtaggagacccagcgcccctaggagcagggaacctggggcctgaactcatcaaggaaagcaatgccaatgtacgtccatctgtccaggtgtcttgcacggactgaggtgggggtgggctgtgggctgctggctcttgagggcagggaccatgtcttgttcacctcctcgcctccagtgtgccacctggacacagcactctataaatgtttgtttgaatgaatacagacattttggcttgatcgtcccagggcgggggctcagggcctggagtgctgtagcaatagcagcgtcagaggggagcagtggagaagagctgagggtcttgttgtgccccggggtagcgctctgatgagggtggagccttcccttccccaggaacagtcctcgagttggatttgccttctgcagcctatcttcatgcgcaaggacaccaagatgagtttccagtggcggattcgaaacctcccctatcctaaggatgtctatagtgtctctgtggaccagaaggagcgctgcatcattgtcagaannnnnnnnnnnnnnnnnnnnccggcctgaataatgtaatcagctccatcggggaagagaaacttgaatgagtatctagtatagtacctggcatagataggggctcagtaaatatttgttgaatgaatgagatgatgagggaaatcacaggaccattaacttgtggtctcaggtggttctgctgaaaggttattatgaccttggtctcctgactggagccaggccttggtaagggtggcctggtgacatcactgtcagagctggcagggagccatagcttggaaggcacccctgtctgaagtgggagtgacagtcctttaaagcagtacttgacagcagtttaaagcagactgggcagcagtaaacctaatccctccccagactgacagtggggcagatgcttgggccgcttggaagtctcttgcataatgcttcaaaaggggtactcaacttccctttgtggtcccctagaggggaggcaaactgcaggggttgaaaggacagaaggtggccacagtgcatttccattttggaaatgcattgatctcatttaggtttctggagccctgactgatcacaggagaacaatgccctgtgtgaggcctgaagggaatgaccctgaaatgaatcaatcttgacctgggctagagagaatacagtctagggacaactcccacaaaatagatttgggcattgagatgggaggttttataagttacctgtctgcaagctgtgaagccattcaacatgcctcatggggatgcccccacccatctcttgctttacatgcagtaatggggacacagctccttgtgcatctcctcaggtgatgtggtgccagtctccccttccatctccctcaggctcacgaggcccacagggaagcagggtagctcccagactcccccatcgcagccctgggtgctgccatcctcttgtgacccccatatcccattgctttggcagggttaagaggacaggggaaagggtggagatggatgaattaatttcaggattattgctgtacatgcagccagcagcccctgcagtgggccttgtctataaatataaagtcataataataagggtttgtgtttataaagcactttgaagccctcagataagaggcagtttattcccgttattgttctcatcattaacaggagtcactgcctaaagtggaatttagcaatttcagacaacagagaaattgcctgtaggagaacaaactccatgcttcagcaagcattccttggtggaagaggccttgggtccaaactgggaacaaaagtgcttctgatagcacttgaatctgcagcccagcactttgtgaagctggctgctgcctcttttttgtcccccagaggtcactgtcgaatacagatatcagacagaaatgtgattaccagggagtgaggaaagaggctagctagctcaccaaaaaattcatctgccagcatatcctctgggtcccatctcctgcgcacatccagccataggtggcgctgttggccaggagctccatggctggaggcccaggctagctctcaaggcaagcaggggttgttggacatttttgaaatgatgggtgaggccaggtgggatgggagtgatgcccctggaggggcagggctgagggttggattcccatagaggacagaggagtgtttcagggcccactttggaacccacactgagcctctggtccagtgtcccagcctggctcatccctgccctcctcaggtctctctgttgggaggtaacctagaggccgctgaacccttagccagatcgttcccgaacctagtggcatttttaccttctacctggaagaatgtattttatacctttactcccattaattatatnnnnnnnnnnnnnnnnnnnncattgcactccagcctgggtgacagagtgaggactccatctcaaaaaaaaaaaaagagatggagtcttgccctattgcccaggctagagtccacttcttgcaatcatagctcactgtagctttgaactcctgggctcaagggatcctcccgcctcatcctcctgagaagctgggactataggcgcataccacccaatctggccaagtttaaacaattttttatagcgttgagggtctctccattttgcccaagctgctctcaaaatcctgggctcaagtgatcctcctgccttggcctcctgaagtgctgagattacaagcatgagccaccacacccagaccagggtggccattctggcaggtggggaagtgtggcctctggccagaagccaaaaactcaatggctactcccttccacagtgtttagctttttaaggatatagtacatttaaaatctgttttctgatcatcattctgtcaggaggtggacaggatccatacttttattcttgtgttatagatgattatataaatgtatatataaagtcagcatgatgaaccagcttgctgaaagttagtgactgtctctcctgatactcagacatctgcacttcagaaatgcacatcatggcatttctctctgatttgacctcttccttcacctggaggttccataacctgccccagttctaatattctggaatgtggttactaaccaaagccagagtttctttacccatacttgccttgtctctgaagagctgggttggtgactttacttgaaggaattgattgcagtgtatcatgtccttggcctcacatattagtgagggatgaatcagggaaggaaaaaagtgcttttccaggatcccagtgttggaccatctattcctgataacgtttgtgcagaaagagggctcctagcctcagcctggaagttggccgctgtaggtggaatgagccagggtgcaggagtgagaagttgttgggttaaatctggcctctgccactgttagctgtagaatttaggcaaggtttcctcatctatcagagaagactcacagctacttcacagattttggggaatttgatgaaatcatatatgtacaggccagcacaacggctggcctgaagcaggtcctcaacagttctttggaaattggaatctgaggagagcttggctgatttgacatcggtgatagtaacactgtgggaggtgttaataggcttcactagaaaaaaggattctgtggttaaataaatttaagaaactctggattaaacaggcttctctttggtggggccgagagcctttagtatgtgtgtgtgattgtgactgtctagcagggggcgactgtgggtgggggtgccaagtttgcccagagccttgatgtttaagaagatttgcttgctgcttttctaaaggcggactggttggaggcttctctggacccctctggccatgcggtgtgcaggtgtgcatggcaccccctctgaggtatgtgaggcatgacccaagtgattgtccacagcagccctgctcctgccttcagcctccagagtctctctccctctgagggcctggcctctggtgcccttttgggttgaaaggctggattggggaggggatacagtagagagtggtgggaggcaatagatcattactgaaatagtcaaaatggaggagtcgtctgtcaaacagggagaagacaggtacagagttggcctgttctgggccctttgacattgacttcaagttcatctagtgcagctcttttattcgaagaaggaatgtggaaactgaggcccagaaattaagtgacctgtccggggtcacaaggcagggccaggagttctgctacaagcctttacttccacatacatcttttgaagacttttgacattcagaaaggaaggccactgatgtgttggagagagtacccaggggacccgcagagtgttcggaccccaggggagacaacctgttcattgttgaacatccccacctcccacctcaatatctgccccatcattggacaaatgcaaataatctagactatggcgggctattactttgtggtgagaatgtggagacatggaggtgtcaggagatttggggaattctcactttaatacgggcttctctgtttaccagctttgtgagttgggcaagatatctaacttttctgggcctcagtttccttttgtttaaaagtggataatagaagtaaccaacctgagagagttgttttgacaattaaatgtgtttagaacctggcacagaataagctcttaaaatgtcatctttcattgtatggctgaaatagaacattgaagggaggtgggaatgggggagagcggggcatctgcaggaagccagggaactatcctgctgtaagggttcatcttttagcagaaacaaaacaaggtctgatcagcagggatatggccttgttcctttttttgagattgagtctggctctgttgcccaggctggagtgcagtggcacgatcttggctcactgcaacctccgccccctgggttcaagtgactctcctgcctcagcctcccaagtagctaggactacaggtgctgctaccacgcctggctaagttttgtgcttttagtagagacagggtttcaccatgttggccaggctggtcttgaactcctggcctcaagtgatctgcctacctcggcctcccaaaatgctgggattacagaagtgagccactgcatctggaggccttgtttcttcttcatccttttcttttaattttttgtagagacagggtctcgctatgttgcccaggctggtcttgaactcctggcctcaagtgatcctcccacctcagcctcccaaagtgctgggattacaggcatgagtcaccaggcccgccctcttcttcatccttaaatccccagctcacagctcaaggtctgggacacagttgatgcccaataaatgtttgctgcctacctacagctgcctgaggctgaacgttatgacccttccagaagcacagtgggtctctctcttgtccaggtgctggtgagaaagtcaagtacagtacctatcatggaaaaaccctatgtctgggggaatgggtgtgagaagggggtgggcttccccaggaggagaaaaggcagatgctccctactcccttgagcctatcgggagcttctaagaagttggttaacctcgaccaataaactaaatctattacaagagactcaaaaccaagctgagcctccacctgctctgcctccattcctcttgcctggtggtaggagtagttcaaggaaagcaggtgcaagctatgcacctaaagttccctctgatcctgtccttgctgttgtggccaagccctgggattcattttccggtcccactgccccagcctgggggaatggttctgctgggctgcttccctcctggttctgctttttgtgtatatttgcagggaagatgttaacacttcctaacaagtctttgtgttcatctaatctctgctgtttaacctttgactctcccctattatcagtgtctgccacctttgctggccagaccaaaggccccaggaagagccctcagcctgagctggctaggaagaggatgaggcaggcattccatccccggtttgcaggcagatggatcgcctttccctggggcagagctttggaaaataaagcaacttgcaatgccattaggatcccccagcccccactccttttgaactgtcagcctttaagtaaacattcttttcctgccatgggtcccagtaccttggtggggagtggggaacctgggaggagaggggccccgagagcctctgttgaacggagggatttgggcagggaggacgggggcagaagtgctgcattgatgtcaactctctgagtccccagggcataggggcttttgaagtggactcagggtagctgtcaccacaaggaccaggcccctctgaagtactaaaagccccatcctccccaggcctctcacttgagtttgtttgtacctgcctgaggtgtttcccttcacagcccatacaacctctgcagcagaaagtgatgccttgcccaagtgacaggtctagcagcccctggccagagcctaagccacatttccaccaaggaaaatgccaaattggtgtactgttagagatgaggaggccattcattgtgctttggtgtagtaaggatcagaccaaggacaaggaatcttactctaatcttgactcccatccctaccgacaactggccgtgaaacaaggcaagatatttcatctctctgagcccgagttcccttttaggtaaggggggtcaaatttcctgcaaagtctagttatacacattacagactgggtgttgccatctgttctatttttttttttaattaaaaggcatcattaatcgctgaaccggcacctgcagatgataaggaccatgtgtgatatgtaaaaatggaggagtagggacttggggccagccaagtagtccagaggtccagcttccgtgatgagtaacatggttcgtcctctcaaagagatttctcctagtagatatacttttccctctggcctacaaggccaggctaacaaggccttgaaaggccccaaaagaggaagaggtagttgaggccttcagtggacctcccatgtaaatggtaacagtagggccccagctttgggagacagatctgaatgtccttactctgtcctttgttagaacacgtcccatttttctggtgtctccatgaggctttgggggtagaggagtcccaagctgcttgagctatttgtgtgttccaggcttcttctgcctgtctttgggagacccagctctgagatgtgagtcactacaacccctggtctaatcacagaattataactaggttctgctcttctgccactggactggacataaggcttgcattctatgctttccagggccactgagctctgaaatactggtgttctaactggtttcccttctccctctctgcgtgtgtggaaggtgtggaagaactaggtagaagctaggcagcagagggcctgacgcctggctgttgggtcaccttgccgagtgccccaatggcctctcggtgtccccacaggtactacaagaagttctccattcctgatctagatagacaccagctacctctggatgacgccttgctgagctttgcccacgccaactgcaccctgatcatctctgtaagattcacccagacttcttggacactgcatcagggagagtcttcctctttccctgcccacttcccatcccataagagtcctcagttctagccccaagccctagggtatgcttgtgggagaataggcatctctaattcagcatgggggagagcagggagggggctcaggaaggagcctgaccatataattcacagctagaagagggtagagggtgaaagggaagcggtggaaattgctgaacttgggttcttctggtccaaggtctgctcctactcaggcacatgaccttgagcaaatcattcaatcctacaggcctcaattttctcgtgcaaataaggggatcagaaggagaaggggccccaagtgtgtgtggaaggagatgggacagtgactgaattattttcttattcctggctgcatccacagtaccagaagccaaaggaggttgtggtggccgagtctgagctacagaaggaactaaagaaggtgaagacagcccacagcaacgatggggactgcaagacccagtagttggcccctgagccttatacctccaccacagggggtgccgtgagacttcaaggcttggcccttcttgaccacggcagcctcctgtcttctaggagctatcaagggtctctaagaactgggcatggggcactcctagccagtgagtcatggtcatatttcctgagtaaagtcattctgagttacttactgcacagggactgccctcttgttcccctctgtatgctgcctggccccagaccccactggcctccctcgggagggtgtgatgacattcctttctctatcccggagacctacaacataaagctttccacaaaaagggagaatagggtgggagcacatggccctagcagggcagggctggcctttccctgcaacctgtttacacaaactcagaggaagaccaggctggagggaccctgtgctaccgtagcttgcagaagtggctcagaggaaactcctgaagatgtgtgggcaagggaaaagttttaaaaatgcagaaaccggccaggcgcagtggctcacgtcttaatcccagcactttgggaggacgagacgggcggctcacctgaggtcaatagttcaagaccagcctggccaacatggtgaaaccctgtctctactaaaaacacaaaaattagccggccatggtggcgcatgcctgtaattccagctactcgggaggctgaggcaggagaatcgcttcaacctgggaggcggaggttgcagtgagccaagatcatgccactgcactctagcttgggcaacagagcaagactccgtctcaaaacaaaacaaaacaaaaaaacaaaaacaaaaaacaaaacagaaaccttggaagtagaacacaggatgttaaggcattgtgggtaaaaagccagaatcagggtcataattttgccaagggtgtgtgttggggtaggggtcaccacaggcaacaactgagcttccagcagcctgtaccctttccacagtcccctctccaaacccacaggtgaccctccataccccaaagggtaagggataggtcatcaatgggaactcttcctgaaaaaaagaaacctttgttctttgggacacagagccatgaggctggtcttgtcgtttcagcagcacatacaaccctgagcttgggtctgctgttcccttctcctggagcctgctaggactactcagccagtgaggaaccagatctgtgaacaatcaagctttatttttacaaaaatgaaaattgtagcatgtctcaacagccagcctgaggtagggctggctcagaactcactcagaactgctgggttccctttgctctttcttggtttcaaagcaaaaccaggccacagtgccccaggaatgaacccccagccccgagaggttggtcaagggtgaggtctggctggtgccaggaggctattggcagcctcacctttccttccaggaaggggcagaaaggaaccatctgggaaggtgggagcacctcacctcactctgtaggctgtcatggctctaataaggggtataggatgggcctctccaggccagatccttgctctggccaaacagggacgcaaggcccgggttcagccgcactctaaagcagcaggtcctgcctctccaacaggttcctgggagggactgcatctctggtaagctccaaagtcccaggagtcagaagcctctagtgcaaggtgcctgagcactggggtcacaggcccaggagcacagtggggcagtgaggaggagctatcactgcaccctccaggcaagagaagtccctgagtagctggtttccctggcccagaggcaggggtggccctgacggtcatgggttttgaaaatccaggacgtggaggttgtaagacagggcagcatagagatgcttggtggtgagacgcaggcagtacacagggctgctgaggggagtcgacgtcagcgggaaggcctggaagggagggcacaggaagtggtaagagctttccaagtgggacatgggtgtgccctaacccaggatccccaggcccaggggaagagggacgtgtgccattgtaggcttcttccaaccctttctaggcacgtccttggctacctcaccctctcccaaatgcagcccataatcatgagtcctggcatgctggagaagaggtgggcaggacacttacgtgcaggcaggccctttgacgccggtcccacagccgtacaacaccgtagtaggaggaacctgtggccagcaggtggttgccatctgtctgcaggcagtacagggtgctgtcgtggggctcctcccactccatgacacatttcctgtccaggaagaggagaagcagagggaggtttagggtaccctccacctctaccccagctttcttgggcctagagtggctgaggggagcgttaaggagccattccgggatggaagagaaagaagcctaaatcatcagattcatcaaaaaccgaacttcatgggagaaagcatcttctgtagagggctctcgccatggcccagacgacacagcagattatgcctgcacttctgttttcacatggccagctacttgtcactggactcaagaaaggttgaagtaacacaggcctcaagaaaggctgggagagaatattgagtgacagtaccctgacggctccagaggctctgggaaacgcctgcctttgccaaggcctgttggctatagccaagccactgggaccagggctgcccaaatgtaggaagtctagtgaccttgcaggcctcttccttcccagccctgacatggagtctctgtgccctctcccatgggccaacccaggactggaggaaggaccaggattggtgcagggcccccaccacctgtcctccctgcccagcacactcaccggacgctggtgcggaggtcccagtagcgaacataggtgtcatagccacaggacagcagtgtgaaaggggactcatacatgacatccagcaccccagcccctgggggaaagtcactgcccaagtgtgtcatcagctgcccactgggaagggaaggacggagtgagaggctgctccacgtgggtcatacacattcgttccaccttcagaaggcatcagaccttggggaaatgttctctttcctcagctagaatgagactcaaggaagggggctcagggaggagatgcccaattcctacccacctcacccctgccatgaggcctctgcaaccagtcccaggccccacccctcccccagcatcccagccctcagcagcccctccatcacacctgcgtgccggctgccacccacccagccactcctcctcaggacaatgaatgggggggcttgctgaaggggtcggcccccctcacattcacatgcacatgcacacacacacacacacttggttactttatacatcttgatcctgcaggtcatgcagttctgagctgcctgagtccaatgccttaattcctgcctgtaatctggggctcaaacctcattggggataaagaccacacaaagggagaaggggagtcccaggagatgttaaaacaagtaaacacctttgtgtctggggagaaaaatcgctgagaaagcagcttagcgagctgtccctggtgttcctggtctagctggcccccagcccggggctagcacgcctccgtgatcacagcccccagcctgtggggctccagcctgctccccccaccctcaccccacccgggggccgagagcagattactgagaacaatttctttgtgactgtgtaattccctccgtgaccgcggcagtgggcagaccctttgccctgatgccagacccctagcaactatgtaggggggcctcctgtccctagcaactacccctcaacatcaagtgcacccgctaatccctgcagccaggggatgggtgcaagtatggagtttccacagaatgactgggggaaatgaaggaaaaggggcgccctccaggcctgatgccttagcttcctttacccgtgagacgctgggctttccccatgccatgacaggagaaacaaggccgtggacacttcacagggatgtccaggtaagaggccctggcatggagtgaggggacttcatggctcaccagcccttttggcccaagtagcatgtcagcaaagggcttgaggcagacaaggcagccagccacatgtctgaatgcagatgtcagctctcgtccttccacctcactgagaccctgacccacaacctcccttctccccaacagagctgccatcttcccgaaggccgaaggaatcaaaggaggagactgggggttcctttctgccccttccacctttcccctttgagccctgggcagtgggccctggccaggagcactgctgctgccaggggggaattaatccccaaggcagcacccctgctaccagcctcctcagggaagttctggtcttcctctcagtagcccagagctgggcctgcggggagaagatggcaagcctctgtctgttggggggctcctgagagggatcaggcagaaggccttctccccagatcagcatcccttagagactgctaaccttggctcccagagaagccctgccttcccagatgggccaccagccaagattcagccaccctgggcaggccagagccctgtaggggagtcattctctctctttcacaggtatactgggtgcatgctgggtaggggctgtttggctccacagttctcctccctcttccagatttgggggccctgccccctccattagtgaggccttaaggaatgattgaggagctctcccctttaatctatagaagtaatttcatgtttgtttgaaatagaagatgaaaggcagtgggggttgggaggactgaagcccagcatggctctacctgcccaccctggtccctgggttcagagggaaggagagctgggcactcatggggctgcacagggacagcagtataaaaggcccacccagactgggctgccaagctgggcccctaccccagcattcatgccaccactggaaaatgtcatggccgtaagtatctgcagtcagaaatacaggacagcccaaggggtccctgccctcggggggagagccaagggcccagtgagcaccaggccctggaggccagcacaagtcctgagagcccctgctctgcccgcacagcctggcaggggctgagaagtttctttctgctgtgctgttctctggttctctaaaatggccacacacactttaaatgggccaatgaaaagatacaatttcttttgcccctgggcccaggaccctcaaggctctgttgtgtggtgcccgtgaggttaagttcagagcataaactgacacgccaggctctgggaaaaggcccatctcttctaatagcaacccagcagtgccacaggagccctgctggggctttgatttgggaaaacaaacagaaatggcaccgtgggcccttctcggcccccaccccaagacctatttaactagaaaactctagctcaactgctctggtagagggagagattggcccgacaatagccccaaactttgggggaaaaggggacaaaacaagctgtctgtctcctcatcccctcctcctgggctcttttcttactgcaagtgtgttcttataaaaacgattagattgcaatttgtataacgtggtgaccccccaaattcagacatttcaccccttttctctggaaagaatgttaagaatgcttctcggcctctcactgtggggggcgagaggggggtgcagagccttggctgttgcacagcttgtgtgggaacagggctgctgctcagagccccaggccaagacgggagcaagggccagcctgtcactatagagggccagacaaaaagtccattcccttccaactcccgtggacaaagcccaggcctccaggatccactaagggctgggggcctccacaccctagcctccgccgagtcaagtccagcaattctctctccacccagggaaacataaagacagatggggccatctgtgtgagcctgatgaatgagacacaggctgaggaggggcaacctgggggagacctgtttccttggctctgaccgtgtgcaggctgctcctgggaaccccactacctggacaagaagaagcaagcagagtgcggccacacccctgagaggtcagggccccctggcccaaaccatcctgctgcccaggtgactctactgcagctggagggagagaacttcctgccagtcagagaggagggacatttacatgaaatgctgacacccatcaccatctttgtgggggcagctaactgatggtaggggctggccctaaaaacctggatagcccgccagggacaggccctgagtgctaagctggactgggcacagggggcagtccctggcaccctacccctgcccaccaagtctgcagagctaggaagcctggtgccctgctgcacttctcccagcctccccaacagccgcctgtactagagcactcctgagtcaccacctcctccacctcccaacccacagctcagcatgtccgtggctcccacaccatttttcagtcatttttaacatactgaattcctgatgctgttctctggagaccctatgctccagagacctatgctctggagacccagatgctcattcctgcatctgtttgagtctgtgcctacctgtgcacctgtctgccatgtgctaccttgaaatgcaacaatggcttttggagagagagagaggagggaagggtgacaaaagagttgaccaccttccatctctgctgcctaggggacagatggcttgaaggtataagctgggcccaacatggctgcaaagagaatgggaggtttttcctcccttctatctccttccttcagtcgagcatcttctgtatacaaagcattgtgcttaatggaaactacagggagatgtaagctgtgacttgatcaagaagactttgtccctgccttcaaggagtattcaatccagggagagaaagaagtctgcaacatatatccaactaacaaatcaaaatgtgagttggtaggtaccacagagaacaacggaaagttctacaagggggcagctaagaaaagcaagcatttctggctgggggtgttgactgattcttcactgacagacagggctgtcataggcaatgacaagatagggagatggcccaggtggcaggagcagcaacaacaaaggtgcagcactagggcaaccaggctgttttggcggcagctggcaatctggtttggttggaggcttgggagtgtgctggcagggtctggcctccaggccacagtgggccttagggtgcacatccctcacctggcacaaactccgtgagtggcagacagccatgaggcttttgaacaaacagtgattgtcctagtccaggccccgattgtagataaggaaaccaagagtcacagacaaaaagtgacaatgtcgtatagcaaggaaaggcagagcctgaatccatgataaaggcagagctcctggaaatcccgtctggtagcagctttcaggatgacgggaacagagggaagtaagctgaagggcctgttgttctctttgtgtctgctggagccagatgagacggctgcttaggttacctggtggcagagtagccaccgcagcaacagctcacatatcctgagtccatactgtgtaccaggcaacgtgctgagtgttttactcgtatcagcccatttaatcctcacaacaggctttggaggtaagtttcttaaccccattttacagatgagaaaatgaaggcgcaggggtcacgcacctagtaaatcttagatctatatgcttcagggtggtggcactccccaccttcacagacaatgcagccactccatcactggcccctcaacatcctcaggacttgccccaagagttacccagggtcacctccagccctttccagctctttgcaggcttttccacctcacagatgcccagaggcttgccctctggtggaggtagtgagagaatcaaggggacagataggttctaaacattaacaatggaggagctatggaagcttcacttgcctcagccccatcaggtgagaaggaagggccttctcaagcatacagcctctcacatgcatgtgtctgtgtgcacacacccccagcacccacccacgcacatgtgttcagacacaatggctcaaaggccaggcagcccactttgtactgctaacaagggggccataattacaggaaggggcagccgcgtagataaaaggatacaaaatttcaacatctgttgccataaagggataaggagaagtgaaacgcaaagtatcagtttggtgtcagcaggcagagagccaatttcaaagagttcagggggacagaggagacaagaaagaaaaagttaaggggggagaaagaaagaaagaaattacagggttccttaaagaggtaaagaaaaaagagaatgaaaaaaagctatcagtaatgctttcaaaggagaagggaggtactttaaagaggggcagttcccgtaatcaccctgactgtgggccaggcccctgcacaaggtgggggcagagggccagggcagacaaagccacacctgggcaggatgggcactaacagtgctctcagagtggcccagcctgtgtgcaggacacggcttccttctccagacagaaggggctccagccaaatgtcccttaccatttattccaaatgtcattagatgccctgatactcactcatatcctgtgctcagttcaggataccaaggtcagttcccagctcagagggagagttctaccaggccacagccatggctgaccaggtggcccttatcagtgttccaacactgtgttcagtggaaagggccaccaactccagccacaggggtcaggatcaaggagagcttcgtggtggaggtgctgtttatattgaagagcgagcagggtttcattaggcacagagggggtattctgggcatggggttggcttgagcacaggctcagaggagaaaaatctagggcatctgttaggatgggtgagaagcctattctgcccctgcctttgttgagaaaaggggaacttgggagctttgaggtggaagtggaggtgtaacatgggaccagggatgaccctggcccaaaggggaaggggaatcaatgggatgtgtgcagggcttgccacacacacagggcagcacaggacctggccaaggactcaataccctaggagcagccaggtcaccaaccacctccccacccctttccccaccccacaatcccagtggggcttagggctgtgactgtggctggacctactatgacaccttcaggtctgggattaaagggctctccatcctgaagcccacctgcccacaggctatcaggggcccagctgtgccctgtgctcagggcaccagtgctaggtccatctcaaatgccccttggcagaaaaaaaaaacccacagcaagaggaagcccatggaggaagggggtatttgtgatgtcaggccagtcagacccacttgggccttccagctgccaggagctgggccccagacagtcaacacaaggcaccttccctggggcctagccaaggaagggtcctgctcaaacatagagaacacaagatgagccttgattcctccaaactccaggctcgggcaggatggctttggcatagttcctcagggcctgatgggatcacagggcctagctagggatacttcagtggttggtcaatcaagatgaagataccggaattcctggcacttgggagttagggaatgggcttgaagaccacctaccatcagaagcagaaatattctggcactttgaggttgggtgaaggactctttctcgtttagatagtaatcctctgtccttgggcctaaccccatggtacccagttccagaagacagaaaggcagaaaaagtccaggcgcagtggctcacacctgtaatcccagcactttgggaggccgaggcaggtggatcacgaggtcaggagatcgagaccatcctggctaagacggtgtaaaccctgtctctactaaaaatacaaaaaattagccaggcgcggtggcaggcacctgtagtcccagctactcgggaggctgaggcaggaggatggcgtgaacccgggaggcggagtttgcagtgagccgagatagcaccactgtactccaccctgggtaatagagcaagactctgtctcaaaaaaaaaaaaaaagaagaggaagggggaaggggacagccaagctccttgccatttaggcaacggctgtgtgcctgtggctgccttctgacctgtgtgctccagctagcaactgcccctccatccctgttccagcccagcctgcaaggagaacagtctctagtggtcttgatggaatgaggggctgagggaacaatggtgaccctgaaaggggtccagg

SEQ ID NO: 647 - DNA, 1443 bp, Homo sapiens
caggactggaacttctgaggttctccctctgagggggcccccagacctgtgctgccctctgtcaacctgctcacccagagatggagcttataccttcctgccgaagactgtcaaggaggcggctgaagataccccggtgggaccggccatctgggtgagtgatgagcacgtcgacatcaccacaggtcgcctttccccgtcggaatctttgcaagtacttttgatgatgcatcagcatgaattttctgccgcttgggaaatgccttcaagatacccctgggatccattgaagtatggctggatcccggcctattggagcgttggtcagggctgctgcacgtggaaatccagaattgaggccctccaacccctttgcctatggagcagagccaatgagagcggacgaaggggggaaggagggcaaatggccagaatagcttccgagtcagccggaagtgaccctctggaacggttgccatggcagcggctgggcgtgctgcttagcaggggaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatgaacagtcctcgagttggatttgccttctgcagcctatcttcatgcgcaaggacaccaagatgagtttccagtggcggattcgaaacctcccctatcctaaggatgtctatagtgtctctgtggaccagaaggagcgctgcatcatttaccagaagccaaaggaggttgtggtggccgagtctgagctacagaaggaactaaagaaggtgaagacagcccacagcaacgatggggactgcaagacccagtagttggcccctgagccttatacctccaccacagggggtgccgtgagacttcaaggcttggcccttcttgaccacggcagcctcctgtcttctaggagctatcaagggtctctaagaactgggcatggggcactcctagccagtgagtcatggtcatatttcctgagtaaagtcattctgagttacttactgcacagggactgccctcttgttcccctctgtatgctgcctggccccagaccccactggcctccctcgggagggtgtgatgacattcctttctctatcccggagacctacaacataaagctttccacaaaaagggagaatagggtgggagcacatggccctagcagggcagggctggcctttccctgcaacctgtttacacaaactcagaggaagaccag

SEQ ID NO: 648 - protein, 344 aa, Homo sapiens
RTGTSEVLPLRGPPDLCCPLSTCSPRDGAYTFLPKTVKEAAEDTPVGPAIWVSDEHVDITTGRLSPSESLQVLLMMHQHEFSAAWEMPSRYPWDPLKYGWIPAYWSVGQGCCTWKSRIEALQPLCLWSRANESGRRGEGGQMARIASESAGSDPLERLPWQRLGVLLSRGKMAVTGWLESLRTAQKTALLQDGRRKVHYLFPDGKEMAEEYDEKTSELLVRKWRVKSALGAMGQWQLEVGDPAPLGAGNLGPELIKESNANEQSSSWICLLQPIFMRKDTKMSFQWRIRNLPYPKDVYSVSVDQKERCIIYQKPKEVVVAESELQKELKKVKTAHSNDGDCKTQ

SEQ ID NO: 649 - DNA, 91141 bp, Mus musculus
  misc_feature (1)...(91141): n = A,T,C or G
tggactgctctgggcacacacttggtatctgaggtggctcgaagcgctaacccagaggcttcacgagccgcatcccggtcatgggtcatttcccaggtagaggttgggaggagttaatgtccctttggttccatacagtggtgttcagcagggatatcaggctgggctggtgtctgatagctggcacccttaagctggaggggatacgtagaatggctgtaaggtagctgctagcttccctgggattttcgaatagcagtagnnnnnnnnnnnnnnnnnnnnnnnnnnnnnnnnnnnnnnnnnnnnnnnnnaaaccaaaaggtgggaggggcctgaagcacatggcagtgtattaggtgggggagggctggaggcaagggtcttagggatccagctctgagtggtcaagtgtgcaaagatcctgcctggtggtattggagcatgggctggtgaactcagtaggtggtgatacagtgatctggaagctagtgtcccccttggttctcaagtgttacaagtgtctcaggaggcctctggcttttggagttgtatgatgtcccaccctggctacctcctgtgttccctggaatatctttcctagctaaccttgagggccctgtactagcagtcagtattgggtccagctgctaccataggctatggccccatcaccgccctggacttgagtctttctgcttctctgtgtggggcacgcccagtggccctgatccccatggggagatgaattgcaggagagggatggatgatgacagctcattataggggtttgtcacagttgctttgtggggaggggcttgtgccaccaggccaggttactgggacattcatttacttattcattagctcatttactccttcattcattcatgtgttcattcattcattcattcattagttcgttcattcattcacttgctgctgttgccagatcctatcctcaccccgtggagtcaggacagacgaaggcttattccctgtttgggttgacaagtagctgagagaagtaagggagaaaatctgctctcccggggctgccagccctggccttcacgtcgtgacactccttgggtgggcttcttcagtgtgttggaaccaacaaggtctcattggatggctttggctagcctggagccttctgagtgccgggattccaggatgtgctgtcacagccagtctgacgtagccaacgaccgtacagcaggctgaggattttgtacagcgtttattgcttaaagtgagtgatgttcgtagggcgagtcatgggatgtttcagcctatagaaacagtcatggatctaagccaaagagatatgtgccccagacagtgtagctggtgacattagccatagctaagctgtgaccagtgtcacctgtgttgaccaaggctggacttggaatggatttcttagaagctgaatctgtctgggcatgttggcataggcctgtgggcccagtgctctggaggctaaagtaagaggctggtgagtaaaagatgtagccagggctacaaaataagactagccttaaaagtaactaactaaacaagtaaataccaggaccctgaaagctttaaaaataagcaagcaagtgaagacagaagaaaggaaagaggtggggtgtgctttggtcttgagcctgtgccagttgtggtgaccctccagctgcaggattctagctatcaagtcataaatatggctctgagggagtgacctttcatacgtcaacagctagctttctgtttagtaagtccatctgtgcgtgcagtgtgagctacatcatgcttagagagtgctgggccttgctgtcagcaccattaacaaacatcacggccaccgttgcccatttcagcgttacactgttaaatccacacagtctttcactgtgaatgcatctcgaggggagagtaaatggagttgtaggagagagggggagagggagtctggctagagaccggggcaggatgtgctgggagaagctggagcagctgccgggctgtgtggagcatcccaggcagatgggaccagcagtgcaaaagccctggggctgtgctgagctgcatgagattgcagactgtcgcagccacaggcaggatctgtcaggcccaggagggtgctgcttgtccttccggcttggtcaccgtccacaaagattcggcctttattgtgggacgtgctctgctgcgagtttatcttcaagttcactctgatggccactgggagaaaggtcctgggacaccatgtgtgggaaagccctggagagctatgggctgtgaggtatggaaggtcagggtatagggtctagggttcccagcccagggctggtagtatgtggtaagtcaaagctgcctcttgacgggtgccatcactccctggggaccaagagcgctcagctgtggccactggctctatcagcagctcctgaccccattcctgctgtgcaggtgtggcctgcagatgagtctgagggacagagaagcccagtgctgggacacagcggccctgacaacaatttagcagcttttggatagagcttgtatacagtttacccttttaaagtttgtctggtggatttttcatggtcacttaggtgtgaactgctcagcctgggctcctacagcacagcatcagggaattttgtgtcttttcgtttcttccgaagggtcaaggactcctctcgtctttggccttttgtgtttcggatatttctcatggatgggggctgggctttcccaggggctcatagtcctggagtaggtacagtgggcagggtggggtgcagagaccaggcactgaaagtgtggatagcttcctctggtctgaggctagccccaaaaggatgctaggtggcatgccctatgacacaatgacactcaggtcctggaagctgcttggtaggcggggtctatgtgacctaggtgatagtgatgtctatgtgacctaggtgatgtgtcaggagctccaggcctccagggtggatgaagtccttgcagatgcctgggagcctttggggttactgtctaattgggtgaaaaagattcagaatggtcagcctcctaggggttgggggtcaccaggggaaacagaattccctaaaggtggagccaggacctctggagtcacgtgagagactcagctctgataaaatggactgagtagtgttaggctggggtgtgcctgtaatcccagccagacaaacagacaaccctctccccccccccccccccagcataaaactannnnnnnnnnnnnnnnnnnnaggtatgcaagctctacactgtgtgcccgttgcgaaatagggtctctgcaccacctgtaaggtggggctagccctggaaccaccaagggcccactgtgttaacaccgcctcagctgacatctgtacctgacgtgtgagagaggtgcttggggaatttgttgttctagtccctaagcacggagacagttatccctcattcctttgttcactgcacacacgtctctgtgtgtctggtctgcaccaggcactgtctgtccctgggagatagcagtgaacgagtccccacttgcagtggggagatgacaagctcagtactcacatggagtgtgacagctgtgacaaggacagtgagattgatctggggggttggggtgggggggagctccaccacccagggagcagagccgtcaccagctccttggctgtctgctgtaattgctgagaggtgggaagtgtcccttccctggggacctggcccctgtcattttaatttctctgccttcgtgcctggccatgactttcaagttaatttcatgcttggcttcctggtgtgggtgatttcagacctgtggaggtcacctgtgcgaccctgctcgtctcccccgccttgctctgaaaagtgtcaggagtagctgaggttctgccagggcacctgccacctgggctgggagcctgccctgaccctgccacacagggaaggcagccccaagggcatgctggagaagagaggtgtgggagtgcccagattctgtaggaccgtcaggagcatccatgcctggatgacagataagtctcagagcttagaaagatggggctggacagctactaccccgcccgggtctctgccagctcgtagccttggtcctcgagtgtctcaggctcagaaggaggcatctctcttcctggtgtcctagacccaccctctcattttcaggatgggcaggaagcaggttactgggaagcaggttactgggagcatgtctctggtcttgccctggaggttcagaggtgcccagtaatttctccagggtcacatagccaagcccgcaagagattcagtccacacctctctgcgtctctgacgacctcagacagtattgcttctcccaccagcaggccaggctggtcccctttgctgcagtaggctcggcctttctgacaccgtttgcagcttgaacagacatgggtggggttccatctaattgtgccctggtacagttgggatcagacccttcctgaccctcatctcatcccgccaagccctggagcccagcccccctccactgcctttctttgagtctatgtttgtcattgctgccaggccgctgatttcctgggctgctcatgcaaggtctccctctgtctctccacccaagttcctgtattttgtaaggcagtacactaggattggtggtagctccccatcttccagtaggaggcggctgcattccccttctccctcttcccctcccctcttctccctctcttctcttgctctccctcagcctccgtatatagtgcagaataactaaacttctgatccttctgcctcctgtggtgtggacggcattttcatgtggtgtggacggcattttcacgtggtgctaaggtttgaacctagggctttgtgcttggtaggcccgcaactctgcatctccaccaagccacatctgaggtcacaggcatggggcatccaggccttcactccagggcaactcctcaaagtgggagctcttggtggattagggacctatggggaagttggggttccctcacctaaaaagtgatgcagttgtgagtccaggttagagagggcaagttcagaggtgtgatgggccccaaggcctgtctgtctgtgtctcccacaagacccagaggccatttgcagcgcctggttgagtgtattagggctgtggggagtagggatgtaccgggtctctgttgctcagggctggggtggatggagccctgtatcccgattctgctgtgccctggcctcaggatttctgttccttctctgcagtctgaactttgtcctgtctgcctgtgtcttttttctaccctccacctccatttcccaaatctttgtccattctgaggtaaatctctgttctcgtctctccccctcccttttacttctcccagtttctccctcctgccccctctgaccctgttcttctccccacgtctctaccctttttttttctcgattcctctccgactcccccaccgctttcctcggtagtccttgcagggtctcttggggcctatgtggccaagctggtacagtggagcttggctgtgtacccaagctgaagacccctcaatgccttagccactcataggacagggtccccaggccatagccgttgagatttgcctctgggtagcaagggtgggtctttgtgggttggtatccaaggctgtgactcagggggatgtgaatggtgcaggctttcaagtatgggagctctagggatggtgggttggggtactggcagctctgaggggcaaagtagactctggggaaagtagggggagtgggctcccttctgactaagggccagtgccgatcagcctgaactacctgctgagagctggccatatctgacgcccctgtctgtgcctccagaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgggtgtctgcgtcatgagtagaatgctgtcgatgagccacagagggggcagctgctctggtggttggggctcctgaccccctttcccagtcctctggagcggggagccactgaagccaagaagggtgtcctaagggcacccttaaatgctcctcatgcccacagaggttttagagagtgacagaaactgggagtgccccgagaaatgagccttcccctcccctagccaggcctaggctctggaaaatggtaccattggaaaggagcaaggcccctggcgtatggtggtcagtgctaatcctgcttcttgagtttgggtgaggggtgcaagggacccccaagcagttgcactttgacccacagagatccagggctaagggatggagggcaggtaggtacctgccgtgtcgccttagctgccagggttgggagtgacaccctaccatcatgcctacttacatagtgctggaactgtgtggctggtttaattaggtcttccctctgtgtcttcccttcccttcctgggctctgcatgcaggctctgcttagcctcgatcccatatcagctcagaaccagggtcaagcttttgcttggagggtgatgtcatttattccactcaagcccagggctgcagggaaacaccgtgtggggnnnnnnnnnnnnnnnnnnnncaaggtactccccaccttgttcctcgggctgacctggtacttgcccagcaactcagcggtgcatagagcctgcgtgtgtgtagtaaacagaagacagcagctaagtgctgtttgcgcagaagtggaatgacgtttgaattgaatgagttgtgggtaaagagacagggagtcccccagtcataggtcctcagctgcaatcaccaagtgcccactgtgcatgtggctcctggcatgggattcgagaaccgagttcaaggctcaacttcccaccacagccgcttcctcctccctcggtggacatggtcccaggaggtggttgtgttttccagccgcatatttcaggcagggaagctgaggccaagaggttagcccattggtcccatgtcccacagagaagtggcaatgtctggattggcaccagggctgccttgttccttagtcttgggtaagcaaatcttgccccgagtagttcgggtgcaaggtgaggtaccagatgagctcaggaggggaaggtggctgaggcagtggaggaggaatggccctgctgaaatacaaggagggagaaagggcaagtgagttgtgtgcagatctttgctgagggagagcatggcaggtgtaaaggtcctgggattggcgcttgataggactgttgatgtccatcctcacagaggagcaccacgtgcatttatgatgaatctgcccttagtatgggatgcggagtgcgtcggtctgcaggaaagagtgatatcggcaggagagcacccttgctctaagatcaggcgggtcagcgccaggatcaccatgcgcagaccacaggaccgcaggcccctcctgctggtgggtgaggagaaggcaggcgttgtggtcccctcaacaccctaaaatccagtcctgccaccccaatgtgccacccctagatgccacccacagcttgccctgagcttctgccctcagccggatctgccattccacgtcagaggtccttggggctctgcagcctaggcagtccaccttagggagggaaggagagagggtctccatgctgcagcaggaggaagagacacgaagggctcaagagtgccgctctgttttctcagtttccagcaagacgtctccttcccgctcagctcagccaccccgctctgtcttcactcagaccccagggctgaggccattccctgggagcccttggtgctccccagagagaagcctgcctcgcttttttctgcggggccaagtgtgcaggagaccagtcagccacgttcctacccagcacaggccgacagacagagatgtctgcttcctcccctggccaggccccctctctccctgtgagcaacatcccactgtctttagacagtggttgtcaacggatcctagctccactgtgggccagatgcacacacctccccagtagatgggacagactgcagcaggccacgcggtggtttgatctagtcagagactgtcccgtctcagacagtaccacacctccccctcggaagctgcttgttgggcctttgtgctattgcctggggctatggagcatgtaggacgtttctgaggtcttgggaccctgttgcttgtctgcaaggtctgggacagtcccagctctcagctggtatctgacgttagctggtgtcctctgctgtctctggcctctggtctctgagtgttctctttcttctccctggtcctctgggtgggagccaagaggcctaggctggactggtggagtgtgttttggggccctctagccgtagccccccatcttccctcagctggagtccaatactctgggggctgttgttcaagacacagacacagggagctccgggtcagaggttaagtacactgtggccggtatcagggcctagaacatatccaaggtgttatatgaccgagtctcctgtcctgtggctgatagaggcgtgaattttgaaatgatccccttggatatacacagggcatgtgtctatgctctgggccaattgggagataaacagcaggcagcttggtggttaaatggggagggggacttccttatcctgcagaggagggcagaaccttcctttccaatgtctgctaggttttggactcttagatttggggagtgtggctgcaccagagaccagggatgaggaactgcctagaaagcggatactccctggggacatcttttctgggccacaagagctctacagagccatgctgcccaggacaacttcctgcaagtggtggggcctggcctgatctcctgtgcagtatcctgcagtgtcggtagccggtgtaaacacagggcatgagccccagcctattggatcagggctgtttctcatttggatgtgtgagcgaggggtaacttgatgcagctgagtcagaggaggcccgtgcagaggaggtctggctctgaaggagtggtcagtcatatcccatggggcacctttggcttcccaggggccggcagctctgtgactgtgtctgtgtgtgtgtgtccatcccccacctgtccatgtgagtgcagtgggtagtatccagctctcaccagcatgccgccttctgaccatcccccccaccccccatcacaggaacagcgcttctgccagcgctatgaccagctcatggaggcgtgggagaagaaggtagagcgcatagagaacaatccgcgaaggagggccaaggagagcaaggtgagggagtactacgagaaacagttcccggagatccgcaagcagcgggagctgcaggagcgcatgcagaggtaagggcacagccacagctgaaaactgtgcgcgcaggggtgagggggtgtgggcctgggggcgggggatgagcctatgctcgggagaccacatggagggatgagtggatgctcaggggaggacacagagatgagcccatgtaagaaaacagttgtgcatagaggggcatgctgtgctggttcccatgggcccctggtggcctctgccacacagagtgccctcacagggcttcatacttacagctcgggaccctcagcacctgttgggcccagagccatcacccatgagtattatcttcctgtcctcactgctcctaccccatacctgctaaagctgccgagtgagactctgctggggtgggagcggcggtggcggtagtattgggagggtggctgtgaggtgggtgcctgtcctcattgtggccatgagggcagaaacctaggcaggctctctttagcaaatgaggctagttgggtgtggtcatctgcactctaggctcctcaggcttgtctcaatgacgacctactcagcagcctgggttctagggctgacctgaggcccagaaacctgctcctggttctcgggctggaggcagcatggagctcctgctgggtctcttttgtcttttgttcatgggagatgggctgccatcttatagccttgggagctgacattcctgggtggctccccaaactccctgggctcctagcctgtggtcagttgtgaaggtgggaggctcggccctgatcccaccctccccattcacccgtacataccctctagaatgttctaccccatggtcttgacttagcctgtcagtaggacggctggtcctgactgtgtccctctggtttccagcagggtgggccagcgtggcagtgggctctccatgtcggctgcccgcagtgagcatgaggtttctgagatcattgatggcttgtctgagcaggaggtaagtccacagtgacaccacgcacaccctgttgcctctgcacgtccctctccctgtcccttacacatacttcttgccacagtgctcaggtgccagcaagaagggatccagagactgctgatgtgtcagatgcaatgtgggcacgccagcaataagtgaccgcgcctatctcccaaagggcagagttgacagggatgccagcaaaccgtggggggcagcctggcaggacatagttggggaagttctctgatctgaacagtctctagtgcccaaagagacatcgggaagctgggttgtgggacagggataagtgccccccactcttctcctgctgccatggttcagggtgtctgttgagcttggcggaactcttaggggagtctgggtgagagtgggtgggcccagctgaggactgtcccaaggagcagccttctggctcattgccccctcagtcctccctgggtacccagtggtaatcttggtgaccccagctatggtcaccatcacagagaaggccaggaagcagaacaggtgcttgtccccagtgagggaccattctgctctctgggccaggtgtactataatgacatttgtccccatggccggcgccacagtcacccagaacaccatgtaccaggacccttgcttctttcctggtggctctgctcttggtagaggtggccatagaacccatgtcccctctgagccccttgaggctgtttatgtggagactgaagatgggatactggacagcagctggcgacacctctgtggctgtggagtgactatttaagctgttctccaagctgagtcctggtcctcgtaacactggccatggaccaggcgtggccgtttaagtggtctccttgtacacactgacagccccatgcacccagcagccttagcagctcaggacctgcaccccactgcagtgcctggccttgcagggacatcctcttgccagagttctgctggaaaacctctcctcctcttgtggacagaaagcagaactcaaaaatccacaagcgatagctacggggccatccttgctggtgggcatgtggctggggtcaacccatgtctcaccgatgtggatgcagacgtggctttcatttcctctggaagcagggagacagtggtcctgtccacccacacattggacccttccctaggtcctaaccacacaagagtattgtggctgccacctcttgaggaagccattgccagaacaaggctggagacagagccagaaccagaaggtgctgggcaggagacacttggaaagtccgtagtatcttctcaacatggacgggcaaggcagccacagaaggaaggacagggctggccaagtccccaggggatgatagaaaagccagggtataaggtctggactagaaagtgaccaggtcctctgcataccttgtgctgccccctggatatctggccttaagccagacagacatgtgccatcccgagagtgcgtggagccaggctgggctgtgccttgtccctgtcttcacggtgttttattacactgcctttgtgggggtgagattcacggcctctcctgctgcagataaggcctcatgctgtgcactgaatttatagcccttactgttcttaaccactccacacccctaaatcctcgccagcgccagcccctgctgccttttaattcctcatccctccccccaaggaatgtccaagggccagggcacctgctcctcacctgccaggccctgagcttgccctctgacccccgaccctgtgctctgttgcagaacctggagaagcagatgcgccagctggccgtgatcccgcccatgttgtacgacgcggaccagcagaggatcaagttcatcaacatgaatggactcatggatgaccccatgaaggtctacaaggaccgtcaggttaccaacatgtggagcgagcaggagagggacaccttccgtgagaagtgagtgtcatcctctggggctgcctgcgatccttgcctgcatcctctctgttcccacactctagtcccagggacactgtccagaactctccctgctctggtggtaccgggggcggggggtggtggtcctcagcctctctctctctctctctgtctccatctccatgggagtcatttgtttcctcataggtaatagatggatctccttgtcccccttagcattcattcagccagacagctcctgccacataggctcagcaaggggaagatgcctaacagggacccagagctgcatatggtggaggccgagtgcagctggctagctaggatggagaagccatgtggggaagccagggcttcagtgatcaggaacaggctgaggttgaggtccttaggagctgatgctcgttgcgtgtggtggccacgcctttgatcccagcactagggaggctgagccaggggcatatctcttcaactaccagcccagtttgatctacacagtgagaccctgcttcagaaagtgggtctccgggaggcccctccaggacagtttgggagagacgagtctgtagcttctaggcggaagaaagaccattgcagcccagggtgaggaccagaggtctggtctgtctccaggtagaaagagacatcccctatttgggggaactccaggagaggtggtatagatgtcacgataatattcgtatgtatgttatttggagcagtactctgtaaacacttcacctagaagcagaaccccttcctcagagaggaccaggacctctgagagactggacagtagaaattgaagctgggacaggagccgccatgttgcccaggagggtctgtggagaggaaggtttgtgcctcaggcctccagtgagcagagtagctgacctgttgcccctctggagagacccttgtctgccccagagcttttccagatgtctgctgggacaacagttgttcagggtcaggctgtacctgcccttggaaggatgctgtacaacaggctggccccatcccagatcacagacaaagcttggcagctgtacggggcttgggcacaagcgacagtcttcaaagtagcttctggccatggtaacacacacacaaatcctgagtctcatattcctagcacagcacagatagtgggagacataccataccccgaggagcggctcctatgggcagctcgggtcagggtctccatccttcatctctttgtggcctgtatcttgggctcttgcatctaagactcctgttgtctgtctggtgtgttttccgacttgactcaagatagtggtcctgaggtggctgaggccctgtgccctggttccctggtggcctgctattttaatgggtgaacacttaggggtgctttcagtggctggaccttcctaggaaagtctctttgctcttcagacccagtgatttgctctgataattccatagctgacaacccgatgaccagatgtctactggtgcctcttctgtctacgcaagacacagccatattatgtcggtctttgaaggatgatggtctgtctccctggagggctttcttgccaaggtgctgatggcatcttgactgacccgagaatagcgcagatgtcacccacagacatctcagctgcctcagtttcctcctgtgtaaaacagacagagctatatagtattctccttgggcctgcggcagctccaaggcaggacagctcagcataggccctgctcttgtgggaagcagtctggtactgctggcagccactcctgccccaacaggagaagctaggataccccatctcttctgtaaaaaggtggtgatttgcataagacctgggtgtcctccattcttatcttagggccagtcacaataccagatttaaaggaagtccacatgagcagtcattactcagaatgttttaggggacactatctcaggaaggccaaatatggtttgtacaggcccaggtggtgcatgtgtgtgtgctcacaaatgtgagtatgcgtgtgtgtgaatgtgtaaaacttttgttgcttgtctttttttgaggggagggggtagtggttgctactttattttctagagtctcatagctcaggatagcctcaggctcattatatagccacagctggtcttgaacccccctgcctcagccttcccaatgctaggatcatagacataagccaccgtgacctgcccatgttactatttttaatatatattaggaagggcttttttttttttatgtagcacagacttgtctttgaactctgaaacttcttgcctcagcctcatagtactggtcatctaggcgtgtattgctatggttgacttcattttggagccttactggcctgcgatcagttgaaccttacatgtacaaccctatacatgcgtcctcagcagcagcgtgaagtgcccaggccaggctgaacgcaggacctcatgtgggcctatctcttgataccactgagcctcttgttttagttctcagatgaggtctcgctaagttgccctgcttggtttgaaactcacagtaccccaggctggctgtccacctgcctcaggctcctgagttgcccagttacaagttgtatcatcagacctggcttcgcctgtctccagtgaactgtgctgggaagagggacggggccctgcagtgtcttaagttaggttcctggtgtcctgggacccatcactgcctagggaaatgctagtggtaccctaggcttgcctgctatctgggtgggcggggccctggaagggtagccaccatcctgccaatctgctacctctgcttccttgggaagagtctagaggctcttccggattccccagtgtctggcggggagaacgggaggggcctctggccttctgcccagccacctggaggccaggcgggggcagcccaacacagactgaacactggtgggaactggaccggtactgctggcagccatttcttacccccacccccacctaccctgggacatactagggtggtggcaattcattggagacagggggcaggcccaatgacgccacccagcacccttagggtgtgagcaggccttgaccctatccccacccccacagctgcctggccctgacatttcagctggccggctttcccagtaatgcttgggcttcgcaggaagctggtggcttggcgccaattcccgccaccccctgcggctccagccacttttggcttttcctgggcatccgaggttccgctccagcactcaggaggcctcagtgcctggcttgtccaacctcgcccaggcaggcttagcttggcataggctgggcctggctgggccgggccaggccgagccaggcccagcttcttagacccggctggggagagagacaaaagcatatctggggaggtggggggaccccactggcaagctgaatgccgtgtcctcatttttcctggaagcctgcggcaagacaaacaaatgtattttcaaaggcattacagccagtgagtcactcggaggaacgccctggaccctggtccctgccccgaagcccttcccacgccctgaagatctgctagtggggcggcgcccgccaagccaggctggggtggcaggcactgggcactctcagctcttgattgtcccgtagggcttccctcagcctcagcctggcctcagcattggcctgtctttctcttccccccaggtttatgcagcaccctaagaactttggcctgattgcctcattcctggagagaaaggtgagtgccatccctggctggcagagctgggcactaaaccggcttgccatccactccttagggccgatgtctgggctgggtggagcgcttgcccctcctctgtctctctggccagctccatcctttttcctgcctccacctccttcctcagggggaaagccaggcaggccccaccctggatggggaggagcctcaaggcttcaggcccaggccacccaggaaagctgtagggactggcatcacacagccatttgcccagcacactgggttgggcgccggttctaagagttttgccacgttccaactgaggccttgtggccaggaatggcctgcatccaggtctgtgtgtggagtaatctcctgggcccttgtcatgggtaatatgggttttctgacaactctagataccactacttccggtgtgtggctaacatgtctatcattctgaacaaaccttcatgcagaattgatatttgaacccaacctgttccctaaaccagagcctgaaagcactctcctctggctctgtctctcgtcggtaaggagttacattgtccccagagggcagttagctggctttcacttacataccaggctagcctacagtacatgaacaacccgtggtgggcaggtggcagggttggctgtgtgctggagttggtcctgtaggcccagcacctcagactaccagggcccacccttgtgggctgtagttggtgtctagaccctcaacagtgggatgtccagcctgcctggccccctgccctgagtctgcccagggatgctggcagctggtgggaggtgggacccgggatctagacagccgttctcaaagaccgtgatcattcctcactgttccagtgggctgatacggtctggagagatgggaccctctgggatctgggacctgaagaaccagtgttgggaaccagttatagcctacctgtctggtgatgccaagcatcctgatgggtatgggtgactcagtagctctaggtttaaggctagggctccacagagccaggatggctcttaaattggtggttgagtaaggctgtgggggagggaggagtggaatctgagggcgagaggcgctcaaagagggtgtagatgaggcagatcagagcttctaggacacaggtggctgctaaggccacatcaccttcctgggctggctggcacgcagttcctccggtgggtcatgggtgtgggcgagggttggcttgggggaaccccatggaaatagtgtttgctcatggcatactccaggagtgtcctgatgtgtaggcagctggggtctgtcccaccccgcagttctcatggtccctggcttggcactaggtcaaatgtgataggcatggacatctcagacacggttgccactgcaggtgtccattgaagcttcttgtccatgacacttaaattctgggagaggttgttcaggatcctggatgttggggaaggagcccagagccatgggtggcaaaggctgggtttgtgtcactctgagtacccgcgactttgttctccacgggagctgagcggctgtgatgtcatcactgttacctacagttgcaaggacagggtctgtgttgagagcctgtgactctaccgcctgtctctccatgccaggctctgtcccgtgtgtgtctcattcagaataactcccttgaccagcacaatctgtttctgcatggcacaagcaagctggtgggtattcagagaagttagatttttcccagggcaacccagcttgtcatcagaggaattaggatttgaactctggcctctgcctcctactatgaatcctctcaccccgtacaccccatacaccccatacaccccatacaccccgtacaccccatacaccccatacaccccgtacaccccatacaccccatacaccccatacaccccgtacaccccgtacacccctcagagtcttctctctgtctctcagacggtcgctgagtgtgtcctctattactacctgaccaagaagaatgaaaattacaagagcttggtgaggcggagctatcggcgccgtggcaagagccaggtaagatgtagtgtgtggctgcttggctttgaggatcaggtccctgcacttgagggacacttgctgggtggtcagtatccttgatgattggtgtcatatagttctactgttagggatccctctttagcctctgacctgctgagggtgttcgcagaggcgggaacagcagccacttctgtcttagctaggatgtctccggttcagagttggccagtccatagtccttactgttagaaggccacatgtcagagctggagggatagctcagctataaaagagcattggcttgattctcagcacccacatggtggctcataaccatctgtaactccagtccgaggggatccagtgtcctcctctgtttgcaatggtatcaagtacacacacggagcagagaatacccatacacaaaagtggtagccgattttcaaagtaaagactgctcaggacaatctggggagttctactaagctttcctgactgccccttcactagtggatacgtgcagggagatgtggccagcactctccacgtctatgtcatcatgccttggtgtctagagtgagcctagagtgccagccactggcgacttgaagttctgctctctgcctactgtgtaaataaagctttattggcacagagccactactgcacagcctgcagcctgcagcatcactgctcacctttagcaaaagctggctgatcttggaagatgttaagaaaatgcaggcaacacacagaagcgaggaattcaggggtgtggcctttgggaggtggggagagattatgtgttgttcactttctctctgaattgagttgaagcatcatggccagggactgctgtcccacagaacaggcgttttctggcccacttacgcaaagtgcagatcgggaggtcaagtctgcagagacaggcgaggcaccccagtaacaatgccctgaaagttagtaaagtgcctgctatgtgagcaagagaacctgaattccatccctagagccacacactcgtaatcccaggggaagagaggtggagacaggacactctgtcttgctggccagtcagcctgttaatcgacaagctgtagcccctagagagactcagtctccaaatacaaggtgaacggctcctgaagagcaaaacctgaggctgacctctggccctccgtacacacgtgcatacaggcacagatacacacgcatgtgcgcatgccctgggaaatacccaggacccagtctgtgtccactctggacttgaaagatggctggatttggtctggggctgtggttttctagctcattttatgcgcccacagtgagctggctagcttatggttctgacagatgtgtgactccgcagtgttgtggcacagagcagtgggtatgctagaggtttggctggggtattcaggaattttctaggcagtcggacacacttggacacctattggcaagtgtgatgaagctgggaggcgtggtttatggagacatggggccctgtgtaaatctctgcacctagccctgtagggataagtgggggaatgctgctacctgccgtcgggatggttggttaatgacggtgatgatgatgatggtggcagtgatgatggttctggtaataatgctggtgatcatgtctttggtgatgatggttgataatggtagtggtaataatgttggtgatgttggtgtttgtttggtttggtttggtttttcatgaaagggtttctctgtgtagtcctccttcctgtcctggaactcactctgtagaccaggatagccttgaactcggagtgcattactgctgcccagcctgatggcgatgttggtgatgccagtgactgtcttagtgacttttctgccactgaggtaaaataccattgcctaggcgatttacagaagaatgaatttacgtgggcttcccattcttctcaagagttaagagtccaatgccggcagggaggcttggcagccagtggcaggtggagcgttcatatctagaaccacagcctccaagcagggagaacaaactaggggtagcagttggttcttaaacctcagagctcgcctctggagacaaacttcctccaataaagccataactcctaagcctccccaaacagccaccagttaagagtagccatgtctcatgcccgtgaaggtgaagcagggttcttggtgattccctctctacgtaagagagctgggatcataactagctaaaggagcatccacagggtcagactcactccctaggctgtgcgagctgagggaggacgattgctctgctgggatcgttgggtagtggggccctgcctgagatctctgctcagctgtactgccgctgggcctcatgggaggcactgctcgctgggcctctgtactctcgggacagtttgccaggctctgtgctgtggtgacatgccccgaaacagggctgagggtggaaagcggctcctactgaggatatcctttgagacagagcaaggcccagcctcacccagtttggctctgtccttttgctccttctgatagctcctctttcctggaggaggcgtgcctgtccccagcagctggtagggccggctctctacccgtttgctattttggtctctccctttgttcctcatcccctgctcggggtggcccctgtttgtagatggctctggtgtctgtggtctcggtgtggctcctgtggctcccggccacactgttgcttagaaaagccacaagtggccattctgcttctcggcacaccaggtgccactcagagggctcctcgagagatgcctgtttggtgctagatgtgtgtgctcatttgggaatgtattgagcgcttcctgcatgctgtgattggagaaccattgtaggggggtccgtgtgtaacagttcagaaagacactgggccttccaggatgtcaaccctactctcagactcacgagggaagagttgcaaggtagacaccaggtagtactttctgcgtgcttaaggtcccagttgttctccaccggctctgcatcctgcgcaccacctcggagcagctgtgcctcctggactggctgcctccttgcccagcccagagactggggactcctctactctcaattctgccttgatgggattgagccaagagaggagcggaggcagagagccgcccctaagaacacctgggcatttagcgtccagctctctctgcacgcactgggatgggcatcggtggagatgtggacttccaggttaaccctcctccggttgccagcgtgtccggcccaagactctttggttcttcaaaacctgttgttagtggagtgaccccaagaaagtcaaccctgggtccagcacccaaacaagtagggtagtgggaaggggaggggagcttcagacccccttagggccctttctggagtgtccctaaaaaggttgagatggctatggacaggtctcttggacgtgtctcctgtgtgtgtgtctgtgtcctccacttgccctgaggcatccaaactggcctggcccttggttagccacctctgccctctctgtcccccacctgccctgtgtcagagcgcttgttcaggggtcatatataaaaaaccacagaggttataagcccctcatgacagtcattgggtgtcagtggcggccactagtgtcctgcctcatctctcagcccacccggccaagaaagagagaggctttccccgacctcagctgcccgtgggtgaggagtgtagctggccgtgtggagtggtagacttgcttgttgcttagctatcaggctagctcccattctagaagcttctctggcctttgcctacggtgaggcaggttcaggcataggctctggggacagtgacctcctgaaccggttctgaggaatgggttcaggaccatgttctggcgcctttccccaagctgtcccattggctaatgggcccgactggacgtcagtctgatgacaactcctggtccctagcccagatccgccccaagaagaatcatgggctgtggtgcctgccacacagggtgacattctaagcccagagcctgcagagatgaccagccatgaccagttggcagatgctgtggccctcctgtggtggcgagggatctatgaccaagcaggtgtgtccctgagggtagactagagctttttcctgtagaggcaggacatgagcaggaaaagtctgtcctggactcctgacctctggaccagccccttttgctgagggggaagtctgtggtggaggttcttcatcctcactgatgtcagccctcacatcctggcccacggtgttctgtcggctgccccctgaccttcttctgtcacactgctcttcctggccttggccacacatgctgctcagactctctgccgtgggtagcttcctctttttcccttttcctctgtgtggccctgtctcttctctgtttctgccgtgtgtgtgtgtgtgtgtgtgtgtgtgtgtgtgtgtccatccgtctttgtctctgtaaccctgtaccacctcctttttgttcctgtctcacctcttcacccaccttccctgtgtctgcctgtctgtccatctgtctgctggactgccttcttagctctcttttctctgtgaccccatgtcacctctctttgtccccaacttacctctttatctactttctctccctcatcttactactttgctctggttgcttgccaagggacagctgaccttgttcccaggcagggcccagattacctgttcaggcgctgtgtgaccaggaggccccgggcagcaccagacagacttgggcagtgtatggctgtcactctcccttgaggaccagctaggtaccccttgcctgtgaggtaaccagagactgatggtcggaaactgtgtgtcacactaagccacagtgccctggctaggccatttggttgttggtcatcagtgagggggtgtgctatgcctcagaccttagtagtaaggttccagcctaaggtccgaaacttcttggctgcagtccatagcgggctgcctggctgctttactgaggatgttctgtgcatggcagacctgtgccgatttagggccagctgagaaggcatctccagttccctgtccggctccacgctgagtggggaatctcctcagaggccctcctccaggtcccaggtctgttagacatgccttgtgggaccctactcagggctggcagctggggagggagcccaggaggcaggagaggctggaccctacggctggaaggagctgcatcacttccatgggaaacgagaaaggttcaagactgggccaggatacacagcacaggggacccagctcccccaaccacccaaactgccttaaggtgggaagtgtgggtgctgctggacatagtccatcactttcctgagacagatatcaccccggtgctcctaaatgctatttacggctaactagatcagtagcactgggagccacccgtcagcaaaggctcatcaaaggtcagcatggcttcactgtaatgagacaactgaggtccctggacagccacttgtggaggactgctgaagtcctgggggccatgtgatcaagagtagctttcagggctctgatcccttgaaggaacagatgagcaataagaaggaactgaccaggcaaaagacacagcgggtgcaaaggtcagaggaagggactcttcttcggtcgcctctatctgagagcaggagggaggcaggagcaagctaacatgtggaggtaggtccagcctggatgtcccgtgtgcttattctggaggcagggcaaggtgtgtgtgtgtgtgtgtgtgtgtgtgtgtgtgtgtgtgtgtgtgtgtgtgtgtgtatgagggagagggagagggagagggagagagcatgcacacgagcaaccttccatatcaccgtcaactaagaaaatggaccacaggcttgcccacaaactgatgagggtattttctcagcggagattccctctacataaatgactctaacttatgtcagtttgacattaaactagccagcacacctgctgagctcccccagcccccagttgaggatttaaaatggggccttgggattagtggtgcagctcaggggtacgacccttggctagcgtgtgccaaagccaagggctcagtcctaagttctgtgaattaataagtagacaagccattggccaccatgaacggactcctgggcgtgtgtctcacggtactcagtagaagtgtctccacaccagagcagctcgggaaagcgctatcagttaatgctgggagccaccatggtgtgtatgaagtgctactgctgtcatgtaaattcttactcctgccaactctgactcaagcctcagggttgcagaagcacacactatatcctgttcctgctccaccatcaagcagtgggaatgacttcacagtctaggctgcctggaccacagcggccatgcagctgccccttggagaggcaccacatgactcagcccctgatgtctgtttaaaagctgatctctggcctggcatggtggcacacacctttagtcccagcacccgggcagcaaaggcaggaagttctctttgggtttgataaaggcaggaagttctctttgggtttgaggccggtctggattatatattgagctccaggctaaccagggtggcatagtgagaccctccttacctcataacaacagaaagccctgctctctgttaatgacagtgtgcccaggctttatgggctcttgttgttccacactctcagggaactccaacacacctctgctgagggctgagcctgcattccttgctatgtgtccctgggagagacacagagcaggcatgaagccgtaccaccagctgcaggctgtgttgctccactctgacccccagccctgttggcctccacccagccaacctctccccttctccacacaggaagctcttgcgactcacttgtggggtgtttgttggtccttggtagtacagtgtttattgagtgagcgagtgtctgagtgtattagtcagggtggctgtgcactcgcaggttctcctttgtttatttaagtttgggatggaatccaggggctccccaatcccttcccttgatcttgtcctccatagagccctgaagacccagtgcaggggctgggtcctactgggcctgcttcctcatccggagggtctcagtgactcaaggccacacagggccatttgtgccttttgaaggttctcttagggttttattgctgtgaagagactcatgaccaaagcaacttttataagggtcaacatttaattagaggtggcttaccatttcagaggctcagtacattatcatcatggcaggagcatgggagcgttgaggcaggctggtgctctagaaggatctgagtgtttaacgtcttgatctgaaggcagccaagaggagggtctggatcaccctggccaaacttgagcacatatatgagacctcaaagccccgccttcgcagtgacacacttcctttaatgaggccacacctcctaatagtgccacttcccatgggccacgcacattcagaccaccacaaaggttttacctttgccctccctctgcacctcagtcctgacaacgtcagcttcagaacatgttctgtcaggttgttctctatacttgtgggggtctcggcgcccctgtaaataagagtttgtttagggtaggaatggcagttctccgaactcggaggaacccagagtccctgagcaggctatctttggggatatctggctgtaggctctgctgggaaatgctgtgtggccctagatggatcgctttacctctctgtgtcttgttctcatctatggaacaatgtaatgtcagggttgttgggaggagcaagaagctggacctgtgatgtgagagcagtctcatcccatacatgtcgtcagctgacacctggccttactaccgtgggcttctgaaagaaaaaatgggtcctagcagaaagaacagatacctgaagctccctgtggatcctttcagggtgttcctagtgctgtgacctgggggtgggggacgtacatggtcaccttgcccgtaactgatgagttgtcactggatactgcacgtgtgggagtcatggggagggtggcattctgcctctcgtggctctccaggctggggcgtgcgtgcgtgcgtgcgtgcgtgcgtgcgtgcgtgcgtgcgtgcgtttccccgtatccttcctgccatggaatacagaaaccatgctggtttctcactgtggtctgaggatcttagcagcagacttgcaaggggctaggtaaacatgtggagccccgggttagcctagagtcagcctatggccaaactccacctcccacttgcctttgtaaatcaagctttattggcatgtggccattcccatttgctcacacagtggcagagccaagccaggtgccttggaacctacaggctgtccagcctgaagtcctttagataagaacttgccagccagactgcaatgtgctggaacaacctgggaatttattttatttttattcagatggttttgagacaggatcttaccatgtagccctggccagcctttttaaaatttgctgcagtcttcctgcctctccgttccaggtgttggggtgttgggggtcacatgtgtgcaccactacttgtgactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaacctctcccacctggctggctccccagttgccctggcctctgcgttcaccgtccctcccttccccagcttcacctgtctcctgttttccctcctgcctctgctccccgggctgtagcagcagcagcagcagcaacaacagcagcagcagcagcagatggcacggagcagccaggaggagaaggaggagaaggagaaggagaaggaggccgacaaggaggaagagaagcaggatgcggagaacgagaaggaagaactcagcaagtaaggcctggcagctgcgcggtgcacacctgggcccctggggaacagagcctggcgccagtttggagccccagtcagttctcccaggcctttcctcccggaagcctcaggccccactctgtccatcccccaccctctctgcacacccccgcttctcccaccccccccaagagacctaggagactgattgctcatttgagccctgctccgggactcataaatccagacagccactttggcactcagccttgcctcccctccaaggcccctgaggtccacgagggagagagggctgaagggcctcgggagggcaacatggacgcaagcatctggcagcccccgccttcatcctcacccccatcagcacccgccaacccccctagccagcgggagaaggtggaggggccgcaggtgctgtgctgggcctgtgcacatcagagcctcctccttccctgtctccacggctccagccggcatctttcaggaagatgaatgagtgacagaggcgataaatctgccccagttgcttctgaggagccaggtccccagatcatgtgcacccccactgctgggctgggctgcaattccccacgcctgcagtcctatataccctgagcaaattgctctgtaggggtgcagaattaagtccccgtggctagtacagggggccacagagtcccgaaggcctctagctgggctccctgtttgtatggtgatggtgtcagcatctcttgaggccccgctggtgacaggtggagtcagatgacttcacatctgcccttcccacccacccctggatgagctcccgccacctttcagggttaaggtactgcggcaggggcctgcccgcccatagcacccttttagccagctgcagctctttcctctctgcagctgtgatggagcaacccaaaggtctccccagtggtcttggggtgtccatccccagctgatccatcccggtgtccctttcgtgacctcagggagaagacagacgacacttctggcgaggacaacgatgagaaagaggccgtggcctccaaaggccgcaaaactgccaacagccaaggccgccgcaaaggccgtatcacgcgctccatggccaacgaggccaaccatgaggagacagccaccccacagcaaagttcagagctgggtgagcaggctggggactgggggggggggggctggaatgtagggagattgtttcttgctaggattccgtgaagttggagtaaactgcccctagctgaggacctgggtctctgtctgtggggtttagataaagtatttggctaactgcgcttattgtgacccggagcgttctcccttttgcctcggtatcttcacatgcacagagagaaattatacacctaacaagaatataaagagaacctgggtgcaggccgagcttaggactgggaagaggctgtgaacccacctttccccaacccagccccatttgttgttttaaatcagaagattgggccgtgtggacatttggggtggtgatgaactgggttaagtcatctagtagaaggatagttctgagatggtctcttcacctttgtgggttttggtttcccttgccttctctgggtaaaaaagtaagccagtagggtgagctgagctgcagttccaagggcagccaccaggggcagcagtgcacactcatcctgtgcagtgagtgggtcatcttggctgcttgggtctcttcccaggttctatttctctagtggatctgaggtagactttcactcttcttggaactggcttgggctttatgtatgagctgctgggggcagtgtagcttacctcaagttatgatataattgggatttgaactcagctccgctgaccacaaatcctgtgtgggttttgtgggtgtgtgtcagctggcacttgatggcagagtgccagcaggcctgtgaggcagacctcatgtgtaagacagtcccatggcttgtactaggctgaaggacagaaaatacaccctggcctctctcagtgttccagaatcttctacctgtggcttgcaaagcctcccacgaaggtgtccgtggaaggacaggggactctgagatccaggagacagccggggcttggcagcaggaagggacacaggccacaccatgcctgtcacagttctcggcacacccctgtcagggactcacagctgggctacaggcagcaggtcacctaaggagcggtcagagtgtggtgtgtcatccagacaaggctgcctctgcccaccctgtgcctggctgcgtcccttctgaagggccttgttgtcctcgggtgagctagggagactgtaatagtcaccagcaccaaaggaggcctagccatggtgacgtcactcacaagccgaaagcaaatgctgaggagccattttttgagggtcatggtaggagacgggctgtgagcgtttagagcagaggttctcaaccttcctaaggcctcaaccctttaatacagttcctcttgttgtggtgaaaacccccccaaccataaagttagtttgttgataccacataactaattttgctattgttatcaactgtaatacaaatatctgatatgttgcccctgtggggggtcacacacaacccacgggttgaaaaccactgatctagagggttgcctccaaggaggtgtgaaatggcccgctctgcacaatggagtcccctgcccatgattcttcctttacatttgtgaccgtgtccctaggtgggcttaccccttcctggcaaagtgcaagtagaaacaggccatgacccagaccctggccacctgtttccttgtctgcgaatggagataccagatcctctcagcatagtgcgctgtggtgctgtctgtgtgtgtgtgtgtgtgtgtgtgtgtgtgtgtgttggtggtgggggggcttctgtacacagctactggcccctgggcatggggcatcaggcactgtggtaagggggggctggccagctcagagcagactgtaggggaagcactctatggaacgcctaccaatgcctgtcttctttgcagcttccatggagatgaacgagagttctcgctggactgaggaagagatggagacagcaaagaaaggtaaagcgacgtgatagtgtgcgccgtgtttgtttgtccccggcactgggatgcctggctcgcaaagctgctggtgcatctggccaggagcaggggctcttcagagcctcagttgaacctgccagagaacaagtctctgcctcgagtgctggcctgtacctgaatttagaatggcttaggagcctgtggtttgagtgtgcgaggaactacctcaactggtccctgaggacagtggccaaggtgcttggtggacagtcccctggccatcgaggctggccacagggtcagtggcacaggagggagggcttcctgtcttcacacctgcgtgtggctcttacatggggtctccaaggtccccacgctggtgcaggcttgtgctctgcaaacatttggaattggtgcctagcttttggtggtggtgtgttccacagtagaccagacagcagccataatagttgtctacatcacaaggccaagactatagattttcaaaatcagggagtcgttagctgtgacatgtgactgggctaagccattcacaccctgaggatgacatctcactgccaacaacctgctggctagacaggaccccttccccagcatctctctgagccttgacctttgaggggacgcctcctggggccctggtaacattagcatgacctgcctcgaaaccacactcattatgcctgaggccttcactctccagcttggtgacctatctctgagcctcagtttacccatctctaagataggagtgccagaatggctacaaggagttgaagccaccttaggatgagtggctttcactgagggtcccagagctagcaattgtgaatgtctggccctacctctcccatgtctctgagagaaacaaagccacctgctcacttgaatgtggcattgcagtgggctcctgccttagtttccacctgatccttctctgagatgtagctcccatttctgccccctgtcatggacgaggagtccaggctgaaggcctcccaaagctccagaggcgatgcccagtcctcttggctcccatcgttcacactctgctcagcccctgcccctgcccctgcccctgcccctgcccctgcccctgcccctgcccctgcccctgcccctcaggtgtggctgctctgcccaggctgcggtgtgcatggtgggaaccggtggcttttattaggagctctaacacacctgccaccactgccacctgcggctctggtcttcagacctgcttctccctccttttgaggggtttgccgagggtctaatgtacccagcaggagtgtcccataccacctgagagcagccaccaacctggaggatcctttaagtgctcctgcttctccacctggatgtgtgtctttcttgactgagccctctttcacccaagggtgggcttggcctgggggctgggccatcgctcaagaaggacagtagagatatctgttcacagggctctgagactgtgtctccagccggcttggtgcagtgtgccgtcaccccagaggggctgtgttgttctttgttttgtgtgtgtctacattgtggtttgtggtatgaattctaaaaactctttacgtaatggtctgattcccatggtttaaatctccgcaaagtctgtataacagacttgaccactgaaaagctgtctgttaacctgggcatcgtggggcatgactataatcccagcacttgtaaggcagaggcagggggatcataagtgtcacagtgagaacagtatcgtgttcatagcaagtgagaagccaggatgggctacctgagaccttgtctcaaacaaacaatacaaaaaaacccattcacctacatttacccacagtggtatgctacaagcttccacaccctagatggaaatcccgtacccattatcggtccctcctgcccatcagtccaagggcgaggcagcactaatggacttccggtctgtggctagaagtcattttgccctgacacttacaggaatgatgcctgctgccacaccagtccttacgcctggctgcactcacttagtgctgttttcagggttgttcgtgtatccatgagggctgcagggctacatgagccacgtgaagtgccacccctccagccaccccccccaacacacacacattacttgtgggctcacctggcaacagagtggtggattatttctaccgtgggctctgcgtgtttctgtggagatcatgtgacccctttgcttttatccacacgtgggtcctggggtctcagcatcctgactgcaaagtgttcatggaaagcatccatctttgtccataccctaaagatcttgcagcccctcaagcatcctcctgcctccactagcccatagctgttgccagacaccaggaggctgcgcgctctctctctctctctctctctctctctctcnnnnnnnnnnnnnnnnnnnnccactgtcccaaggttagggcctatagggagggctgggatctcgtccccactgatcctgggggcccgtgtgcactggccctgctcagtgacatttgaaatagcgccgtgagcgctggcgcgggctgctgctgtgaattacagcaatctggacaattatggctgctcgcggtggctgctgatggctgttccggaggcgggggcggggaggcaggtgcgcacagcccgtggtagctccttttccacagcctgtgggggtgagaggctaagaatgttcccgagcaccctgccgagagagtgctgacaactcagagaggaaaatgaccccagccaagctgtgtcccaggcagatggtactcacccatccttggcccagtgcggggtagcagcccacagagaagcaggccctcagggaaccccaggcaggtaagcaaccaggtgtccccagagccaccggagcatcctccttagcccagctgtgaaggacatctgtagaagcatccagcccccagagcagcccagttggatttcctgtgtgtgtggtctagaccagtcactttcttcgtctatgtaactggtcactggcttcagcacaataggaaaatttttctctcccttgcccaggaagctagaggtgcaaagttgaagtgtgggcaggaccacgttccttccaaggctccaggggcacctacatcccacctctggtggtggtctcatgcttctggcctccttcctgtcatggccttaccccacccccacccgtgttcattaggatttcccttttccttctcttctcttttcttctcttttcttctcttttcttctcttttcttctcttttcttctcttttcttttcttttcttttcttttcttttcttttcttttcttttctccttcccttcccttcccttcccttcccttcccttcccttctcttcccactcagaaatccgcctgcctctacctcccaagtgctgggattaaaggtgtgcgccaccaccgcccagctctttgtagctttgaacttgaaaggtgcccgcctctgcctcctgagtgctgtgatttaagataggtcccaccacacatagccacagagtccttcttagttggcccaccccagcagattgaccattctggtccgttgtacggtctgtccctgtgcataacttctgggtggacataaaacttgagttgggactattgcccagctcagcgacatccaagtggctttttgctcaggagtcaataattagtcaatagctgaccttgacgtcctgatgccttaggcatttgggtaccttgctccagccccgtcaccgctgcagctcctggtctcatggtggcctccccatttcagcctcattgtcattttctctgtagaaagggcagggaggtctgccttccaggttcatcaacaggataggagccaaatgtttgcagtacttgatatacaggtgggtgctcaggtgcagactgcagggcagctcacaggctggattggagtcccaactccgcctcctttggaatctgccctgagtgggtacctatagcatgggctgatccttgcctgtgtgctaaggggtgggatgcaggggaatgacttgccaagatgttgctcagccacaagtgaaacgagcttactgtggaggcaaatgctttacacctctggcctgctttgaggcaactgctattatgcagataaggaaagaggcccagagatacatggaatgagctacccaaggtcgagtagctgtgatgtgaggggtctgggtttggaacctgggctcttgagttgcaaaacaggatgtagtagtgaggggattaaattggttggtctctaggctactgctttaagtaatgaaggcagggcaaccagtggggcagatagccctgtgagggacagtgcgctcaagtgagacattagaaacccagacagtgcgggtgcgagaggcaaaagtggagaggccacagtggcatcggtgacaaaggtgggatttcaaagggatggaagggacctggagttggattctggctacctgatggcccaagatctttgatctttctctgtgtggtatgtgtatgcttaggggacagtgctgttttcctgggctcacacttgggtggggcctgagcctgaactggaagctgcctccttagggacctggcccctgcctgccttaggacaaagattacagttgtggcgtggagaagtgttgggggcctatagggttgggccaaacgccccaagttccctaaagagagattagcctgaccctaaggaatcctgaccctgggcagagccagtggttgaagggtagtggcttagaccagggtcctttggatgtctccagtgcaggcgatggagtgtatgctcagtagacacactctcccttgagagccctgccggccactggatgtggtctggttgagtacctaggcctggtggggaggcttagccactgttctgttagagttgatgctgtccccattgccaggtcaggctgacctttccaagagtgcaccgtgtgcctcgttggggaccctgcacacagcagtgaagtaggctggccaggtgagtagtgtggccagccagtggccagtgcactgaggtcaggggccatgagcgccaggctccatccaagtgaggagatgatgggagggcgtggagatccccgtaggcaggatggagatggtcccagaggagcgactggagggttttggcctcttgtgttgtgatgattcccagggagaaagcagggctcttttatggattgaggtatggccagacgtgggtctggctctggactctttcttgtccctaatcaatgccctaaaggagatgttggctccctcctttcctcactctgggccagcatctgactcttgctagggaaggagaggtagtgaatgacccttgtgaccccagtttccacgtgcagcatgtttctgctttgcccatgagaagttggcatggttgaggagtatggctcagtgatgtagccagccaagggtctgggggacaggacattctgactctgcagaccaggctgcctgtggctctgtaggtgggcagctggccttagggcaagccctgatgactttgtctgacatggtttgaagtacctcctttgtaccagtgattggcaagtacagagatgctgaggtctgaagtgtttcggggagaaggtggccgaggcaggttcacagatgatctcacagggctccctgtgccccccatgggatactgtcggtccctggtccacttgtactgaatgatccaacacttaatgaactcagtgaacgcatccatcacttaagtccagagcaggctcaacatttcttaaggaaggaggatgtggctagaggcctcgggacagggagggcacgtttctccgacttcttgctctggtagggttttcttttgcaagggagtctaagaaagctgcttcaagggtggaggttggggtggggtgccctcctaagcttctccctgagggggatctaggagccccagacagtgggagagcctgttctcccatgtgttaaatcagaggcttacacacttgctgagctcagacccctgtggaggggattggggactggaacagtcacagcccctgagccactggagtgcttcatgggtcccaggtagagcatgagaaagggtcacctttggccaccatttcgcccctcccctctgtggcgactgggctctttcagctctctgccagcttcaggccccctgccttgacttcctgtcttggccaatttcacttcctaagtagctgcctctgaaattccttccttagaaattagtggggtgggagaacccaagaccgcaaggcaggctggcaaaactgttgcaccgagcacacaggcccaacactcccaggacagacattcaggggatcttcatggatccctgcctctgacactcaggagtctagagctcctttttgagagagccatttgcagctcaatcaaaacccatgagtgtggaacaaagagctggtctttggggagtagatgctatggagatgagaggccaccctacccccatccctagagccagccgcagggcccaaaatgctccttgggcagatgtcctggggccttctctggggttgggagcagtagagctgtctgttctctgtagctctccagccttaggagctttggggtgtccttccaggagcaccctgacattttcacagggggtatgcttgcataggccccctttggagttccctgtggagcacggtgggattctgtgggaatgacctgtgtcctcagcaggattaggaatctctccaccagccggccgggatacagggaagcaccatctttctgtccctgtcccctggacttctagaacagaatggaagggcaagggctagagggaagagttggttctagaagtcaacctgacgggatgctgctctaggaggctgcttagttgtcttggcctcccgggagcccttgggaccttgcagcaggtgttctcggagaatagaggatgtattaggtaaccagggtccccagacccttggccagacctctgggagtcccatacctcccccccccccaaatggctgtggtgttggagtactcctaagtacatcccaagttccccaccctccacccccatagaaagccttggccacccacagccctccgagaggtccaggctttgggggcctgtgaggaaagggggggtgcgaccgcaggtggaaccggctggctggcgggagggctggctggcgggcgggcggaagaggctgcttgctccctgcctgccgggggtgggagctctgtttttctggatccctcagtctgttcttaccgctgctgacgctgccacggatggggagagagggagggagcctgtgccagttggcccgcccagccgaacctgggcctgtgcccggcccccgcccgcccccgcccgccgcgtctggaggtcacattcagtcctgacgcggctcgttgggtcaggcagcaagaagagccgcgcggagccctgggtcccacagcccagccgtttagggacacggctgcctggccctgtcttgcccggggcttttggatttcttgtggcttggtgggtctgggggctccgggacagcaccctcaccaagtgtcctctctgagacactggtgcctggaagatctgcggacgccgcgtgcgcactggtgacgcctggcacagagaaacccagcacacagaactgacaacttcccgctgctgccgtagccctcgctcccttcccaagcaggaagggcactgctctgttctttggggcagctggtagctgcagccggaggagtcctggggccatccccagtgcctgcttttgccctctcggctcctgaggatgtgaacagaggtagaaccgggggataccagcaagaagccctaaggagccttgcggccacagcctcctaatcaccgctccgctccctggagcatccttccagccggatgtttccggaaaacttggccgagggggagacgcagatgagaggatgtgagtggtccccagctggcggggcaagagggtggggttggctggtgacggggacttctatggggctacaggaaatttcagctgcacatgtggtggtggtggggtcttggaattttggacccgtggcctggcgctccttcttgcctttctagggtgcagccaagatcccctggaaggaggctgtacttagtcttagctccaagcgtgcctggggcattctcagcggggcttccccggggtggacagagcagctgggctgtctctacgacacgggatatgaagtgctcctgtgcacagcaccctaatgtaaggttcctagaacaagagtagaggaagctcctgtctccccagggctgtgtggcacactctgggaagggcctccccaacagctctgcccagtgctcttccctgaccacacgtgttcgggaacagctgagcgtcatcccccccaccctgacagtttctagcttttataggctgagttagttgggagacccagctgttctgactccctattgacctaactgaatttggaaatgtctgttccccggggtcgggccaccctcccctcccaagtcttcattgcaccccacccccaacagctccaaatggagacctgccctggggttccgggcctgcgatccctcggcctgacgtgtttgttgggccctcttggacggcactcgggtaatataaataaacgcagccccagccgccaggttctggaagtggcagctgctgctggcgcgggtggagggaaaggtcaggggctgagttacacttgatcctgagccctggccctccctgcctcctgtccttgaggagccctgagaagctgctctggagccacgtggctcttgtggtcactgtaggccagcaggtggcctggctatcccgcacctcccccaaaccatggcgcgtccccctcccccccaatgctgctactatgggaagctgaggcttcagacccactcctgagctgggtgaggtgggtgagaaacttcaagaattccagtcttgaccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtggtaggaaatgggacttagccttgtcacaagtggctttgaagctccgccgaagcgccggcctcctaacctccatccccaggggcaggtttctggcactgccatgggaaaatggccagctttgccttcaagggagctggggctcattgaaggttgctgagggtgcacagccttctagtatagcccaaggtttgtagcctcagagcttgtgagccatgaggtctgtggccttggggaggggttgaggggggcctccgcagatctgaagattgtcccaccatgtggtctcaagctgtgacttgagacagatccacccgtgactgctaagtgccaggtgggccctgagtctggtgtggctcttgaggtgtggggggccccaagctcaccctgctcccctccccagctcggccttgctctgacctgagctcttccagggctcgttccccttcacctatggtgagaccggaaagcgggcttgttctcctgaggcctcactgcagctgtgcagtgtcagagctgggtcaccacagctcccgcccaactggggagggaaggatggggggaggctgtcttctgccccctagaatcttaactgtggcctcgcttggggccatgcctgttactgtttgtttcctggtccctccctggctgtgcccccttggctttggacggtagtgaaccctcatctgccctccacctgtaggcctcctggaacatgggaggaactggtcagccattgcccgcatggtgggctccaagaccgtgtcccagtgtaagaacttctacttcaactacaagaagaggcagaacctggacgaaatccttcagcagcacaagctaaagatggtaagtctggccagaactcggtggccacgtccactgggaactggggccagccaggcctcccacagcctcgctcatgtggcccctggctgcctggcatctgcatggggagggatgggtgggctgggccctgactcagccaggaatcggacctggaggtcctaagtgagcagcttcgcttctgcttggctgcccttttgaacagtcgggctacagggacagggaatgagggtcccagaagacagaggctggaggaagacttggggcccacactgacagctgtatctctaagcagggccttttttacatccatggccaggagggccactggagccactgcactgccttcccatgatcctccccaaccccatcttaacgtcatcagcctgttagggctggggaaactgaggaccagggaagctcttcagccacctaagtgggtgtatgaactcagagccgagtagctctaccacctctccaatatcccgccgtggtctgaggcttgtgaaggacaccttgaggcccatcgttccctggctttaaagttgtgtgggttcctgtgcagtgaaagatgtattgctctttcctgagcctcgaggcccagtgcagggtacacagcagcacagggtgcggtagagcatggtccagcagccagagacacagcattgctccattagggctcctctcaagacccatgtggaatccagggacacccttgttggcccaccctcctgccccagctatttcttacggctcgtgtcccccgaacatatgactgcccaactctccatgtctccagggaactgctccctctgctctcaatgacccccggtgggacagtggacccaaggacatagtcatctaaaaggggccaggtctgagcttgtggtctgagcaccatgtgacctgaccagcttctccctactgagccacttctttagctagaaagtaggtggaggggacagtgacactggacaggaaggaggtgcccgtgaatgggaggccctctgtggggcttcctgcctgcttgctctttgtgatacccctgtcactgatgtcatagctacccatcccatgtcctctaggtacctgaagcccttgcgatcactatgcagcaattaccaaggggctgtctgctgataggtgtaggggtgtgtgtgtgtgtgtttgtctaggctgtgccacttacaggctgtgtggctttttagctaagagtcttatctgctctgtgcctcagtttctctgcctgtgaaatgggaaggataacagctcctcccaagtgacagggcagtacttgaaaaggggacactaggcaattcgccagctccccaccagctaaagccagatggcagagggctcagggtctttgtggtgtggtatgtctatcccaggtgatagatggatgcaagcctgcgtgcatggagtccctccaaaggacatagggctctgcccggtgggagtgtgctctggccctgtagcttgtgctcagagcgcacagcctggcctctgggcctcagttcccacctgcttcaggagtgtatgaggagcaggtaccttccactgaggaaagtccagtgtctggcccaggtcacagagtaggacagagtttgtgtatagtgggcaaaggcgtggttggagtgtctggaggagcttactacttagtgggatgtgggaatcatggtgagctattgagctgaggtgactctggtctgaatgggatggaggcaggctgcccaggaaaggggacccctgccccgttcttagctttgtcattcaggtggctgccctggcggaggcctgtagaggaggtgggctgattctctccccaggcaacctcaagagctggctggctggtcctgaggatcatgataagagcagtgagcagaggcggaggcccctgaagtacagagcgagtaccgtgttgtatgagtgtatgagctggcctgtggcagcccctgacctgggctgtctgttctcacccactcggcatcaggctgccactgtaaagagggtaggccaagctgcactaaggatgcttgagcccggaggatcaggagttcagggccagcctaggctacaggaccgtgtctcaaaaagaaaatgacaagaactaagaggttcacttctgttctctgagtcctgaagcagtggctagggcctttggctgctggcccggccccgtctgaaagcaggaaggcatgccaccctcagccacccagagaacaggggaggcaggaggtcagtgggtgtccctgcctctcatcccaggcctggcctgcacatggctgctggagactcatcagaaaccgggagcttgggcggagcctgcatgtcgcaggttatgtaacatttggcagccttgtcctctctgaggtctccctccccctccgtgtggccaaaggctgcccttctgtctgtgtcctggccctcagggctcggcctccaggttgctcagtgtgtcatctgggcgctggccctgccggccttgcttccttctgctgtcttctctctgtggctgctgggagacgctccaggcagggatgtatttgaactctggcaggcgggcctccttgactctgcgctttgtctctctgagtcgtcggtgtcatcctctctggtgttggctcatttgtggaatgacgtggttatggagtgtgtggtggctctactccagctgtgggagggaggcagttggagcaggcagaggtcccagttgacgaggaataagtctcgtcaagatgctgtaactcccgtaacttccagcttgtggccccagaggtgcggagacagagatgcagagagagtgagggtttttgcagagcattggttaatcccccagggaaatcagagagggcctctggggagatgacgttgaaggaagtgagtgttcgctctctgggggaagggtgttcaggcagggaacagcctgtgtaaagtccctggggctggcgtggggcctggagaagcagacttagactaggcagagtggcaggactagtgatctggagctgatgtcaagtgttaggggctgcctggagtggtgacggctgtgtggcaggcagggtagctgtgtgtacgtgtgacttgacgccttgcagattgctggtgtgcagtaggtgcttaggaaatgccatctgtgatgtgagttcatatctccaaaacagcgcttacacacgcctaccagccctttgtcactggggctatacagggccgggtgtcccataggctctagaaacacagggtgtgctctgtcgtctgtccatgactctgccaggctgatgggctcccgtttcctgtgagtgtccttgcaacctgctgcctagttcctgttgctaaagatagacgaaggaaggggatccccagccccatgccacagcatcctcgcacccgcagactggagcctgggcctcttgggaggtgccaagaccagaccctgtgtgggcgggggtggcaagtcaaatgtccacgaggtctgtgtatacttagaacaagtctgtggcctagtattggcaatagagacagtgatggactgacaggcatgcatctgccttttgttctgtgtcccaggatcctgggacaatggacacagcaagcctcagagcatggtcctgctatgttcccaggacagaatgtcaccagtgaggtgtagcagagctatggtctgtcaccagcttctgaccttggtggtttttttctaacctatgacccccgctgccatcttcccctgaaagagctggtcagttgcagcatgtctccacccaccacaccccttccctcctggcctgtgctccgctcggacagccctgtggatgttgccagaccagcacggagggcatcagctgagatatgagggcgcctggaccacattctgtccctcatactagatcaggcttaccccaggctacatcgtttcaagactagtgcatgtcctgactgctgctttgaatcccaagcttagggaagcctcggctgctctgggcttcgacccagctcagtggaggatcacggaagtccagccaggggagggttttgaatgcttctgtgctgggagggtgatgctaggccctgagtgtggggagtagaggtggtttgagggaaaagcaagacgacagtatggctcatccacaccctagagcctttgtaaataggcgtctctcagccagagccttgcccgggtgagagaggcttaccccatgctagatcatttttccctctgcactcagacaaggactccagtgtcgattcctatagaatcctgatcacccacccagctgacttggcctgtgccctttttttttttccccatttgatcccactgtggtccctggccagtcccctgagtccaaactttagggtgtgtgttgctggctttggagggtagtggccatgttatatatccctgagtctgtatccacagcccctccacttgtgcctaaagtgtgcactgtgacactgtggcctggcccagcctgcacccagggtcccactgggacacaccgtgctatgaagcgtctatggtaaaaatagctctggcctgcatggccactgccacgggctgagtgggaaggctacctacccacacagccgtgcagccaaactcactgctctcgcagccgggaccaggcctcagacatagggcgtccccagccgtgaccgctactgtcctgtcccaggagaaggagaggaacgctcggaggaagaagaagaagaccccagctgcggcgagcgaggagacagccttcccacctgccgctgaggacgaagagatggaagcatcaggcgcaagtgccaatgaggaagagctggcggaggaggcagaaggtgaggtcactgttgtcctgggaggtggggacggaggggagggggagtgaacgcgcacgcacaggcacacgcacactgtcctatgtctccatcttctaggcatccctgctttcctgggccaggcctagggctgagcacagaggagccctgactagaccccaggcttctggccccagatccccatagttcgttcacctgctttctccataggcctggcataagtcgtctcagcatcctcggctgggccctaggctcttggttgaggctcccagccaccctcatgagcatggacatagacagcatggaggggaagtggtggagacagagctgcccacagaagaggggagtgactgtgagccccaaatcctggggagggggatggttacacatctgcttaggagcagagacggggccagccgaggcctctcaccacccgagaattcttggggcagctaacctctcccacccaagagcaatgggctagaaaggctgaggtccaggctagggaccacttgacctcagacttccttgtgtggtaacagtcatggcagccatatatggccttgtctctgtcaccacaggccgaggaggtggctgaggagtgactgaggcatggtggagtcattccaggtccctaagacctagtttggcagcttggtcatagccctctgctctgtgtctctttggcgtccaggggaaggggcctagtgatcttcctgttacttgatgtctgggtctgtaaagtgcctactatgtccaggctctgtgaccatgcctggggcacatgggtgcctggtggaatgcctcagtgcagagctgggcctccagccattccttccctgcccaaatgtagtgcttaagggtccagtcacagttgtcacagtcccttcatgtctctgagggcttctggtatagacataactaactgacagcaagtcgtagacaccaacactcatgatgggggctggcctgcttgtccacaggacttcagtggctttggcctcctgtgtcctgtcgttgggctgctaaaaggaagaccagaggccatggcccacttggtggcccaggctatgtgatttcctcacctgtcattgtgcttcttaagtaccctggtcttgaggtctctgagggtcacgccctgtgtgcttggggcctgctccctgctgctgttaccgatatctgttccaggagagctgtcaagctctgggctacaagggtactgagaagctggggaggctggggactgactgataaggctggaaggcacattggttagggcctcattggtttgtagccctggcactcacacacacctctgttgaccctggacataccttgaccttgcactggggcggaggggtgggtggccagggcctcccttgggagctgagcctagtgggtctcatggaagctgtcttgggtcccctgccctctgcgagtcacaccctctcccctttgtacagaatttgctgtaccgccccagctctgactcctctctaactttcttccttccagcctcacaggcctctgggaatgaggttcccagagttggggagtgcagtggcccaggtaagaatgtagcttttggctgagttggggggcatagtggagtatccaagaccttacatccccatcccttgtccttgggtgctgcttctgcctctgcttttttcctcctacaaagtgtctattccccgatgcaactgtgggcagcatgccctccctacctgcctttcctctctttgggacccttccctgtcccctgtcctcagccttgtctccaggtgtctagtttgcagaaaatggaggaacacacacacacacacacacacagcaccttaaacccatgggagatggagcagcagacatactccttcaaggaggacttcgatgcagtggccctgtatcatgctgggttgtcagccatattgtaatgctttcatggtccccgggcctaaacatggctctcctgctcagcatccatggaggtttgcttcccccttctgtggatggggaaactgaagcttgagagaagccctgaacttcccattggcagtaccaaaagttgggcactgagctgagtggcgttcagaccgtatctacagacctccgatgaaggcctgtcttgaggttgtccttggattggccttgtaggggcactggctacctaaggattctaggggttgggtttggtcagtctgtgggcagcgggaaagagaagccaaagttgcaagctataagggctagtgagggacaaggctcaccgggagggtcatagcctggggttgttctgctattccttgagagggctgtcacatcctatgtagtagctgatcctctcttttcctcttatcctgcatgtagctgctgtcaacaacagctctgatactgagagtgtcccatccccgcgttcagaagccacgaaggacactgggcctaaacccactggcactgaagcattgcccgctgccacccagccacctgttcctcctccagaagaaccggcagcagcccctgctgagccctccccagtccctgatgccagtggcccaccatccccagagccttccccatcacctgccgcacccccggctactgtggacaaggatgaacaagaagccccggctgctccagctccccagacagaagatgccaaggagcagaagtctgaggccgaggagatcgatgtgggaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgactccagtgccacctgcagtgccgatgaggtggacgaacccgaaggaggtgacaagggcaggtgagaggcatccggcgagctttggctcttgtgtattctgcaaacacggggagcaccctccatctgccacaacacaggtggccctgcctaccatggactctgtggctggtttgtaggggtcaacatgagactgagaccagaaatcagggtgtcttagtctctgttctattgctgtgaatagataacatgaccaaggcagttcttccagaagaaaacatttaatccttggctggcgtacagttccaggagaagtggttgagagcttagctaatcctcttccacaggtgaagagagacacagtggggaagggagggaggaggagagctttgtacactgatcctgagcctgacttgggcttttgaaaccttaaagcctgctcccagtgacacattacctccaacaagaccacaccttctaatcctttcaaatagtgtcactccttggtgactgagcattcaaatatgtgcagggacacccttctacccatttgaggcaacctggagctaagatctggaagggcttcgaaggtagccatagaaggctccagggagaaataaatgctggtgtcctccagctgtgacacagaccaggtggtgtgatgtagcagcgtagttggaggtagaaggtccaaatccaggtgtcctggagtcacccatactccagcttgaaacatctttcactgatgatggatgcctgtaatccttggcttatggatatagcactctgatcttagcctccatagacattaggttcccctgtacctctctgtttaaattcctgcttccttgaaggttgccagtctcccatgacgacatcagcatagcttcctgacaaagtctcacacaccggggcccagacttagttcttggacgcagggatacagttcttcccttctgtggtggcaaaggccatggctaggagtgaacctggtgtgtgcaatggggaccacgtcatgggaatacaaaaggccatgtattcccaggatgttagacatgaagactgctgccttcaaagggccaggccatggctgagggggtcccagtgagacagtaaagatgccagctatggggcagtgattgagataatgtcacccaggcccagacactggaggcccctggcgtgcggtcaccccagcttatctctgaggtggtagcacatctgtgaaccattctgaatggtacattccctgccctagggacacactgtgttttaggtgagaccatctgggcactgaagaccaggtctggaaacctctccccatcacatctggacagccccacccacctctgggcagccgcggatgctttgtgatgaggcagtgtgctatgtttattttgactgcaaacagcagagtctgttttctcttccctcaagtctctgaaaaattccagcagagcaggggaggagaccatgaccttcagaccggcccacacagggcccttcctgctccccctggctcccctctcccctcaggcctggtggatttgaaatagatgctttgtagacctttctatattccccgaggactccactggtagggctcccatggagcaggtggtcaacagatggccctggataagcagaagatggccagcgggcttctgagagcccccatgtccccagcttcttgcctgataggcataacaggggacatagggctcacagcagcttcagtgccaccagggtccacaaagccacaggtgtctctagcttggctctttggagtctggatggtagaatcatagagccaggcgtggggtgccaccctgagtaccagcccactcctcaaacttctgtagactctggtcaggctgaggcctctcagttccttctcctgtagcactagccagtagtttccctccctccctggtgcttgctggctgtccaccttcgaggcttgctatctagcttctaggctgggactcaggatactgtccctgccctggagcacacctgagctctcagtgagctgtgagacttcctggggggaaagctgaccaccttccacagccacaccaccaccacaggggcccaggggagagtaaagtgaagtacaccagcaggccccagcagcctgagctgctttctgtaaaccctgcgtgttcacagccagccctacaggcctctctaggagagctctgctgctcactgctgctgtgcctggagccagttcggcttggagttggcgaggagacttgcagccttacctcactttcagagtagggcccatggtgctttctagtagnnnnnnnnnnnnnnnnnnnncccccccccccaacccccaagttcagtctccatattgcaaggggtgttttgttagaaccataacccaggggccaggtacacagtgtttgatgcagcctgtgctgggctgagatggttagatgcaggaaccagcagggccctgattccctgctgctctggcgctggtgagaagaaaggcatatcgctcatgagccatgtggatggtatgtgtgactcgaagcaggcaagccttagggatgcttattgctcttagtgtagagaggaagcctgaacacagggaggagccagggaggacaaaggccctggggcctctgagcttaggcctctgagtttacggttggtgcttctcaaaggactggagctgggaggccagtgaccagtggggtttttgtcttgggtcctgtgaaggccagagatcaacacttttttttttgttactgtctctaattgcatgcctgagtttgagtatgtgaacatgagtgctggtgtctgtagaggaacaaggttcaggtgggttgtcatccacctggcatggcttctgttctctgtaagagcagtgcacccctgagccacctctctgcctcctttatgtatgcatgtcacatttttgtgccgtgtccacagaggcctgaggaaggaggccagaagagggcatccggtcttctggtattgagccaccttatgggttctggggaccaaacctgggtctctgctctttaccacagagccatctctctagctctagggtactgttctagctttaagcctgcctggagataatggagaaaccgagggacatggtccttgtggagaaggtcttagttcccaggcgtgtaaccatcacgtatgagaaatgcgatttgaatctcagcagaaacgtatttgcgtatacacgaaagtccacttctctattgctacacagatggggtgacgatgctccccagatttactgcagcagtgcgccccctccacctcagcacaccttgcccttggtggctctagagagctgtaactcacttgcgcagtcttgtgacgtcgggtgtcttcagtgtctcatagtgtcattccagaccatgccatcacccaaggggagacccccacagccttcccagctgtgtgtatccactgatgggaatggttcgatgtcctgtgaagggaacagggcgtgtggtccctgtgtctggcctcagggtcagggccccgtgacttggatggcagccccctcaccaacttgtgtgttctttcagcatctgtctatgggtatctgcatgactcaagtagttggctgagaacactcacaagctggtttctctgtgttcttcatttcttctgagaatggttcagctcactgtagggttagtggggaagccttgttttattttagatgttacctaagtgggattcactatgtagcccagattggccttgaacttgaggaatcttcctgctcagactctccagcggggtggaatgacaggtgccatgccaccccacccaaccagggagtgattttctgaggagttttttcaaagcctgtgtcgtattttatttcaatttaagtttatcaaagttagtcataaaaatggctaggggcagccaggcacagcagcacgcacctttaatcccagcacttggcagatctctgaggccagcctggtctacaaagtgagttccagaacagccagggctacacagagtggaaaaaaaaaagaaacgaaaagaaagaaagaaggaaggaagagaaatgactaaggcggggcagagctagtggaacacatgaggttgggtgaggatggcagcaggaacctctgccattggggtgggacaggtgggacagaagggatggaggactcaggatggcctgttcttcctgtgtgtcccccccccaccaccaccaccccattgcctcaggcagctttagcaggcttcatcctgtctgtctgctctccctgcctggctgagcttgtggcagatgcagggcagcaggctgctacccgcagggcttattgcatgcatactttggctacagcagagtctgtgcccctccatctgctgaaggaggcacgcacgctcttctgctgtgtcccccgtggtcctagctgtcaggaatcctcaccccaaaggctgaaatgaagttccagcttacatggcttcacgtaccttgaaccaggatggtctcagtccccacgggtacataggtcctagtgttttcaaggaccttcccgagtgtttgcccctatccaaattcaagggctgtacccatatctcatcccccatcactgaggtcatgaaagttgcccaccatccaggacaggactgagcccagagacatatttggaccgaatacacacgggctccaattagtagagtcatcctcgccatcccagggcccagcctgctcttgctctgggtttgagagaaaaataatctccaaggaatctctctgtccctccaccctgatccggttgagtttgtggcctttcggccactccccgagggcctgcatggcccaggcgcccagctaggtcttttcagctgctgcctttgccctgaggccatcttggagcagtgttttgtgtgggccagagtagtgccgctacccagcagtgtgtgttggctggggcacctggactctgctaagggcctctctggcgggccccaccatccaggacttgaaggagaagccatggaggcagggctgccccagccccctctcccaggaaggccctccaagagcctgtggctgatgctccagcctgacctgacacttgtccctccccaggctgctgtcaccaaggcccagcctcctcaccccggctggagatccccgggccagtacctcgccccagaagccgctggacctgaagcagctgaagcagcgagcagccgccatcccccctatcgtgagtgagccctgaatccgagcagcccaccttgaacttctattctcctctgtgctcagcattgctggttggagctttgcctgtggagggaggctcttccccaggctagcggctcccagagatggagatgtgtacacaggactggataggcagtcctgggaggagttgggagatcgggaaggctgggctgagcagctgctctccagaggttcccccatgcttcagaccaggcagctgtggccagcaagcccccagacccaaggacacctcagccaactaatgtccaggtcctttcaggtctgtctttggggcctttgggagctcgccattgtctaaagacacttggctggttttagtcccctcagccatttcatttgaagatttaggttttgcctttccattgaaggcagcgaacagttcatgggggtccaaactggcctgtctgtcaggcttaagtgttggacatgtgtctggcttcacttctagctccccaaagcccacatagctgctacttcttactcctgatgtggggtgtgctgggtggcataggggatcctagcacctgcctggatctgggtgtaggaaacgggcccttccttggcaatgatgaccccctccctatgtctgatgttaaggctctgcctccacatgggggctttaaatggggtgtggctgcctttttatacttggcttttgtacgggccacacggccactccccaccctgtcaacctctgacatggggccaggatgttcatgcccgcccccatgccccccagcaggtcaccaaggtccatgagcccccccgggaggacacagtacccccaaagccagttccccctgtgcctccacccacgcagcacctacagccagagggtgacgtgtctcagcagtcgggaggaagtccacgtggcaagtcccgcagcccagtgcctcctgccgagaaagagggtgagtgttgggcacagggatgcagtgggagtgagaggcagccctcttctctgttggggttccttggcaatatgggccaggctgggaggatacattgttacggcagcagatgacagggctcaaccacagctgcagaagcgcctccagctggggggcttcttgagaaaccagaggcaatctagtgttggggtgtggtatgagtgtgtgtgtgtgtgtgtgtgtgtgtgtgtgtatgcgcgcgcgcgcgtgcaaacatacacgtagccagcttctcctgtgtgaatcaggtcccatgtgatctttgggttccctgagggtgcagtgcagtccactgtcttagaacaacagcaggactgacctgagctgcccgggctagcctttccctggctaaagcatggcctgcccactgtcgacaccccttcatcggcagcccagagcctcctgtgcaggtagtgggcagcacctgccagggccccgtggtatttgcacatcagtgcttctgagcgctagggttgtcagagagagataaagcactcacaactccagttacatcttactcttaacttagtgggaaacaagtggggcggggcgggtgtagggcaggcacaagtgggctgtgtgtccgacaaggatctggtgaggagaggaggtgatggggaaaggcccttcacggactgggagtgggggaggaggtcaaagagggaaatggggaggaaattgtgtagctaaggaggatagtagctttgagtgacagtttgctttgggaggggcatgtcatcagattagcgtcttgggggaaaaaaaatcagtgtctgattcttgttgagaaagggcagaagggagtagggcaggggtgggaggcgggctgaggtgctcctcccaacagctctagggcagcctgaacttgacaggtggccttggaagtgggaggaaggggaggcttgagtttgttcctgaggccaagccagtgggacatagggacatagcgatgacccctggagcatgagggcaggggtgtcttgttggagctgggtttggtgcatactacagtaagggtgggctttaaggggccaggtatatagaacacagtgtgctgtgagaagccacccggactcaagatgacagcctgggatgacagttagggaaggggaaaggcgctggtctggctctggccaggcagctgtggctgagcagggctggagccacccagggccagccaggtcttgctgggttgggccctaggccccagtccctgggaaaagagccagcagtcagtggtccctgaggctggttctgggcccatccttgtggccagtgctacgttgtttcctagactcctccctggggaacattgcacctggcggcaggctctgtctctcacgtggtctggccacagttctgctccccaggggacacatgaacccagcatgcaggaagccagccttctctgtcctggctccaacagggagcttccaggccaggcaggtcccttgggatccccaggcccggctggaggaacaggttgtctgtcctggctctcagccacctgcctgcattggctgagtctgaccccatttccttccagcctgagacttcctctctgtccctagttctccagagccaagctggatggggcagccaaggtatacactgggccaccgcaccaggtgtttgaacttcctggttcagagcaagccctgtaggttgagaacgtgaataccactcaggttactttggtgggtcaccacctctccggggcatgagtttagggggagtttggtctcccgtaaaggagagatgtggagtgtaccacttgggcctctgctggggctccagctttcctggaggacagcctaggactgtatggaggtgatccgggaaacccttagctgtcagtttctgttccaaggtcagggccagtatcattcagggttgtgattccccagccaaggcttgcagctcagaacagatggcagctaaagccagagcttgtgaagcctcagtgagtgctggcctgtctctgggtgttcaacacctgaaagtcacaggggacctgagccttgtggcacagccatgggcacaggccatgggctggagccagctgcctgcgttctcaggtctcccctgcactcagcagctggggcctcagtcttcccatctggagggtgaaggaacagactggctgtgacatccgaaacagtgctaccttttgctgttgtttgtggccacatgggctccaatccagacatggccatatttggcaggtgaccgaagagacctgatcaaatgggtctggtcactgtcctcagtgtaccttacaggctcatcaaggcccggctggagctcagcctagtgaccagtatagtagatggttagcgcacagactgcctctgccccatgctcatctagaatgactgctataaccacatccattggcagaacgtgcagccagggagggcagcaagcctgacccagcactcttggtcctatacatccagctggtggcattctgcggggaaccgtgaagcaaagatcagccctctgacacatggcccctgtggtgcctgtccctgtggtctggccatgagccagtccactaccaagcaggtagcatgggaacgtagcagcacacctccactgacctgtcccagcacccctcttgtcagggtcctgtcacagcttgccagtggtgtttgagggtatggagatggcagagccctccctgactgcccaccttaactctttcagcagagaaacccgcattctttccggctttcccaactgagggcccaaagctaccgactgagcccccacgctggtcatcgggcctgcccttccccatccctccacgggaggtgatcaagacttccccacacgccgctgacccctctgccttctcctacacaccccccggtgagtggacagcgcaccagttaggtctgtgcagtcggtgggcagccaactctttcagtgtcgcagggctgcatggtgccgatcggatgagaccttggctgaaggtgtgacctgctcactcctgtgaagctgggcaccttctgagactcgggaaagcttccgcactacctgcacggccataggcagccttgggaggaacttgagctggaaaggggaggccagcgtgggaggtattttccaccagtgactaagaggatggtcattagagggagcagtgggcagtcttgattgacagatagtgtgagagactgtttggggggaagccacctaggttttctattcttgatggtccttaccaccactaaaagtaatccagccaggggccagtgataaccagcatcagcagtggctggcccaggtagagctgacccatgggacaagtgtactgagggagcttggagaacagggaaaggcatgccaggcagaaggaacagcatagcatgtgcaaagggccagaagcactctcgagtcgggacacttgaggcacccgagcatgctgtcacagcataacatttccacccagcaagcccagggatccccagtcacatgtcactggaatccaggccggaggtgactctcctgaaggcataggggggggatagcgtgctgactctgggaaaggtccctttggcccctgtgaggagaacaggatctagggagggagtggaaatcggggtgctggcttagaggcttgggtgtggatcgggggtgggggtggtgacggtgcagcttcagagaatccaggactgtggggttcccgtggagtgctcaagccactgaagcagagacatgtggaggagcctccaagagacacttcctatttccttgcaggtcacccgctgcctctgggcctccacgatagtgcccggcccgtcctgccacgtccccccatctctaaccccccacccctcatctcctctgccaagcatcccggcgtacttgagaggcagctgggtgccatctcccaggtgagtacctctggggctgggtctccccatcacagggagcctttttgagccatggggtgtttccagggatggtactgggtgggagccggctgggctcatccctgcgagttgggccagcctacggggctacgtggatctcaggctgtgcattccgctgcctcaggcaggtgactcaacgtctggaggcctcagttcatcctctgttcagtgagagggtggggagctgcagctgctacaggctatcgagtgtcacgtcataagcccttggtcacctctgcatcctacctgccctcagcacacgggatgcgaagcagtcacactgtgtcctttacgtgggcactggccttgggcagttgttggcctgtctcccatcctccagctgagtgggccgacagccccatctctgacctgcatatccttaagtccagagtggggctctccctgtgtctgaatctggttgtgatctgtttccttaccctagcaggggatgtcagtccagcttcgtgtgcctcactcagagcatgccaaggcccccatgggccctctcaccatggggctgccccttgccgtggaccctaagaagctgggtgagttcccacaacctttggttccttacaacttgggctaaggggtgggcagtccctggtgggaggggcagcttgagacctctgtgtatcctctcacccgtccctagcccccttcagtggagtgaagcaggaacagttgtcccctcggggtcaggctgggccacctgaaagtctgggagtgcccactgctcaggagacctctgtgctgagaggtaaggctggcacagtcaccttcactcctagagagcctgaaaagcccacttcacagctgtttcctcatccttgagacaccaagaaggacagttgggtggctttcagacatggggtcctacgagctgggtcttttgtcttctagggacagcactgggctccgccaccagtggaagcatcaccaagggcctccccagtacccgggctgcagacggccccagctacagaggctctatcacccacgtaggtgctgggggcagggtggtacgggcagacatgccaagtggcttgggatgggatgagaggacctcctgggagactagagacaatggctgaatggttgatcactgtgccgtgtggggtcaggcctagggtgataaagagaacaaacgtcctgtgtctctggcagttaggtgtggcagagaccaaccacagatagggatagccaggctcataaccaggctgtcaggagccacaggcgatagagtgtctggactgagaaagttacctgggccaggaagaggaaagtgtgacatgttattatggccggaagaaatagagggagcaggggtggcagctggcttgacatatcaccagtcaggtaggcataagccagtggtgcgtgccagacttagtacccaccgaggcaggaaggatggcgagttccaggcgaacctgaactgtagcctgagagaccttgtttctatgaaacagtatggtagtattctcgatagcatctctgggagtctgcgagaggcagggtgttggcagcagcattggcactcggaagccaggatgagagacattgacaacaatgcggaggggagttacacatgtgtggctgtgctctgtgcatgccttgcggggtgggggagtgggtggggtgtgaggagtcacccacagatccgggtgcctgccactccacccctacagggcacgcccgcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtgaggacagaggacagacaaccacgaggctctggcagttaggtggggtggctatgcctgtctctccctttctttccgttcacaggatgtcttttctcaagacagacatagcaaggccactgagagcaaccaccttgctaggctgaggcttagcaagcaagcacatagcagatagtacttccctgccagctcgcccctgctgggagtgtgttggaaaccctttgttgattaggagtcatgaagaccggactgcaacacacggccccagacagccgttgtggcgtgtctccactttgctgagaggggcccttggagttggcgttgtagcctggacaggttggggtctgggcctaggtttcatgctcagggtcctcctatgagaataccttcctggccctggtgagacaaggcagcccttgttagggctgtagggtctatagaggtctctttagaaccaggcagagctgaagtgatatcagggtgcaggcaggggagtgacttctctcctgcaggcatacaacccagatgaggctggggctggccttggcggtttccccctacataggctgggaaagctgggggcagccttgagtgccgtgacagggaagggctgtggcagagccatgccaccctcttctctggctagaaaacgtagccagtgctacctaaaagttgaggaacccgcccctgggaagcatcccccataaccaggcaccctacaaacactcgctgcttcaggcctggggactgccagcttccctattccttgagccccacagccccctaatccttgaggtaacaagtgaccccgtgtgtccagggaacaagggcaccagctgcctcaggtgccagctgcatgtcctggtgacagccccaaagagctagtagagcactgagtcacagcttgggagcctccagagtcttagattgtaaccttccagcctgtctttgtggagatggggtgtcctatgcgtcttttctgggcccagtgggtctgaggcagttcagagtgtcacccaccgtcagtcccagccccagctgccaccctttctttacaatatttctttgtattctcatacattagccagcatgttccaagtcaccagtgataacaaagccactctgtccctggcacgcagaggcacacctgtaaactggcctcacatggtccttggactcacacatatccacttgtgcacatgcagagctgcaggcgcttgtggaggcttccctgccgactcagactgtgttgacatctttagtgtgcacatacacctatgggtacagacgcatacccacccacttacaaagcccgggtgggcatgccctgctctttctgccaattgagctggtttgagggtcccatctgtgggatggcagggcctccttccagctctgcctattggcgggcctagcaccgtgcctgtagtgccagccccttgcagccgtcccacatcgtgtgctttctccggctcccaggtggtatgtccgtgtcacagtgctctaaggaggatggaaggagcagctcgggcccaccccatgagactgccgcccctaaacgcacctatgacatgatggagggccgtgtaggcaggactgtcacctcagccagcatagagggtaagtgtcccgctgtagccacttaccaggaccgagcgctgcccaggaacctcccaggcacccaggccagaatggaaaaggaggtggcctcttgacaagcttggagggatccagttagtagttggctcaatattaacagatagagaaactgaggcacaacctactgcagaatggggcccagggaagtggggggtgctttcttgctgggtcttgcatcatgatggaaattgttagtggtagaccacagccctcccagacaccatatggtgacaccatgcctgttctccccaggactcatgggccgcgccatccctgagcagcacagcccccacctcaaggagcagcatcacatccgaggctccatcacgcaaggtacctcccttatggtgtgtggttccgcccccgggccaagtaccagctaaggggttggaaacagagggtgagcttccccacccatggtctataggtggagtgaatacttggccccgactccaaagcttcagcaagcacgccttgctagtgattgggagggggtccagattgaatggaactttagctcgtgtctctgtggtaaactgagcagtgtggttttacttagcatcctcacggcatatgaagagacaggcttagaaaagtcagttcgcatgcccaggggcccacaggaaggaaggatttgtgctgacctagaccgagccaggcaaggcagtggacagccagtgctgtgtgcctgacaggcatcccgaggtcctatgtggaggcgcaggaggactacttacggcgggaggccaagctcttgaagcgagaagggacaccaccacccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccaggtacgagagtgcagaggaggggggcatgggcaagcctggggggtgctaatgctgccctcgttgcattgggttataaactgaggcccagagacatcagcagctggccctggtcactgacagtatttgtgaaacccaagtcttatgtccctaacttgtcacttgactgctccccacgtctctacctgcatgtatgtgtcaagcctagagccactgtcctctaacttggtcatagcttgatgggaaagagaaagacaaaacagccagacaaaggcgcctagggagggctatcccctgagccagggacacactcagtgatgggccagaatgattctagagaattcttttgaaaatttaggtgccactcttctttttgggcccagcacttagaaggctaagtcgggaaggttataaatttgaggctaacctaggctacaaagctgtactctagcttaatgccagtcaccacagttataaagtttaataacaacacagacattgagtagcaattgagatctaggacctagctgtgctccgtgtccccggcttggatccccccgccatcctctccatgatgtccaataattcccttctctgtggtgccctctgagacctaacagggaatatgtaactccagcctgggacccgagccacagctggcgtggcagcaagtgcatctggctatggaattccatagcattgcaagatggtgcagtccccactgggtgaggaaggttgtgttgacctgaagttagcctcactctggaacccctgggccggtgggtgaccctggatgtgtagccagactcaagtgagcagggcgtccagcctctggacatcatgtcctgctaaaggtctctgtccatttgcccaagggattagagatgccccatcctgtgcagacatacaggaagagcggcatctggccagccaaatacagacctgcaccctctccccagggcaccccactcaagtacgactctggggcaccctccactggcaccaagaaacacgacgtgcgctccatcatcggcagccccggccggcctttccctgccctgcacccgctggacataatggctgatgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggtcagtgggtgagactccctcaggctgccagctgtggggaggggacagctcacttcctacaggataccctggccactgcctcttgccacagccagtctgtctcctgccctgcctctacactgcatacagggccccctgataaagtgttttttaaataattcaaggctgaggagaaggctcagtagctgcataagcatgaagaccagagttcaaatccccagcacccacataagccaggcacactcatgcacgtgtgtaattcttatgcttcacagtgagacggaaagccaagacaggagagtctcctaaaggtctcgggccataagtgggagttaaatatcccagacatggtggagagtgaaaactgaccttcaaaattgtcttgacttctcactacacaccatggcacatttctccattcatgtgcacacacatacacacagaaaaattaaagtaaaatcgttcgaatgaaacagttatcactccgtaggcttcatctgtccagtagcactgctggtctgaagcccctgcctgtgacgtcacccccgagttctgtttccctctctgattctttttacctccctgacttccactctcattctccgatccttctcagcctttccctgtgctggccccctctttagagggctccacctttggttctgtttctagccaacccctgtataccccacaacaccctaattcagatgtcagggccaccaggggaggctatggccagttccagccacatcctggctaggcttgtgttaggtgtcagatctgtgttttgattcattgtctcagggcgcacttcccaaagcattgagatcatttctctctcaagcctgtgtgcttcctactttgtggttcatctccgacctggagcaaatggctccttggggctcagggttcttgcctgctttgttcttggggtgctccagcccatgataaagtcagactggtggagtgaatgcggaatggtgaccagggagtaaatggatattttcccaggggaccaacagcagaggggcaagaggccctggggtttgtgacagctcagcctggtggccccactgaggctgaggctactgtgacctgtccccacaggcagcctcctatccagcaaggcgtcccaggaccggaagctgacatctacaccccgggagatcgccaagtccccacacagcactgtgcccgagcaccaccctcaccccatctccccctatgagcacttgctccggggcgtgactggtgtggacctgtaccgtggtcacatcccattggcctttgaccccacctccataccccgagggatccctctggaagcaggtgggtgtcctgggcctgtagatttggggcttaatgattctacttccttgggtgggctcttggggtctggagagttggggctaggcttagtatagagatcatcccctggttagcccagggcaggttccaggggtgggcttgggatcctgtctctcagtgggcttcttttcctggaggattcatctgtaccttgcagtaagtgaggggctcaagtgagtgccatgacttgagcctttttaaaggctcctttgttagggtgtcaggagctatattttgacgcattatatctgtgagcacttcccaaagcattgacagcagacaccccacatgatgagggagcgagtcttaagctctgtgtgtgtactggggaggcatgtgggtgcacaaggagaggaagctgaagtggggagtatgaagataagacatgggccacctgaccctccctccctccctccccagcagccgcagcctactacctgccccggcacttggcccccagccccacctacccacacctgtacccaccttacctcatccgcggctaccctgacacggcggccctggagaaccgccagaccatcatcaatgactacatcacctcgcagcagatgcaccacaacgctgcctccgccatggcccagcgtgctgacatgctgaggggtctgtcaccgcgagagtcctcgctggccctcaattatgccgctggcccaagaggtgagttacccaggactgcgcccatcagcagaggcttgcaaaagacgagtgtctttgtgtgcactgtgtaaggtgggaagaggggtcacagttgcccaggtgaactaggtggtgcatgctggctccttgggagaagcagggtggtgctgcttagatcttttcacgtctagcagctgtgtaagtagcaggcacctcttgctaccatgcatgttgttctgagactttggtatgaggcatcttttgacattcaagagatcagaacacaggctggaccgggtgttgcataccttttctctaagtatgcgggaggttcaaagccagcctcagctacataaagcttgaggtgccagcctgggctatgtgagtccatttttaatacaaatgtgtcgtcgtgtccccccccccccaaaaaaacaaagaaaggaatgagtgtgaagccttttggagcactgacttccagagcctgtgaagagcccaggtcactttgtcacgactgttgagcagctctgtgggtttcagagggtgatggcagtgtttcggttcaaaagatgttggttgagagacactaccggtcagagccttgagaagggagcctggggccaagcctggccctagggaggggtacagcaggtgcaaggtctcaggcctacacccttgggaacaggaggtcagaaccctgcagctaataccccccctgacccctgcaggcattatcgacctgtcccaagtgccacacctgcccgtgctggtgccaccaacgccaggcacccctgccaccgccatcgaccgccttgcctacctccccactgcgcccccacccttcagcagccgccacagtagctcaccgctgtccccaggtgcgcctggcaagtgggtgggtgggttcgtgcctcactcccgatgccctgcaggtaagttctggccccttggctctggctcacactctggccctggggtttctaggaggccccactcacctagctaaaccaactgccacatcttcatcggagcgggaacgggaacgtgagcgggaacgagacaagtccatcctcacgtctaccactacagtggagcatgcacccatctggagacctggtagggcaccccagaccccgccccacccccaggtcctcatgggccacctgggcctgccccctgactcggcggcctgtcaccaggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctcccgtggaacccggcacgcccacggtcctgaggtgggccaggttggcaccggggggaacaagcctggggggagggcacacagatgggtttgttgagtgggaggggtgtgtgtgggtggacagatgggtagagagttgaacagatggcagcaggatcagaaggtgggtgagcaagtgagagtacaagagagtgggtagatgggtggcatgcaggcaggtggaggtcggcccagaggagagggcacgcaatgagtagacggggagatagaagcaggtagctgggcagatgacagtgggcggatagaggatgctctggatagacaggtatcaggatgaacaaagaaccagggggatgagtggggatggatggatggatggatggatggatggatggacggacggacggacggacggacggacggacggacggacaaatggatagatggacagatggactgatggactgatggatgcatatatgattaagttgattggtggcggatgaaggggtagatagacatatggggcagatgtttggatggatgggtggatggatggatgagttggagcagatagataggtgtaagtggatggatatgtgcctgggtggatgaatgggtgaattggataggtggatatgtggactgatggacaggtaagcagacacacagatgaatgggtatacactgggcagctggatggttgtgtatcagtggtagatggatagataagttgagatgtatagaaaggaagataggggtggatggatggatatggatgcatgtggatggatgagcagatgggtccacggatggctggatggacaggcagatgagtggatagcagagtgggtgaatgaatggatggactacaggtggtggatgatggggtgggtgcatggagtccgttggtagtcattagtgtataaggcccagaagtaacaacttcagagaacagaactgggagcttaatgtgaggccgcagggctggtgctgctcacggcgctggtgccgggatgcctgccttctgcctgaagtcagtctcatgcttcctggctctcatgcaccacactgctgagaggctccgcactcctgccgacttctaggcgtgcctcctactggccctgcttgagcctcctgccctccccgcaccaggcttcttctctctgacccttgggagaggatagtctgcctctgtcactgtcttcccagaagctcgggcacccttgccttaagtgctgtattctgatcatctaggagggtaagaagctttaggtgatagggactgaatagagccgagcacagcataggagggtcagtcaggagggcacttgttctgggagcctcagagagtgagaatctaggcagggactctcagtcagggactctgaaggtgtgaggtaggaagccattggccagcactgcctgactctctccctgtccttgcaggtccacctccacctcttcgcctgtccgcccagctgccacattcccacctgccacccactgcccacttggtggcacccttgaaggggtctaccctaccctcatggagcccgtcctgttacccaaggagacctctcgggtcgcccggcccgagcggccccgtgtggacgctggccatgccttcctcaccaaacccccggcccgggagcccgcctcctcacccagcaagagctccgagccccgatccctagcaccccccagctccagccacacagccatcgcccgcaccccagcaaagagccttgcaccccaccatgccagtccggacccgccggcgcccacctcggcctcagatctgcaccgagaaaagactcaaagtaaacccttttccatccaggaattggaactccgttctctgggtaagaccaccctgacagcggccacgttcatagacgcaataatcacgcgtcaaattgctcacgaaagggggccgcgagaaggaggttcgctggccaacgactcccctggcgacggtaagacatccggcccgccgcctgcccaccccatctgtggcctaaagatattttcagatctttgcttttaatttttccccctttttcggttggttttggtattttgtttcgagctcgtcatcctggtcagttggcacgctgtggtgactccgcccacacgggcccctcatcgtttgcccatcctgtcgtcatgagtttttttttccttttttcctttttctttttctttttttttttttcctccttttttctttttggatttttcaccttttttcctttaatgaatggatctgtggtttggactccgaccgcgcctcccatctcccgccaccacctgcaccttcgttttggggagtggggatgcaggggctaccagctgactgctgctactgttcctggaggaagtcaaggcagggagcgagggggggagacagggtgggggggaggctgggtgcccacctcctcttcccacaccagcataaagcccaaagggagtgatcagggacagtggggctgggacaaggcagggcctagggacacagttgtctagggacacggtgtcactcagcttgaaccccacaccatcacaccctgaccccatgcacactcaagcccctctccagtttctccaccaccacctcccccagtctctcctcttctacccaagccccacactgcccaagccagactcccacagtcctttgggtgtgtctgtatcctgatacatggaactgtctgtcacttgccattcctcctttctggcccacctaggcttagataatttccttccatcttgaggcccacactgtggaggaatggctcatcccaagcaccccccaaacccaagcccacccaccttctgaccccagctcacctgtttcaggttaccacagtggagctggctacagccccgatggggtggagcccatcagcccggtgagctcccccagcctgacccacgacaaggggctctccaaacctctggaagagctagagaagagccacttggaaggggagctgcggcacaagcagccaggtaacacccgggagagtggcaggtggggagactaaggcacggctccacgctgtccccaggccctgacaagctctgctcgcctccttaggccccatgaagctcagcgcggaggctgcccatctcccacatctgcggccactgcccgagagccagccctcatccagcccactcctccagactgccccaggcatcaaaggtcaccagagggtggtcaccctggctcagcacatcagcgtaagtgtctatttctgggcccccaccattggggtggataggagagtgacgtcccatagtcagacagatgctagcatgcactggccactacactcagtcctgtggcggctgtcaccataaggtctgcctggggacactcacccaggagaccaagagtcagatcagggttctgccctactctacactgaaagtcctgacctgcctccctcccacaggaggtcattacgcaggactacacgcgccaccacccgcagcagctcagtggcccccttcccgcccctctctactcctttcccggagccagctgccctgtcctggatcttcgccgcccacccagtgacctctacctcccaccccccgaccatggcaccccagcccggggatccccccacagtgaagggggcaaaaggtgaggatatactcatatctgtgtcagatgcttggctgaaggatattggggtaggatgagcttgactgtgttgggctaatgggaacctgaggctcagggatacagaagttcactaagctcccagaaccaacacaaagtctaatcacgaaggtggcacacccaaggctcccatgtgccaactgagtgtcctatatatgccaactcagctaggggtctgatgtcccatgcccatttagcagataggaaaactgaggcatagagaagtgagttaccatcccataccatgcacacatacttaccctggctgggcctgaggctcggggcatgagagaagctggggccctacctaggcttaggagcggagtgaggcatcttgtatgagtttgattttagaagcacgggtacagacagtgaggttctggcatgggtgcctcagtgtggtggcacacactctactcaggtgagatagctctggccaggctgaggcaggaggattgtgaacttcagggcagtctgggatgtactgcaagaacccgactcaaaaatcaacaaaagcttacaagtctttaggttatctcagaagatcgtagtagcccactggggtctccatacctcagctgcagagtggccatttacagggaaatgtgcagggccccgctgtggacagtggggtctcctcatcatcgggtagaacttcaccctcagctaggacgctatctccatcaggtccccagaacccagcaaaacatcggtcctgggcagcagtgaggatgccattgagcctgtgtccccaccagagggcatgactgagccaggacatgctcggagcgctgtgtacccactgctgtatcgagacggggaacagggcgagcccaggtacccacagcacaaatccgcgcttagagatggtggtgtcagttccatgtacacccaaggcctcggccctcccatatggaggccattaatccctcacagctcagcgggctgatagaccttcaggggccttcagttgcagcaccctgtgtctggcatcctggtgcctggcatccctgtgtctgggatctcagcctgagccatgccctgttttatcacttgctggtgatctgggaatgaactaagttgaaccagactgggtgggggtggacatggacttcagggagggtgtgacctgcacctgtccagttccctggggattcttgtgtcagatctagcaataaggcattgctgggggcaattcacagcgtacctgggatgggaaccagctggtccttagcacctcacggtagctcaagtggtgagctccctgttgctaaaggtcacaatgcccagcctgctgaccctggtgtctcctgctcccgcaggatgggctctaagtctccaggcaacaccagccagccgccagccttcttcagtaagctgactgagagcaactccgccatggtgaagtcgaagaagcaggagatcaacaagaaactcaacacccacaaccggaacgagccagaatacagtaaggggaagccagggctagagcaggcaccgggagggagatagtactcttaaaccttaccatggaagagcccaacgttctgccagttggtactaactgacaacagcatatagcactttggtaatgccctgcacacagtaggtgcacagggaaagctgtagagacagccctgtgctgggtgctgaggagcacagcacactactccaggttcatgctgcagacccggtgcctttcaccacggctgatgtgggtggacaaggactcatgtccttagcgcagggtcacatgggccatatgcttacaagaatgcaccggaaagcaacacatgacagctttgcactgtcccctccccagggtggcctggacagacaggcaaggttcttcctttctggagtatagaagccctcacaggtaacagaggcctaaggtagtgaccaaccgcctgagtaaacctggagcatcaggtgcctggttgtgcccagacattcaactcagactgtacgggggacaagcaggggtgcagatctcctaggacctgtgagctcagcccttccccaccttgttaccctgctctagatattggccagcctgggacggaaatcttcaacatgcccgccatcactggagcaggtaaccctcctgtgtgtccgcatggcaaactcccttccccagtgctgacttggggacaaggagccttagcctctccctggtctcagtggacccagaatgacacagatgggcagcctccactgcctagggtcctccctacatgaggagtgcccaaggtttgaggtcagggtccctcaagtgggtgttaggtacaccccggaaacacttggccagttgctggggcttggggctggggcacgtcaccaagtgtggacctgagggattggccttggggtacagagattcagggtgccgcaggcatctttcacactaaagtctctggccattttctaaatcagatgcaggcagtaatgtgagggaaaagtgtcaaactcacgtgcagtttgtggcagaagtctcaggctttcagtatggtgcttggggcttagagcatccgcttcccgtgcttattatcacgttgccccctgggaaagaagcttgtcgtgggaacaaatgggctcggtgactgtgtcacaggggaagctgtgaggacttaatccaggccagaggaacaggcaagggtccctacttccttatttgtgtggagccttgggcctagggaataaggtggccagattaacccttggggacatttccagaagaccacaggacctgtaaaggggatggggtaggatcctggcagggacagcctggggcctttgctgagcctcaagcagaaggaaactgaccgagacaggaatgtggttggagatgcgtgtttctagagtgtgctaaatcttgacataggttctagacacctgggtgtatatgcatatagatagggtaatacagtgatttgtgctaaaacctaacttagttgtctctctcacacacacacacagacatcctcaaacatcgccccttaaatgttagttctcaaagacatgtttccaggcctagccagtgacgttcaacaccacaccaaaggtagatgagagaaaagttatggctgtgcccagtgccatcaggtcacaagctcaacaccacggagacaaggcccaggagccgtgctccatcaggaaactcccctctgtcccccttttctgtgttacctcctctctctccctctttattctggatgtagaggagtggtggggtggggcttgtttatttaaggttgaattgtgtgtgtgtgtgcgcgcgcgtgtgtgtgcgtgcgcgcgcgtgtgtgtgcgcatgcattcacccctgttggaagttcagctttttcttggtaacctttgcttagcactgtgggcacatgaccaacatgaccagccctggcccgagcttgcctgaaacccaagccgaggctgccagcagtcacccagtgactgtcccttccatcctcagaagcctggctagtttacaaaccagaggcttgccagccagcatgtttggccatgtggctttcacaaggctcaggcagcctggaggttcacagggcatcagagactggccagtggcatgggctaggaatcctgctgatgacgtcgtcattgtttgtggttttgttggtggtggtgatttgggtttttttggttttttgttttgtttcatttgtttggtttggagggtggttggctcgattgagcttgccactgttttgttcttttttccatctggatttggagcagtttgttgatacttgggattgaagcactcaacccagcaagtgtcccgtcctgtagtgagcaacaacacagccctcttctctgagggcaggtctcctcggcagcccaggctagcatggactgcactgaactccctctgtagactaagctagcctcagaaatagctggggttccaggcctactaatcaggctccaaccctcaggaggctccggaagcatccagtgagaaggggatgcctgcctgccccagcatttaccagaagtcccagagcacaattcggggggggggggggggctactaggaaggttaaagcatttaagaaccatcacgaaaaataggtttggaaaaaattaaagttacagaaagccatcctcagactgtggctctctagggcagggtcggggatgagtgctgagcaggctggagcccaagcagtctgggattctataccggatggaaaatggtgtgctagcgtggcagtattatgtggaagaagagattccttgacaagggagatttttcacatggcgagatagacccaggaattatgaaccccgaattctagataaacacaacttggaaccccagaatcactattgttctttctgtgcaatggtagcttcttttgttaccacagaaaggggtgtgtgtgtgtgtgtgtnnnnnnnnnnnnnnnnnnnnggggagggagagagagagagagagagagagagagagagagagagagagagagagagagagagagagagagagagagaacgaacgaaccagagaggctttgcagaggctcagtggagtctgcaaacatcttctaaggccactttgttgatttgaccactctgtccttgtcatggggccgggccagccagggctggagtgacccttcacctgtccagtgctgtcctgtccttgcacgcacacaactgcatggctgtgacccccaccccaccccaccccttgtgcccagctctctacctttctctggctcctgtgggggagacatggggcaggggaggcaagcctagttcagggggatcaggcaggctgaggtccctaaccccttgaggaaaaggggacagcaggggggtcctatctttggtcaccttcctcctccacatcccttcctagaatctacccaccagtaagaccccagctggacttctgtcccctgtcccagcacctagctccagcttgactcaataccacagccttcttcccttgcccgccccttgggccatccacgtggagtcaaaattttaaaaatagcctcagctgggattggagtatagaataggaatagagctggggaccctttagccaccccagagcccctccctggaacagccatgagctgcagggacagtcaggaacctcatcagcacccaacagaaaggcgggctggagggatgaacgatgctcggcagatgtgtgctcactgtgtctctctctctctccctctctctctctctctctctcctccctcctccctcctcattctatctctcgcaaccctctggctccccggcccccgcccccctgtgtgtctgtctgtctctctcccaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagcgccagtctgcccgctgctgctatgcccataaccactgctgacggacggagtgaccacgcactcacctcgccaggtctgcaggcctgccccctgcccgcccgcccgcccgcccggctgtgtccctccttatcccggtgtcgttaatcctctcaccttccccccctcaagcttgggagcctgtgaccttatttttgtgcgtttgacatctagtttgctaatctaaagctggtctgacaccccatgttgcggagggcgcccccccttttacccccagcactgctgcttttcccgtgctcacatcactccccacatcctcccctgctgtgtggacagggatgacagcggccaggcccaccatactgtggccagggcctctgggaagagtctagtgtgggcgtgaccccttgaaggccagacagcacagctccccactcttccaatgtccgtcagcacttgttgtttccaagcagagacacaagcaaagaggtgccctgctgtccccttctagggtcaggccagccccggtctggcgctctcagcagaggccttcagtccggcatagttgagtgctgtcttgggcaatgcctgtcatccagccaagatctgacattcctcagtgaggggtacagtcctgctgggagcacctaagggaatagtcatcaatctctctcatagtgaatgttcatgcctttcttcacaccaagggctggctctggccatctggtagacctcttagcctcctggctcagggtttctcacactaggtttctgtcttgggggccctaggaggcaggtggctccccaaggcagaatcagccccactgcccctcctcagtgctggtgtgggtgtcctactgtcaaccccgtctgacttggccccttcccactttgtcccctgcaggtggaggtgggaaagccaaggtctctggcagacctagcagccgaaaagccaagtcgccagcaccaggcctagcgtccggagaccgacccccttctgtctcctcagtacactcagagggggactgcaatcgccgaacaccactcaccaaccgtgtgtgggaggaccggccctcatctgcaggtgggtatcagctaggagtagagatgtatccaggggttgggggttacctgggctacccaagaaagaaggtccctgatcaccacttagcaaggaggatataggaagaaacctatcagagggtcctgtgtagctggccagaccttccaggcatggctcgtcatacaggggaggctggcagcctttcttgcctgtcaggcactgtaggattttgacaggacagtaaaggcagtagaagacaggacagagggagagcggaaaggttttactggagtccagtcaaatggtggtagggctgtcgagcacagaggcaaagggaggaggccggttttgagaaactccagagttagaggtcctggcccaagagacccaggctctggtttcttatatggaagacgggtcctgaggtgcctacgtgtagcggcttgcagagcctcctgcagcactctcccatctttctcgcagggtccacgccattcccctacaaccctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtccccgcacaaggcagaagcagcccagcatggagcagacagctgctgactccggagactgaggaaggagcccctgagtctgcctgcgcgtccatccgtccgtccgtccactcatctgtccatccagagctggcatcctgcctgtctaaagccttaactaagactcccaccccgggctggccctgcgcagtgaccttacactcaggggatgtttacctggtgctcgagaggggagtggacaggaggggagggacagcgggccaggaggggggggacagcaatcgtgtgtcagtcgcactcgtgcatctggggcagcggggacccaccacaggctgaccaggcacctccatgccaccgcctcgccccttaccgcatttggaaccaaagtctaagctgaactctcgcgtggtcctgcccctccctctgcccccagcccgcttgcgctctggacagacagacgttcccagcttatcctgccctaatgctgtcatcatcgcagtctccaaaggccacccagcccacaagactgggagcccatcagaccaggtgggtgcacaaggggccaggcctggcctggggcacggatgcttgcaggaactggaccgtttcccggcctgttgctgtggcaacgggagggaaggcacgtgtaaatggtgttggcttacagggtatatttttgataccttcaatgagttaattcagacgtctcacacaaggaaggactcgcccgtgtttctgccgctgtgctttggtctctacctactgtttcagaggcacgtgccagccaaggcggtggccccaccatacgcaggacttgggggtcaggggctccggcacacggcactgtgcccttcccccccacccccttccttgggcaaaatggacttgatgcgtattctgtggccgctctctgtgcacggcggcattctgtcatttacacatgttgttccaattaaaaagcaaatatactcaagtgacaacgtttctactctgcttctcactgggcagcaggcagccacaggagtcaaggggagtgttccttaaagtcagcactgagcagtgaacattgacccctaagtacagtgccaccagagggcatcctgcatgcacacgtatgaggaagccaccaggtacttgtgtcgtctataccttgctggatgttcacaccggtgggggacccattggtcattcacaccagtggtcatcgtacaggggtgttcacacttgttggggaagccagccagtacctgtattatacggtgaccatgtggaggtgttcatacccgtggaaaagggtcctgggcattcacccttgtcacaggagagtagtcattgcattcttcacggtgacagtgtgtggtacttacggggtgaagattactgtctcgtagtaggcattggggtccctgcctgtggcttagcctctcctgttctttcttgtgggtgtaaatttccgccagtcacacccacagtgtgcccttcccccccacagtgagggtgtcctggggactcttgcttcttgctctgcactgttttgatcctgcctgttgtgtcagcagtaagtattcttgaacctgaccgaaatggccacacctacctctttgggtttgatctaagaaactccaacagagccctgctgccaccttggtgcctgttgtaatcagggttctctagagcagtggctctcaacctttctgttcctgtgacccttgaatacagttcctcgcgttgtggtgaccccctgaccatagatttattttcattgctacttcataactggttttgctactgttgtgaatcatagcataaatatctgatatgcaggatagttgatatatgtcacccctatgaaagggctgcctctaaggggttgcaacccacaggttgagaaccactgctcaggaatttgtgtgtatacacatacatacgtgtgtatatgtgtatatatacgtatgtgtatatatgtgtatttgtatatatacaaacatatacatacgtgtatgtatgtgtatatacatatgtgtatagcagaatttattaagaataagctttttaaaatatttgttttatttatatttcacgtgtgttataatgtttggtctttgtgtatatctgtaccacagtgcttgcctggtatctgcagagctcagactagagacaggtgctcgtgagccaccaatgtgggtgccaggaactgaaccctgggtcttctggaagggcacccccgaacacatctctccagctccttgagtgagctttaaaatagtaacacagccaagccccacccacgatgctgagaacagtttgtgtggtccttggacctgagtgcctcagagttgtcccagaacagcttgcctctcactgtaaggcgatgacccttaagtcactgagtaagagtgccaatctggcacctggaagctcagaaggtttctagagagccgctggtccccaggccgccaggaaagcttagcctggctgtaccgtcagccatggggttagcagtgctatcaatgaggcagagcacctctgagtgaagggcgaggtgatcgccttcctggcagtcccttttgtacctggctgctgcctgaaggtgctgcccacaatccaggtgtgccttcccacatcaaaaccgttgggacagctcttcaggtgaggctcccttacctcatttgtgacagggtgacatttaaaccaactctcgaagcagggctgagagggcttccagtctttgcactgagtcagttgatctgctccatcctggggcctggggcccctctacatccatccatacccatctgtacatgttgtgacaccccagcctgctgtccccagtctgccacctggctccagagctggtttgacagttggtccacaaaggcctgggctgaactcacttggccttaccccgctgccaggtggctggtttagtgccctcagaggccagccattcaaagagaggggtgtgggaagcaaccaggcaggcccgtaccagagtcttcatctggcagtcatactctttctgccaaggttcctgccttgcactcatccttagctcctagcctgggcagccagggagggatgccatggcagagggtcccaagtctctggaatgaaacccaccttggctctgctggcaggtggctgctgggtctgataaaggaaaggagatctgaagcagccataggcaggagtctgatcatgaaggctctggtggaggtatgtatctcccaagaacaacctccccagccgcctggaatatctgagctagagtgtggagagacatttgcatcctccagggagtcccaagctgccccgagtctgtcctgtgaactgtcaggagcagacatgagctgaaacctggagaccaccaggcaggtctgtaccaggctggcttggaggggctcgaccttcatccagactgcaatacaaaagctagcagccagggggtgctgtgggcctcatcttggacacagccagctccacctggacggtcaggttgctttgctacaccggttcacggtgtggtgtcccttggctgccaccagacaggagctggtttgagctaccccattgtctcctccagccgcatctctacctctcagatatgaaacccatgtctcccttgatacttcctgaggcctagaccatgacagagatgtggagacagagcttgtacctttggagggtttcttctgtcccctagctgtaaccagcctgtcctcgctccacctttaaaatggaggcacatgtgacttctctcacccttgcctcccaggaagacacctggctacactgcaacgtccagccgtggtccacccttctctaagaacacccaagctcgttcctcttggtctcttaatacagagagagctagtcctgcatcaagccacatacccctcccccctaggagacccctccccgctaggagagctctgcccaccgatcagatacacactgatcccctacctaggcttgattcggaaacaacacagaccatgtcagtcaaggaggacttcctagaagtggcagccttcaaaagacaggttgtggggacacagcttgtgctagactcttgaaagccagggtggggacaagggatctgtgagaaaaggcatggctggctttctaatattgaagcaggttgggcttgcaaagagaaagaggagggtggagagagagtgtagaccactctacaaggtggatcagggaggctcaagggcaagggttgtggtaagaggcccttcagcggccagtggagctctggggtctctccaccagccttgccagtctatggtagtggtggccacctcagctctctcctggctgtggacaagctacattacaaggtgtacaggttgctaggagcttgagggaagaaagccatgcatggcacatgtggaaggacacacgtccctcatccttggcagctagtccagggatctgagacatggccaacaaaagaacctcaggaagtggggacagagtctccagggagctgtggggacccagctgtggctgccaccaggatctcgagtccctagcccacactcttcctgggcactccccaccccccaccactccttttggggatgttgtgactgacgatagggtgagtgaaccagggccaggctccagaccaaggttctctgctacccagggagacggtgaggtgtccagagggccagggcacaagcctggctgatgagaaagggcattcatcacgtttactgcgggcacgagtactacagattctttcacacattttgcagcataaagcagcacaagccaagcatggtggcacgcgcctttaatcccagcacacaggaggcagaggtagatggagctctgtgaattcaaggccagcttggtctacagagtgaatttcaagacagctaaggctgatgtcgtaaatcctgtctcaaaaataacaaaaaaagggtacctaggcaccttgtgattactgtaagccttactaccctgtgggcaggaaccactctggggatattacagggtcttctgtgcctggtactggagggctaggcaaaagctcatttgacacaaagcaccctagggcagggcagcagggaacatggccttagggtggccagcccccaaggagtgggactggatccgctcccacctggcacctcattctcccgatctctaggtcccctggataaccacagggcaggtgaactgctgaggggtatacttgggggtatacctggggtatacttggggtatacctgggggtatagttagggtattgtgctttacacgccccctgcctttgttccctcattggggggctttcccaagctctgcacattgtagttggcagcctggtgaccctatattctcaaacaggtaagagccctctgagtgggaagccagttgggcttatgactatagattggtgatcgggcccttgcctggcacatgtgaggcttttggggcaagaggcaggaggctggcatacatggagatctctagttcttccttgtctcccaggagcagggaagccgggctcccttagatactaatgccaggtgggaaaaaagtgggtccaggcatatccagcttccccccccccccaggggcatctcagaaacagagagcatcctggctgtgtgggtatattttattaagataattcactaatttcttaggctgttcttttaaccagggagcacctcagataagctaatagatgaacagaaatctatcagtcatttaggttctgtttgccccacaaagaatgtcccttccctctgggccaccacagcggcagtaggtaggtttctagctactggacaattgagacaaagggacatctccacctctaaagtagactcggggactcattttagcctgggcaccatgggacagcaccaggttgtgggaaactggtgtaactgtaggatccatcctaagcaagaacgggaggccaagaaaaacagactccgcttctcttggggttctgagccctgccataggctcaagtccagagtcagccataggcagttattggccgtgtcccctcatttgctttgacgcctcccagggcacctgccagagagctttgaggctcaagagttctaagctagtctggaatgcgtcttgtggggcacatgtgggccgccctggagggctgcgccctgcacagcagacaatgtgttctgggtacccccagcctttgccatctcaggtcaaggtaaagttagctcaacccctccgcacgcacctgcggttctcagctggaatgagcgttttttgtttttttttttaatggcctattttggaaacaagcctctccaagaatgaggtttcgagccaggccatggctgagtgccctgtgctacatagggccatctttgcctcaagggcacaccaggacatgtttggccctgcccttaaggccatagagcctctaaaggctaatgaaagatgcattcacagactcctctaggctggagctccggcacagccagcctaacctgtggtggtagccgggccatctttcctgaacctctcccacactcaggtcctcctcagagactggactcctcagagtacatcaggacagctgggaccgggcgtagggtccccgcaccgccgcagctgcaggctggaggagtaccagtgccgaggctggccgaggctgcagtgcagggtggtgcggaaggagctgcgggccagtttggggaagatgatggcggtgctcccgaaccgcagggcccgtgggcgaggctccagggtcagctggctgcggtagctccgccaggtgcagttgggcgccgccactatggtctcactgtaggccgtgaccgtgggcactggagcgtagaagatcttgtctcggaagtatctctctgaggcgtaggtgatctcagagttgcagctggggagggcaataacaaagggggtgagttgcccgccacgccaccctcagtggctagccttctcgaccttgaatccccagctgggggactgatgagatggctcagaggttaagagcaccgactattctttcagaggtcctgcgttcgattcccagcaaccacatgatggctcacaaccatccgtaatgagaaacaaataaaaaaaaaatgtgggccagagtgagcgggagacaggaagagggaaggggagggatcccagctgggagactaaagagtgacacacagcacagaccgctggaccctaaattggggagagagacaagaaaggattgatcgggatgataggtgtttttgggtggtggctttgtggcagtggattgtgaccacagaggaatatgtgaggtgttggagcatatttcagtattcgggggccaacgatgttaaaaggtcatgtgggagagcagagcgagtgccccccctaaagtctactcccaactttaccagaagaaagcctattgaaagtccccacagcccctcctggtgggtggctccctcttcagaaggacaagtgagtgacatcagtgccacttccatggtttctgacttgataccaagcagaggacacagcaccagggagtatgagttgaggccccagctggctggctgcgcacagccagacatgacccccgcctccctccagctaggtgagacctgtcttacaccttgcacccagctccccagcacactccctgagctgggacccacccacctcgctcttggcctacttaccggatttcatgtgcgggttctgggtccacctcgatgctctccccaaagaacacaggcagcaaccgtgacctcatctccagagctgggggagtttggaagagggaaggagcctaggaggagacatggcagaggcgaggggaatatctatttgtatattacccacagtactgaggatgggggtggggaggcagacagacatgtgtacccacatgcctgtgcatgaccctgtgagggcggggcatgaccgtcttcatgcaccagcaccctaggtgagattaatgtaaactgtctgagtcaggtggaggcacctgtctcccatgggacgccatgcagcctcaggatccagagacatcagcactgatccatgccaccaacctcccagctgaggtgcttatggaaattaacactagagaggctgtttgtggattggtgtttcccccaaatgcaccaggtaagtctgctggttcgctactgtaccctgggcacagcaccaggtcccatgtggccttagaggaggaaggatgtgaacagggacgaaggctttagatgtatgcatttggatgcatatcccctgcccactgctcctctttggcttatgggctcagtgtcttcgctcaggcattagaatgcttgcctaccatgcattaggcccctacttccagaaccccataaacgggggccggcaagcccagcaggcagaaggtacaatcaggagaattggaatttaagggcatcttcaggaacatagagttcagggccatctttggatacatgagaacctcaagacagaccgagaggtaaaaaattggaacccagcacctcttggggccgtgtcccgagccttgaccaacctgcagcagcagccccaatccagccggaggttgtgcaggactctgccagacagacagacagacagtgcaattcaagtggaaggagccagctctccaaaggttaccactggaaaaacagcacagccacccacagggaggctgcaggcctcatgagataggacagagcccaggtgtccactgggttaaggaatggggcagggaggctggacatgtcccgttggattccagggacagataccaagggaagtgggtggcagccactagctactccctgtaggagatttctgcagtccaaaccctggcgaagagttattttgagaatgtctcaccctacaggctacagaactggctatctcacagagcccacaggaagagctcaactgcattgggcaagaaacagtgctcccacccagaggttgggtatcgttccatagtgacatggtggtggggcactatcacccaggccacatgcagtgtgggccaccatagctccagactctgtcaacactggagtcttcacatctgcctcattgtgcctcactagggcacagaaaatcccaggcaggtggccacccagggttcaggagccctgttttaagtccaaagagattctccaaggggctgcaggatggttcagtggttaaggacacgtactgcttttgcagaagacctgggttcagttcccagcatccatgtggtaactcaaacacctaactcaagttccaggggatggatgcaccctgctggtctctgtgggtaccagacatggtacacatacacataaggtgactgagacctccagctgcggctggcagggcctcggttgtgcatccgtgaccgcaagtgtgccaactgtgatgccatccacactggggactgaaggatgtccagttcccggggatttcattgtcccccttgcagctctgggacatcaagatagagggggagaaaggtctgggggcacctaccaatcctagcggactcccccttccccagctggccctgaccccagccttgtcctttcctgagtgcagagagccatgggcagccagggcagctgactggtcagacaggggtgaggtggagaccagagctggcctcagcaggtcaaagggccgaggttcctttgaacataatgaaccactcactgcccagcccaatgatggtaaacaccgctcgctggctgactggagccatggtgccatggggtttggcaccctgggaaaaaccaaagccacagggagcgataacacagtatggcagagagcgaggtgccacccagagactgcccccacctgggggcagtctggcccagctgaactaagacacacagagggggtacagccacaaggccaaaacagtgtcccatgtagcccatgtaaatcattagaccaataagcaccttggtgatggaggggcatggccccactggctgctgctggagggacccctcccactcccactcccactcccaccctcaccctcatgcacaatgctacatggagactttgcaagggagtcaaagacacccttggcaacttctggtttgttttaactgaagtctcatcctatagaccaggctggcctggaacttccagctgtactcctgcctcaccctcccaagtgctggaattaaaccctggttggttttagctgcattttgaatatgtgtgggacaggcttggttgataagtctacctcggcccaggaggaaatgaagcaaggagggaccgtaacagcccgaatccctgtcctccctacagatggcaggggctgttaatggtggcagctggggaccacagaaatagccacagagctgtgcaattggagggagagggtaccacgatgggtccccacagcaagccagaaagacttgtgatattgatggtccccacaaggacagttgagtcccgaaccccatgctgtggctagaacagccatggggatctctacaggtgtgaggtagccactgactgactagtgtccttagacagggacatcagaacagagtcagatgaagatggcggcagatattgccactgtatctcagcacgccacagagtaccccaatgccatagccaagggctcccaccaaaagccacaccttgccacaaggaaccacagatgtgtcactggacatacagattaccaccagaagccagggatggtcttcgctagtccggagggatcctaactcgggccttgattctggttgtatggcctccagatccacgagagagcggcctctgctctaagccactctggcaccttagaggcagccatcccaactggccctatctgtagtgctttccccagaagatggctgcttgtggggtccccagactgaagttccacgtgaggctcttcctagcaggtgccctaaccatggggccatggggccggggttgtgaggaccagctggcaatccaccgaagacc

SEQ ID NO: 650 - DNA, 7534 bp, Mus musculus
ggaacagcgcttctgccagcgctatgaccagctcatggaggcgtgggagaagaaggtagagcgcatagagaacaatccgcgaaggagggccaaggagagcaaggtgagggagtactacgagaaacagttcccggagatccgcaagcagcgggagctgcaggagcgcatgcagagcagggtgggccagcgtggcagtgggctctccatgtcggctgcccgcagtgagcatgaggtttctgagatcattgatggcttgtctgagcaggagaacctggagaagcagatgcgccagctggccgtgatcccgcccatgttgtacgacgcggaccagcagaggatcaagttcatcaacatgaatggactcatggatgaccccatgaaggtctacaaggaccgtcaggttaccaacatgtggagcgagcaggagagggacaccttccgtgagaagtttatgcagcaccctaagaactttggcctgattgcctcattcctggagagaaagacggtcgctgagtgtgtcctctattactacctgaccaagaagaatgaaaattacaagagcttggtgaggcggagctatcggcgccgtggcaagagccagcagcagcagcagcagcaacaacagcagcagcagcagcagatggcacggagcagccaggaggagaaggaggagaaggagaaggagaaggaggccgacaaggaggaagagaagcaggatgcggagaacgagaaggaagaactcagcaaggagaagacagacgacacttctggcgaggacaacgatgagaaagaggccgtggcctccaaaggccgcaaaactgccaacagccaaggccgccgcaaaggccgtatcacgcgctccatggccaacgaggccaaccatgaggagacagccaccccacagcaaagttcagagctggcttccatggagatgaacgagagttctcgctggactgaggaagagatggagacagcaaagaaaggcctcctggaacatgggaggaactggtcagccattgcccgcatggtgggctccaagaccgtgtcccagtgtaagaacttctacttcaactacaagaagaggcagaacctggacgaaatccttcagcagcacaagctaaagatggagaaggagaggaacgctcggaggaagaagaagaagaccccagctgcggcgagcgaggagacagccttcccacctgccgctgaggacgaagagatggaagcatcaggcgcaagtgccaatgaggaagagctggcggaggaggcagaagcctcacaggcctctgggaatgaggttcccagagttggggagtgcagtggcccagctgctgtcaacaacagctctgatactgagagtgtcccatccccgcgttcagaagccacgaaggacactgggcctaaacccactggcactgaagcattgcccgctgccacccagccacctgttcctcctccagaagaaccggcagcagcccctgctgagccctccccagtccctgatgccagtggcccaccatccccagagccttccccatcacctgccgcacccccggctactgtggacaaggatgaacaagaagccccggctgctccagctccccagacagaagatgccaaggagcagaagtctgaggccgaggagatcgatgtgggaaagccagaggagcccgaggcctctgaggagcccccggagagtgtaaagagtgaccacaaggaggagaccgaggaagagcctgaagacaaagccaagggcacagaggccattgaaactgtgtctgaggcaccacttaaggtggaggaggctggtagcaaggcagctgtgaccaagggttccagctcaggtgccacccaggacagtgactccagtgccacctgcagtgccgatgaggtggacgaacccgaaggaggtgacaagggcaggctgctgtcaccaaggcccagcctcctcaccccggctggagatccccgggccagtacctcgccccagaagccgctggacctgaagcagctgaagcagcgagcagccgccatcccccctatcgtcaccaaggtccatgagcccccccgggaggacacagtacccccaaagccagttccccctgtgcctccacccacgcagcacctacagccagagggtgacgtgtctcagcagtcgggaggaagtccacgtggcaagtcccgcagcccagtgcctcctgccgagaaagaggcagagaaacccgcattctttccggctttcccaactgagggcccaaagctaccgactgagcccccacgctggtcatcgggcctgcccttccccatccctccacgggaggtgatcaagacttccccacacgccgctgacccctctgccttctcctacacaccccccggtcacccgctgcctctgggcctccacgatagtgcccggcccgtcctgccacgtccccccatctctaaccccccacccctcatctcctctgccaagcatcccggcgtacttgagaggcagctgggtgccatctcccaggggatgtcagtccagcttcgtgtgcctcactcagagcatgccaaggcccccatgggccctctcaccatggggctgccccttgccgtggaccctaagaagctggggacagcactgggctccgccaccagtggaagcatcaccaagggcctccccagtacccgggctgcagacggccccagctacagaggctctatcacccacggcacgcccgcagacgtcctctacaagggtaccatcagcaggatcgtcggtgaggacagcccaagtcgccttgaccgggcacgagaggacaccctgcccaagggccatgtcatctatgagggcaagaaaggccacgtcctatcctatgaaggtggtatgtccgtgtcacagtgctctaaggaggatggaaggagcagctcgggcccaccccatgagactgccgcccctaaacgcacctatgacatgatggagggccgtgtaggcaggactgtcacctcagccagcatagagggactcatgggccgcgccatccctgagcagcacagcccccacctcaaggagcagcatcacatccgaggctccatcacgcaaggcatcccgaggtcctatgtggaggcgcaggaggactacttacggcgggaggccaagctcttgaagcgagaagggacaccaccacccccaccaccacctcgggacctgactgagacctacaagccccggcccctggaccctctgggtcccctgaagctgaagccgactcacgagggtgtggtagcaactgtgaaggaggcgggccgctctatccatgagatcccgagagaggagctgcgccgcacacctgagctacccctggcaccacggcctctgaaggagggttccatcacccagggcaccccactcaagtacgactctggggcaccctccactggcaccaagaaacacgacgtgcgctccatcatcggcagccccggccggcctttccctgccctgcacccgctggacataatggctgatgcccgggcactggagcgtgcctgctatgaagagagtctgaagagccggtcagggaccagcagtggtgcagggggctccatcacacgtggggctccagtcgtcgtgcctgaactgggcaagccacggcaaagcccactgacttacgaagaccacggggcacccttcaccagtcacctgccacgtggctcccctgtgaccacgagggagcccacgccacgccttcaggaaggcagcctcctatccagcaaggcgtcccaggaccggaagctgacatctacaccccgggagatcgccaagtccccacacagcactgtgcccgagcaccaccctcaccccatctccccctatgagcacttgctccggggcgtgactggtgtggacctgtaccgtggtcacatcccattggcctttgaccccacctccataccccgagggatccctctggaagcagcagccgcagcctactacctgccccggcacttggcccccagccccacctacccacacctgtacccaccttacctcatccgcggctaccctgacacggcggccctggagaaccgccagaccatcatcaatgactacatcacctcgcagcagatgcaccacaacgctgcctccgccatggcccagcgtgctgacatgctgaggggtctgtcaccgcgagagtcctcgctggccctcaattatgccgctggcccaagaggcattatcgacctgtcccaagtgccacacctgcccgtgctggtgccaccaacgccaggcacccctgccaccgccatcgaccgccttgcctacctccccactgcgcccccacccttcagcagccgccacagtagctcaccgctgtccccaggaggccccactcacctagctaaaccaactgccacatcttcatcggagcgggaacgggaacgtgagcgggaacgagacaagtccatcctcacgtctaccactacagtggagcatgcacccatctggagacctggtacggagcagagcagcggggctgggggcagcagccgccccgcctcccacacccaccagcactcgcccatctccccccggacccaggacgccttgcagcagaggcccagtgtgctgcacaacacgagcatgaagggcgtggtcacctcccgtggaacccggcacgcccacggtcctgaggtccacctccacctcttcgcctgtccgcccagctgccacattcccacctgccacccactgcccacttggtggcacccttgaaggggtctaccctaccctcatggagcccgtcctgttacccaaggagacctctcgggtcgcccggcccgagcggccccgtgtggacgctggccatgccttcctcaccaaacccccggcccgggagcccgcctcctcacccagcaagagctccgagccccgatccctagcaccccccagctccagccacacagccatcgcccgcaccccagcaaagagccttgcaccccaccatgccagtccggacccgccggcgcccacctcggcctcagatctgcaccgagaaaagactcaaagtaaacccttttccatccaggaattggaactccgttctctgggttaccacagtggagctggctacagccccgatggggtggagcccatcagcccggtgagctcccccagcctgacccacgacaaggggctctccaaacctctggaagagctagagaagagccacttggaaggggagctgcggcacaagcagccaggccccatgaagctcagcgcggaggctgcccatctcccacatctgcggccactgcccgagagccagccctcatccagcccactcctccagactgccccaggcatcaaaggtcaccagagggtggtcaccctggctcagcacatcagcgaggtcattacgcaggactacacgcgccaccacccgcagcagctcagtggcccccttcccgcccctctctactcctttcccggagccagctgccctgtcctggatcttcgccgcccacccagtgacctctacctcccaccccccgaccatggcaccccagcccggggatccccccacagtgaagggggcaaaaggtccccagaacccagcaaaacatcggtcctgggcagcagtgaggatgccattgagcctgtgtccccaccagagggcatgactgagccaggacatgctcggagcgctgtgtacccactgctgtatcgagacggggaacagggcgagcccaggatgggctctaagtctccaggcaacaccagccagccgccagccttcttcagtaagctgactgagagcaactccgccatggtgaagtcgaagaagcaggagatcaacaagaaactcaacacccacaaccggaacgagccagaatacaatattggccagcctgggacggaaatcttcaacatgcccgccatcactggagcaggccttatgacctgtagaagccaggcggtgcaagaacacgccagcaccaacatggggctagaggccattattagaaaggcactcatgggtaaatatgatcagtgggaagagcccccgccgctcggcgccaatgcttttaaccctctgaatgccagcgccagtctgcccgctgctgctatgcccataaccactgctgacggacggagtgaccacgcactcacctcgccaggtggaggtgggaaagccaaggtctctggcagacctagcagccgaaaagccaagtcgccagcaccaggcctagcgtccggagaccgacccccttctgtctcctcagtacactcagagggggactgcaatcgccgaacaccactcaccaaccgtgtgtgggaggaccggccctcatctgcagggtccacgccattcccctacaaccctttgattatgaggctacaggcaggtgtcatggcctccccgcccccacctggccttgcggcaggcagcgggcccctagctggtccccaccacgcctgggatgaggagcccaagccactgctgtgttcacagtatgagacactctcggacagcgagtgaccacggattgggggggagcggtgccaggtccccgcacaaggcagaagcagcccagcatggagcagacagctgctgactccggagactgaggaaggagcccctgagtctgcctgcgcgtccatccgtccgtccgtccactcatctgtccatccagagctggcatcctgcctgtctaaagccttaactaagactcccaccccgggctggccctgcgcagtgaccttacactcaggggatgtttacctggtgctcgagaggggagtggacaggaggggagggacagcgggccaggaggggggggacagcaatcgtgtgtcagtcgcactcgtgcatctggggcagcggggacccaccacaggctgaccaggcacctccatgccaccgcctcgccccttaccgcatttggaaccaaagtctaagctgaactctcgcgtggtcctgcccctccctctgcccccagcccgcttgcgctctggacagacagacgttcccagcttatcctgccctaatgctgtcatcatcgcagtctccaaaggccacccagcccacaagactgggagcccatcagaccaggtgggtgcacaaggggccaggcctggcctggggcacggatgcttgcaggaactggaccgtttcccggcctgttgctgtggcaacgggagggaaggcacgtgtaaatggtgttggcttacagggtatatttttgataccttcaatgagttaattcagacgtctcacacaaggaaggactcgcccgtgtttctgccgctgtgctttggtctctacctactgtttcagaggcacgtgccagccaaggcggtggccccaccatacgcaggacttgggggtcaggggctccggcacacggcactgtgcccttcccccccacccccttccttgggcaaaatggacttgatgcgtattctgtggccgctctctgtgcacggcggcattctgtcatttacacatgttgttccaattaaaaagcaaatatactcaagtgacaa

SEQ ID NO: 651 - protein, 1585 aa, Mus musculus
EQRFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMDDPMKVYKDRQVTNMWSEQERDTFREKFMQHPKNFGLIASFLERKTVAECVLYYYLTKKNENYKSLVRRSYRRRGKSQQQQQQQQQQQQQQMARSSQEEKEEKEKEKEADKEEEKQDAENEKEELSKEKTDDTSGEDNDEKEAVASKGRKTANSQGRRKGRITRSMANEANHEETATPQQSSELASMEMNESSRWTEEEMETAKKGLLEHGRNWSAIARMVGSKTVSQCKNFYFNYKKRQNLDEILQQHKLKMEKERNARRKKKKTPAAASEETAFPPAAEDEEMEASGASANEEELAEEAEASQASGNEVPRVGECSGPAAVNNSSDTESVPSPRSEATKDTGPKPTGTEALPAATQPPVPPPEEPAAAPAEPSPVPDASGPPSPEPSPSPAAPPATVDKDEQEAPAAPAPQTEDAKEQKSEAEEIDVGKPEEPEASEEPPESVKSDHKEETEEEPEDKAKGTEAIETVSEAPLKVEEAGSKAAVTKGSSSGATQDSDSSATCSADEVDEPEGGDKGRLLSPRPSLLTPAGDPRASTSPQKPLDLKQLKQRAAAIPPIVTKVHEPPREDTVPPKPVPPVPPPTQHLQPEGDVSQQSGGSPRGKSRSPVPPAEKEAEKPAFFPAFPTEGPKLPTEPPRWSSGLPFPIPPREVIKTSPHAADPSAFSYTPPGHPLPLGLHDSARPVLPRPPISNPPPLISSAKHPGVLERQLGAISQGMSVQLRVPHSEHAKAPMGPLTMGLPLAVDPKKLGTALGSATSGSITKGLPSTRAADGPSYRGSITHGTPADVLYKGTISRIVGEDSPSRLDRAREDTLPKGHVIYEGKKGHVLSYEGGMSVSQCSKEDGRSSSGPPHETAAPKRTYDMMEGRVGRTVTSASIEGLMGRAIPEQHSPHLKEQHHIRGSITQGIPRSYVEAQEDYLRREAKLLKREGTPPPPPPPRDLTETYKPRPLDPLGPLKLKPTHEGVVATVKEAGRSIHEIPREELRRTPELPLAPRPLKEGSITQGTPLKYDSGAPSTGTKKHDVRSIIGSPGRPFPALHPLDIMADARALERACYEESLKSRSGTSSGAGGSITRGAPVVVPELGKPRQSPLTYEDHGAPFTSHLPRGSPVTTREPTPRLQEGSLLSSKASQDRKLTSTPREIAKSPHSTVPEHHPHPISPYEHLLRGVTGVDLYRGHIPLAFDPTSIPRGIPLEAAAAAYYLPRHLAPSPTYPHLYPPYLIRGYPDTAALENRQTIINDYITSQQMHHNAASAMAQRADMLRGLSPRESSLALNYAAGPRGIIDLSQVPHLPVLVPPTPGTPATAIDRLAYLPTAPPPFSSRHSSSPLSPGGPTHLAKPTATSSSERERERERERDKSILTSTTTVEHAPIWRPGTEQSSGAGGSSRPASHTHQHSPISPRTQDALQQRPSVLHNTSMKGVVTSRGTRHAHGPEVHLHLFACPPSCHIPTCHPLPTWWHP

SEQ ID NO: 652 - DNA, 233380 bp, Homo sapiens
  misc_feature (1)...(233380): n = A,T,C or G
gagctgagctcaccggtacatgagaaagatcccgggctgagctgcccttgcctggcgtctttgggccttggttttcccatctgtgtggtgggggcttcgagggtccccgtgtgtcggtgggttggtgtggagggattgggtgtggacaccaggggctgaaagctgatggggacccatggggaaacctgtgcctcggacccctccagaccagaggctcctgcagagccctgcccatggaagatctgggtcaggggctgccttgtctctgggtgcttctgttgtcactggcctctggccccagcctggtggtcaccaaagcctatgtttcccctgggcctgctgcggaggtgggaggcagggaaggtgggctcttatccagtcctctcatcgtggccctccgagactctgctccctccccctgggccccgcttctgggtgttcgaggtgctggggacattggtgtctcagtagggttgcaggctggcaaggggccctggggaggtggcctggtgaaccccgatggtgagcttcaactgagcactgctgggtgccaggttgtaaatttctcttcagagtagcccctggcatcatccctgttttacagatgggcacactgaggttccgagaagcaaggcaccttcctcaggctttaaaaaatgacagcactagggctggagcgggagccagcctgattttagccacctaatataattgcctccgtttcaccgagaggaaactgcctctgcgaagttgagcagcacacacaggggtcgcagtctcctgccaagatgagatggctcagggatttgatctgggtctcaggcccatttggggcccaccggggactctgtatgtcagccccacttgtgcctggctgtcccctcctgtgtgtgggcaccggctgaatggtggaagcaggtccctcctgggagcaggtcacgggtgctggggctgcatccctgacctaccctgggtccgggcgggtgtggaggcagaggaggatgtcctgggggtttgagtgggggcggagcctgcttgtgaggtggaaggtggggcaactgaatcagtgtgggccaccctcccaccctgaatatccccaggccctcgtgacaaatctctttcaccatctcttgacccagcaattaattgcttctggcggatggtgcccccgccctccagggagcttctaaaggccagaccctgctcctgggcgggcagcccggggcagaggctggggagagtctgcagtggtttttctgttcagctgcagattcaggggtccccaggccaggcagcctctctgggagaagccagcagctgacattttggggtacttgctctgcctatctgtggggctaaacctgagttcatctacagcatactgtgaggcaggtgttgtgatgttcctcttttacagacagggtcactgcggggcatagagaggtttcccgaagcttccatctcatccagcagtctccagtgcaccctttccattcatctccctccccgctggggctccccgggcagggggtgccgggcagaggcggcgtcgctggtgctgactgacgctgagtgtggatcccagtcctgggaactctctgggagggctttcttgcctcactgcctccatctgcacagggggaggatgtggggcggttgttaagaattaaacgagttaatcatcgtaaggggcttagcattgtgcggaggcagcgaaaccctgagcttcaggcaccgaggggctgtcggtgcctgtgagggtgagggggctggacagacaggtggacggacagctggcctttccgtgctgccgcgtggggcctccgcggcctcccggcctgggctgcgctccctgccctgtcgtggcccgtgcttggccatgagccaggctgctgccaccccgacagagcccgcgtcccccttccctcccaaaagcggtcgataccccggctccttcctggcctctaattgctcctgccggctgctgtctctgatggcggccccacaccccgcagcgaggagaggggcggcgaggtttctgggaagcctagtccctgctaaatccacggcgctgtcggggtggagaatggagtggccgagggcagagggtcagatgctcggggtcccgtctccccgcccctcactggctgtgtgacctggggcaggtaaccccgtgtgggtctgtttccccacccctgaaacagggtccggacagtggagatgcacgtggcctggcaggaagtgagggctgttattattgtgatgatcgttgtcatggttttttgcagcggctcctccccagtcgctatgcccggtgtcagtgcagccttccttgttgggagcagacaggtggccctggggctggggcgcgttcctgggcagggcacggggttgctcctcagtccccctctggacggggctgcggcccatccccacctccctactgatcccattgcaggccctgatcactcacatccatgctgccagcccccttggccttggtctggtggcccttgccctagctggtggaggagggatgggagggagagaggctgtgacccccatcttcgcccacccacccgcccttggctgttgcagtccagtggggactgagaccttggtgaactctgggtggctgcctctgcagattccaggagggctggcacggggcaggctgcctcagctgtccctggagaaggaaaacatatcccggcggcttctcaatggaagggctgcggagcctgcctccctcccgctctggctgtctggactgctggctaccacagggacggggaccaggtgacaccactgcaggagacaggggaggctccttgttcaccccgtgtgggaagatgtatccggtggaccccggccggccctgggagggcggtgagccgcctccatgtctcacggcacctaggttgtgctgtgctggaagtccccaaactccagcctgcagggaaggcttctgggagtcatgcctgccccttgggggccagggtctgatctgtgggtctgcggggtccagtttagagcttctgcggagcacgccccgaggctggctcatgctggcctggcaggttcctagggcctgggacgggcgctgagggtcttggcctcggtgcccagggcagaggtggcctggagtggagcctgggctgctgtcgcccacctcgcccatctctgtgggccctgtgggtgctcaatcaacacccgtccttctcccttctggaagatgtccctcatgtggccctgccaagggtgtggctgttgtggccggtgtggccgctggtcaggggaggctgggctgagagggaggatttatactgagccctgggcttgagtaatcatgggtcctggaggcacaggagccccgaggcaatggcccgccctgttcctgtggctgctgcaggtctggtgggaaaggctccagagtccagacaccaagcccttgcccagcattgaggctggagccccacagttctgatcctccatgcaggaagaggctgaggctgggtctgggagggcaagaggtcgatgcctccatggagccctcagggattgacccaaaggtgtcctcgctggccctgccccacactgttcctactcagttatgtgttccactggagcacgtggctcccctcctgtggccaggaacacagcccccatccccttccagctctccactccccatccccctccaactctccaccccctccccctccagctctccactccccaccccctccatctccactccccaccccctccatctccactccccatccccctccatctccactccccatccccctccatatccacccccatccccctccatatccacccccatccccctccatctccactccccatctccctccagttccactccccatccccctccagctctccactccccaccccctccatctctactctccatccccttccatcctcacccccatccccctccagctccatccccacccccccaccatctccactccccacctgctccatctccacttcccatccccttcaatctccactcctcatacccctccatcaccactccccttccctctccatctccactccccacccctccatctcctcctccatccccttccatctccactccccgtccccctccagctctccactccccatccccctctagctctccactccccaccccatccagctccactccccatcctcctccagctctccacttcccatccccctccagctctccacttcccatcccctccatctccactccccatccccctccagctcttcactccccatccccctccatctcccccatccccctctagctctccacccccagccacttccatcttctctccccatctccctccatctccacctccatccccctccatcactgctccccatccccctccatctccactccccatccccctccagctctccactccccatccccctccagctcttcactccccatccccctccagctctccactcaatccccctccatctccactccccaccccctccatctccactccccatcccccttcatctccaccccatccccctccatctccattccccatcttcctctagctcttcaccccagatccccctccagctctctactccccatccccctccatctccactccccatccccctccagctctccactccccacccccctccagctctccactctccagccccctccatctccactctccatccccttccatctccacccccatccccctccagctcttcactccccattcccctccatatccacccctccacctcccatccccctccagctctccacccccatccccctccatctccccactccccatccccctccatctctccactccccacccccctccatctccacccccatctccctccagctcttcactccccatccccctccagtccactccccacccccctctagctctccacctcccaccccctctagttctccaccccatccccctccagctcttcactccccatccccctgcatatcctcctcccatccccctccatctccacccccatccccccatctccactcccatccccctccagctccactccccatccccctccagctctccacctccatccccctccagctctactccccaaccctctccagttctccactccccagccctctggctgccccagcttctctaaccctctgatctggttcttgcccctgggcctttgcacaggctgtgccttctgcctggagtgctcttttttccttcctcatggacacctgttcctcggccctctgtgcttggctccagtgtctcctcctgcagggggccctccctgccctccctgccctccctcccaccactgctgggtcgccatggtttatgtccgtcactccaggggccactctttgcaatcaccttgctcacttatgggtgtaccggagggtgtttgggtgtgtgtgtgtgtgaccttggcccctaagaccctcagcttttgtgttcgcagtcatgcccctgtacctggcaggtaacagggggtctgtcccctctgtttgttgagcagctgaaggttgatggtgtcctggtcgaggcaggtcgaagctgcctctgggtttgaatgtcggctggctctgcctcttgcagctgtgtggctgtgggtggtggcttcccatctctgggtgtggcgaatggacgagtcaggttggcctttgtggctggggtgagccaggcgggcttcctggaggaggaaaagatggtgcttgttctggttccagcagggtggagagcagggtgacggtgcgtttggtagagttgagggtaaaagccaacgccaggaggtgggcttgtttgggagctgacaaggggggtgctggcaggtgggggcaagtctcagcctgtgggccatgcgtggtcatggtgggcttggcagaggggagccttggaactggtccttgctctccccgtgcatctgctttgccgggagactagcctggccagccccaggggcgcgaggatggaggcccggcccttcttccagctgtgggtggactgagctggtggcttcagaggaatggggggtgcccgggttcccccagcctgcctgggagggtgagggggagcgtgggagcttgctgggggacagtgagcatgaaggagctggtgggatgctgtgcggggagggcccacggagccggccagtgggcctgggcctgagctggaatgtgtgtgggtggccccgagccggtgagtgtgaaccgggtgtgcacgagtgtgaatgagtgtgaatgtgagtgcagcagagtgagcaagtgcgactgcggccttgagcgagtgagtggtgggtgtgagcacaggggagcgtgacacagcgagtgagacctgctgctgcggggctgagctgggagacgcccggccccgggaagccctgacgggggcggctctgccggggaggcgtggggctcagtccacactgtggcccacatgccctggccgctcgcgggcagcctgggctggagcagcctcgactccacgctgccagccctgtgccctggtgccctggctccccatggcccaagcacttggtcctgggtttggatcctggctcactcccttccttgccacgtggccttgggtgactcctccctcagagcagcagtttcctggccagggacacgggatggctgtgcccctgaaagggtcctgtgcaggaagtggatgttgtcaccctctccttccctccccgactagctctgcccagggtcagagaggaggagcgggcctcttgattctcaccatcgcttgcctgcctttcggactctctaatgcatgatgctctccatgccagcccctctcccacctcgctgcgcccagcctggccgcccgccacatcactctcctggactggcacagtggcctctcccttggctgtggcttctgccctcacccgcgctccacggccagatgcatctccactttggagtgggaccttgcccctctgcagcttgcgtaaccctcctaaggttctctgctctggagataaaacccatctgcagaaccctgcgtgacccgcccctgctgcctccagccctcctctctcttcctctccccctggctctgctccagccagggccctgggttccttcccacctcagcccagtcctcgctaccccccttggcccctcagtcatctccctggattctggccagtgtgacaggttgcctgtcctgggaagtccctgctgagttttctaaattgggaacccctctttggacctatgtgtcactccattactgctgggagattctctgtttccctctggacaatgtgaccttggggccagcccccactggccttgaccccatgccaccgggacaccctgggactctgtctgttggggattgcaggctgagctggctggggttgggagcaggttaggagaagatggggtctgatctcccagctgtctctcccaggtggaggttgagagcttcttggtgcccagggagagcgcctgccaggcctggctctgccctagcctgtgacgggacgtgctgcaggtggctggccaccgaggcttccgggagctggggagggcggctgtgaagatgtgcccgggccctccctgtttccagccttcctgcagggcctgtctctggagctgatgcagatggcaggaccaagtgccaagcctgggggcatcatagtgaaaaaaacgcttaaaaaagaaaaaagggcaggaaagaagtggctggcttgtccccctgtgagctgcccgcagctgccctttcaaaggctccctccttggggcctgagggcctgccaggcactggagagggctggcctctcggagcttggctgccagcccctgggtgggggtaggagtcatgtccagcaagaactgagcactcgaagtggcacacactggagtggcacacactggagtggcacacactggcactgagggcactttacactcacaacattcctgtggggtcagcatttttaaaatgatcgtttccattttagagatggggaatctgagactcagagaggtgaagttgcttgttccaagttgcacagctaggagagggtggaggccagattggaacctggggagcctggcttcagagcttgagcactgcacacagctgctcccttgtgggagggggcagccctggcctcaccagtccccgatccctcagctttggcacgaggtggagaaggggtttcccagaggtccgttgagactgactgtccagtgctctgccctctgtactattttttacttgttcttttcatgcagaagttaacacgataaagaatgtataaacccctcagtgcagattagcgaacaattataaaggggtcaccttgtagacatgggctgccttctccctagaggtgattggcgtcctaacatttgtgggaatcacattttttttgttgtatttgactacctctgcaggcctctttacaaatgtgaaagttgttttgtcttccccagaatcctatcgtggaaccatagagtctgcagccttgaatctggcttcttggacacagcctgagtctcagattcctccctgtggtcctgtgtgtctgcacttggttcctcttgattgcagagtcatatggcatggatgtaccactgtttatccgttcacctgtcgatggaccgttgggttgttttcagttgttctgcgattgtgcataaagcttcagtgaacatttgtgcgcgagtctgtgtggctgttttcatgtctgtctgacaaagtcctaggagttgaattactgagtcatatggcaagcatgtgtttaactataagaaatggccaaactgtttttgcaaagtagttgctccattttgcatcccgtcggcaacgggtgagggttccaggtgctccttgttctcaccagcacttgatgttgtctgtctcatgtttgccatccctatgggtgagcagtggtctttcgtggttttaattgccctctcttaaggactgatgacgttgggcatcttttcgtgtcttattggccatgtgtatatactctttggtgaagcgtctatgttgtcttttgcctgtctgctgttggactgactggctcatattgatttgtgggtgtcccctctgtattctgggtactagctatcattgcactacttttgactttgtatggtaactcagaaattcttaaatgaggctgggcacagtggctcgcacctgtaatcctagcactttgggaggccaaggcaggaggattgcttgagctcaggagtttgaaaccagcctgggcaacatggtgagaccctgtctctacaaaaaaatacaaaaattagccgggcatggtggcacgtgcccatagtcccagctacttagcaggcttaggtgggaggatcgccttagggttggggctgcagggagccatgattgcaccccagcctgagtgacagagcgagactatatccaaaacaaaaacaaaaacaaaaacactccaaaataccaaacaaacaaaaataaattcttgcatgagaatagtagacacccccacccccggaccccatccttcaggtgtccgtcgacccatctccctgtttgtggggtcctctgggtagttaatggggcagtttcccagtagcctagccgtgtggcccggggcccctcggtggtcttgccagggtgtgggatgcctttaaacccacacatctgggattgaatcacagctccgtcacttcccggctctgagaacctgggcatgagatttgattgtctgagcgtcagtctccctctctgtcaaataggtagcagtacctgcctcacagggttctcatggagaaatacttggcccagtgcttacgacacatgggccctgacggcagacatggtcttttttcctgcatgtcggtgtcgtcatgccaaactgcatacatgcgatgtcaactaacaaaacccgtgttttgtctgcaggtctccctgagtctttgaggacacagcctcgctggaggcagtttctggtaggttcatgtctgtctccacttggtgtccccaggaggttcatcctgcctggactttctcacgggaagtgggtctggaattactcggagccaggttcggcctggagtgtgtggtgggggcctcggggggcgtgtggggtctggcacatcagagctgtccagggcagggagcaacttagggcagtttgcggggtcccccagtgatgggccgtttcctggctgagttggtgcagtgattttttgatgacacctgagaggtgggagggtccctgacagtgtcagtgtcaggagggtgggcttccccgggctccggggttcttggtcacattgcttttgtgctttggcggtgggcccgcaggtttggccagggtggggcctgtcgatgggcccaggtgttcgggtgttgggtgctggaggaagccctgaggctgaaccaccactgtggtccccgtgcctagcaggcaaagaggtggcctgggtcctggtcttatcactgctacttctgtgctgggcactggggccaggttgctttatctctctgtatctctgtttctccatctgtagactgggcggggaggcaataacagtttccccttatagggttttgctgcggtgattaatgctcatagagagcagtgcctggcctgagaaggtgcctggtgagtcataatcacaggtcgtgcttttcacaggtcaccccattttgtgaccctcacagcaacactccagaatgggtggtgcctcattttacaagtggggaaactgaggcacaggttggtcacctgtcccagatctttcagctggaagcaaagagccagaagcaaagaaccccttctcacccttcccagggaatgcagcaagtttctcccggagtgctcatttcccagccaggcagatggtcgctgagggcattgcagggctcgtgcgcatggaggctggggcacatggcgggcacacagcgtgttctggctcatgacaggctgttgtcgggagatttcattcttgttccaaatacagtcatgtgctgcataacgacattctggtcaacgatggaccgcatatatgacagtggtcccataagattataataccacatttttttttttttcgagacagagtcttgcttggttgcccaggctggagtgcagtggtgtgatctcggctcactacaacctctgcctccaggttcaagctattctcctgcctcagcctccttagtagctgggattacaggcgtgcgccaccacgcctggctaatttttgtatttgtagtagagatggggtttcgccatgttggccaggctggtctcgaactcctgacctcaagtgatcctcctgcctcggcctcccaaagtgctgggatgacaggtgtgagccaccaagcccagagaataccacatttgtactgttccttttctgtgtttggatacctagtgtaccactgggttctagctgcctgtgggagtcagtccagccacacgccgtacaggtggtagcctgggaaccgtcggctacaccagggttgtccaatcttttggcttccctgggccacattggaagaagaattgtcttgggccacccagaaaatacactagcactaatgatagcggatgaactaaaaaaaaaaaaaaaatcacaaaaaggtctcataatgttttcagaaagtttacaaatgtgtgccaggccacattcaaaggcatcctgggccggggttggacgagcttggatgacaccacacaacctgggtgtaccgctggcactgaggtctaggtttgtgcaagtccacccccatcgtgctcccacagccacggcaccagctcccgtgcgtttctcagaacgtgtccccgtggttaagcagtacatgactatatattcgtttatggaatggctctttctaaagcacctactgtgtgccaggctctgttgtgggtgctgggaatagacctgtggacaagacggccaagcacctagtcctccctgcggggagacagaccatgaccaaaagtcagtaagtgcgacgcttagcgggtctcttggtggtgagcaccaggctgaggaacaagtggtgaaggggtctggggagcctgtgggtgggctgggggttgcagtttcaaagtgggggtcagggtaggcctccctgagaaggtggcctttgagcaaagacctgaagtaggggaggaaggaagcatgtaggtatctgggggaagggtgacccaggctgagggaacagccctgccaaagcactgaggcagcttggaatgggcctcccgggttgcgcgattctgagttacctcgggggagttttcctggaggaggcctctttacttcttcctgagcctttgggggccccccactaggcaggagggaagatcagccctgcaggtcatctgcttcctggggctgggccttgggccctaagccctgggcctcacaaccaggttttgtcttggagggagcaggggaaggaggattgggatttggaggtaggagaaggaggagtgggactggggtgggggaggaggagtgggatttggagggaggaggggaaggaggagtgcgatttggagggagggaggaaggaggagtgggatttgggttagggaggggggaaggaggagtgggacttggagggaggggggaaagaggagtgggatttggaggtgggggaaggaggagtgggacggtggcggtcccccacaaagtgatgaactcagcagggctttctgcctaggctcatggggctttgaagttggaaggaaagcggcnnnnnnnnnnnnnnnnnnnngccctgccaaagcactgaggcagcttggaatgggcctcccgggttgcgcgattctgagttacctcgggggagttttcctggaggaggcctctttacttcttcctgagcctttgggggccccccactaggcaggagggaagatcagccctgcaggtcatctgcttcctggggctgggccttgggccctaagccctgggcctcacaaccaggttttgtcttggagggagcaggggaaggaggattgggatttggaggtaggagaaggaggagtgggactggggtgggggaggaggagtgggatttggagggaggaggggaaggaggagtgcgatttggaggtgggggaaagaggagtgggatttggagggaggggggaaggaggagtgggatttggagggaggaggggaaggaggagtgggatttggagggagggaggaaggaggagtgggatttggagggaggagggggaaggaggagtgggacttggagggaggggggaaagaggagtgggatttggaggtgggggaaggaggagtgggacggtggcggtcccccacaaagtgatgaactcagcagggctttctgcctaggctcatggggctttgaagttggaaggaaagcggcctggtctgggctgtttttcccagcctcctcctcctctgcctcgctgtcccccgtccatcggcgtctccgtctccggcctaatggggagccttcctcctgtggctgagttatctgcttgtcatgccagtggcccacccgaggacgataaaagggctttttgtctgcaagcacttagcttcctctgccggggcgatccatcacatctgagggaggccgggaaggcagacagacggtggagtggggcctcctcctcccctgctgagggaacctgatgctcccaggagcccccttgcaggacccaagtggctcctcagcccgaaggcaaggcctgtctgggggccagcaggggtgagtgggagtggggccatgggggcacattgaggcaggcagatgctctgcactcccctgacagaggacagacgctgcccggatgccctgccccaccacacccacttggcagctctgtggggcccctctgggaccctccatgctggagagggtgggtggggggtgcagccttttctgagtaagaaccgtgatggtagaagggggcatgggggagacaaggggggacagacctcagggccgacactcgctatgcgtgcactaagcactttgtggaattacctccttaaatctcagggcgaccctggaggtgggcaccgtccttatccccattctccagatgaggaaactgaggtacagggaggcgatgtggcatccccagggtgcagcagcagagggagggcttggctccaggctcccagcggtacactcttccctgcggacctaggaccttagaagggggctgtgggagcccctggccccaaaagtgggttgcccgtgactcgaaactctgtgagtggattcttcagctgggagtggggtggggaggtgggtgtctgggattgtctatacattggggtgaggggtccggtgtgggtgggggctggggtctcggggtaccctgggcgggtgatcggggacaccgaaggtgtgtagggggaggttttagggccctggcccagtgggatctcacctctcgggggctctgggaggaccggctttaaccccagttggacggggccctgggccctgcttgggtggggaggagagcaattcagggccccctgcccttccctgtctgcgccaccacccttccctctctgccatcctcctctctctccttcccagcctggatgctcagccctgggcgggggctccctgcaatcccttcctcccctcccccttccttcctgctccctacccctccttctcctccctccttctccccacaggccaccctcaaatgacagcaattaatggtgcctgtgatggcgggctgagaggaggaggctgacagttgagcgtgtctgcctgcggccgcccgctaatcgggcccgggggatgcccctcctgccgttggctccaggcgcctgccctgccatcactcagaggggagcaggagccctggacaggcctgtgggagctggtgcagagcccccatccctgcagccccctccctgtccttctattattattatcattttctttcataaacgggtgggctctggctggactcttgttcagcatgagttggtggatgcctcccagacgtccttctcctgaaatgacctctcatgtgcctgtgttgtcctcagggccagccatccccacagggccccatccttttgtccctgcttccctgggagaggcgggttgggtggagcccaggaaccgtgtcctgtccggacagcaggcatcagttaaatgccccggcctgagtcctcggggcctgggggcagctatttgagcccagagccttgtctggtggggtgaggaagtgtgttgtgtttgtcagggttacaagaatcctggccagctctgtccacagtgggcctgggcttgaccatttatcacctggcagcagcaataatgaagcccctgctgtatgctggggcctgcagctggtatgttcactttggttcattttacttggcagttttctgaggagtgtggtatttctcaccttgcttttgtagagggggagactgaggggcagagaggcaaagcgatttgccctaaggggcacagtgccctacgtgacctagctagcataggacaaagctggggttcaacccagacccaaactgtccaatgctcatacatcaggggactttgggaaacttgagggccagtttaggaaccagcagactgatttagaagtgaggaaatagtccctgggtactgggaatggagtgagtagtgttaatatatgcatctctctccctgttccacttaagatcatcttcattgagatgtaattaacctataatgatgcacccattttaagggttcaattgcatgtgttttgacaaatgtaaacatttgcatcacctccacaatcagaataaagtgtttctgttccccccaaatccccaccagtcccttggcactaaatctctagcacccacctccaccccccacccccgactagaggtacccactgatctgctgttatagaagcttttaactcttctagaattttataataaaattatcattttattatatactatactttgttgtgtctggcttctttcactctgcataacccatgttgctcatgtatcaattcattctttctcatggctaagtagtatttcattctgtggatatattacagtttatccattcatcagttgatggacatcaaagtttccagtttttggctattgggaataaagctgctctgaacattcttgtgtaagtctttgtgtgaacatgttttcttttttcttatgtgaatatctaggcattgggttgctaggtcacatggtaaatgtgttattttagtttataagaaaccaccagctgttttctaaagtggctgtcccattttgcatgcccacctgcagtggatgagagttccagttgctccccatccttgtcagcacttgctactgtcaatcttttaatgttagccgttccaggagaccctaatgcacatgcgattacatttttcagcttttgctgccttttgggcaaagctgtggttctgtgttttgattttatgtgtctggccagctggtgggagtctaaaggatggtgggagataatctcgtgtctgccaacgctagctctgtgttttcctttctagtctttatgctgctgactgactgcttctcgtccggctgcagtggttgagaccacagtgcagtgccggattgcaccagttgggttgtttggggttagttagctgtgagtgttgttatttatttttttattttttattttttttgagacagagtcttgctctgtcgcccaggctggagtgccatggcatgatcttggctcactgcaacctccgcctcccgggttcaagcgattctcctgcctcaacctcccaagtagctgggattacaggcatgcgccaccacatctggctagtttttgtattttttttttttagtagagacggggttttgccatgttggccaggctgttcttgaactcctgacctcaggtcatccacttactttggcctcccaaagtgctaggattagtgagtgtttttttttttttttttttttttgagtcggagtttcgctcttatcgtgcaggctggagtgcaatggcacgatctcggctcactgcaacctccgcctcccgggttcaagcaattctcctgcctcagcctccctagaagctgggattataggcatgcgccaccacgcctggctaattttgtatttttagtagagacggggtttctctgtgttggccaggctggtctcgaattcccgacctcaggtgatctgcccgcctcggcctcccaaactgttgggattacaggcgtgagccaccgcgcccagaggtgttgttcttaacactcatcttacagatgaggaaactgaggctctgacaggtcaggtgacttccattccgataagaaatgaaactcatgactctgagttgtgtgccctttctcctccttcaggctaggaggtgccagctccgtttgttgcagtgatgtgtttgccagtccagagggtcatgccaagaattggtggctggttggggccaggaccacctttttcctagggtttcctctgctggagagatgagggtgtggaggagacgctgtgccttccggatcaagcactgtcctttggcactgagcactgttgagtgaatgtcaggcgttggttctgccaagggtcttccttgttcaatcctgttgtcttgggcaaaaccacacctgccttccggggagctattttggggcaagggaggagcatggcatatggaagcccaggaatgggctgggatggaagagggggcctccttctcctttttccttgcctgaggggtgtcagctaagatgacttttcggggaaggaggcctgtaaattaaataagcaatcccgtaaataaataagtaatgaagtcagcggggtgcctaattacatcagattcatcattgtggatggatgcctgcccggtcattgtacttgtttttaatcttcggctctgacatgtgtctccttccgtctcatagtcatccccaccccagctggagggaggaggcggggaggcgctgctgtaggggcttccagagagccttggtggtggaggtggtggtggggtccctggagggttatttacccagtctgcctgtttatggcagtcgtggaagggatgacgtctgttccgcagtgaaacctcaggaggcctcgggccatcctgattcagcaaatccctcatcaggctgcgctgaagggtagatgacaaacatggtgccccgcacagatggggccacagcacacgcagcacgccctggagggcgagatgggaaggacacggacgggggcagatgacctcagtgcaaagtcccagggatccaggtggacccgtctttatgctgcagttgggtttgtaaacctactggagcttcgaagtgggagcaccccatggcagtgacagcagcagtcctaacagggtttgtgatcgtccttgtgtcacacttcacatgttataatttatttaattgactgggcacagtggctcacgtctgtaatgtaatcccagcactttggaaggccgaggcaggcggatcatctgaggtcaggagttcgagaccagcctggccaacatggtgaaaccccgtctctaataaaaacagaagaattagccgggcgtggtggcgggcgcctgtaatcccaactactggagaggctgaggcaggagaattgtttgaacccaggaggcagagactgcagtgagctgagatcgtgccactgcactccagcctgggcaacagagcaagactccacctcaaaaaaaaaaataaataaaaaattatttcatcacctaaaagctcttgtaaagtagggattatcatcatcccctctttacatatgaggaaactgaggcacagagaggttccgcatcttgcccgaggtcacacagccagtgaactttgcactcaagtcatctgcccccgtctgcgtccttcccatctcaccctacagggcgtgctgtgtgtgctgtggccgcgtctgtgcggggcgccgtgtttgtcatctacccttcagcacggcctgttcagggatttgctgaatcaggatggcctgaggcctcctgaggtttcactgctgaaaagatctcatcatcccttccacgactgccataaacagatgccattctgaactgtaaaataaaatcatgtttcactaaggacaaagcaagcccatttgctgaaattaaaatagcttctttccagatcttctctttctctttcagcggccctgattggctggctcttgggggactctctgtcctgcctgagataatggtccttagacccattgtacagttggagaaactgaggctcagggaggtggaggagcatgagtgagaccacacagctgggaggtggtgaagctgggattctagctgcttcttactgtttggtttggggagcgggggccacctcatgtgcctgacgtggaaggggctgcctgtcctctccgagaagcgcagggagctgtgtgcaccccaggctggctttgctggggttcttgctgtggctgattggttagcgtcctgtctgtccgcgggggagaggagaccagctgccccacctcgtggtttctcctcaggacctgagcatgtgctgggcatggacagaggatgggggtggctgggggcagtcttgtcctcgttcgctgtccatgcagctccagggtgcccagccacagcccacacctgttccctccatggtgcctctccatatctccagactccaggtcctgtacgaggcagtggggcctgaacccttgggatgtctgggcctctactgggggcccagggagggaacaccctttactttacagggtgtacttgtgcagccggacagggcctgcgttgctgggccgtggcttggatgggagtgggggttcacacattcccctggtgctgacttcaggcttgcggggtttggggctctccctgcccctcactgtcacctggggtggagagaggagttgaggaaagacccacatgaagaattgtgtgtgtccatggtgttcctgggggttggagcaatccaaggaggctgcctggaggagctggaacactcacattgaataatcataagcccatcttggagggactaatgtgtgtacatgcttcaaacaggacctggcacagagcaaataccatatttaccataaaagctaacatttcctgatccttttcttgcctcagtgctgtgtgtgagttgccagtattattattattaacattaactacaatttctaacgtgcaccccatacatacacgcatgtactctttgcagcagccttagaaggtaggtgctattatgatcagccctgttttctagttaaggggattgagggcagagagaggttaggggacttgtccaaggtcgcccagttggcagagctaggatgtgaacccagaacgcctgactccacggcagctgcttttcatcgtgtggatggtgcaggtgccacctgcagccctccctctgccccgtgggtacgccgatcactgccgcagccagcctggatctcttggcagggccatgccagctgtgggacagcctccatgtgccacgtagggccctcaggcacgcagcagctgctctgggcagtgtgggatggtcaggacgtgggacatctgcttcctgcctccctgcagccagattggtgtccccacggcctcctcctggttgaggggatggcaaacagcaaacaagatgcggcgctttgccttatggatcacacaggctgatggggagatgggcagtgccaaaaaacaaacacgattttgcaaggcaagaaaatgctgcctgtgaaataatacagggtggggaggtagggatgacttcagtttcgggggactcattttaggtaagaattccagggtagcttctgaggaggtggcatctgagctgggccctggacaataaggaggcacccactatgtgaaaggaagggggatgagggaacagcaggcgcgaaggccctccggccaccatgtttcaggcatgctgattggggttctgtgcctcagtttcccactctgtaatggctggagcagagcaggggggccccaggagggctttcctggatctgagactgtcctgcagacctccagggctgggctgtttttcacatttaaggcagaagtcaaatttaatgacttttgcctttcccttttgttcttttgctccatagttaatttccatgtatttacatggttttaatttacatgtattgggcacgtggcatgttccggactcatgtacgtcactgggatgagaatggtggagaagttggacattgcctgtgccttcgagtttagtatccagagggggagtgtcagttaaacaagcaagtgctatcgcgggtggtgagggttgtgaggacgaggttcaggcattcacctgggtgaggcaagagctgaattagtcttccatcaggccaggcgtccagggacgagtcattcaaggggagacctgggggtgattagttaggggcagttagttagggctcctgagttgtggcagagacacactcgagccgagttaggctatgacggggagttgatgggtcctcagagtggccagggtaggacacgttcaggcacggctggatctaggtgctcaaacaatgcctctgggagctggctttgcctcagctgtgcctccttccatgcgggccttgttctcagacaggctcatgccaccagcccagcccagccagccaaggagaaggagagtcacctggcatcccaggagggacactcctttctcttgtttgagtgaggtcctcgacatttgtttcactgtttgcaacagcaagaggaggtggccaaagaagggataaggggatgtcccaaactcagacacagggaggaaaggagtgagtgagtcagtgcaggtcaaaggggaggagtggggattgtggctaactggcatgctgggtattctgatggttttccaagagaagctggaaatctggattttataaggaatggcctagtttttaaaaaacattgaatgggccagaacaagttttcttcatggccacaactggctgtcaccattttatagcctcttcttagcagtgacttttaaagtattttgtccccactgtgatctgggtagaatgtcccatgggctgttccagaaggtctcaagtcttgggaagtcacgtctgacaccattggagatgccatttctgaaagtcaaggcccacggccacagcagtttctcagagaacaataccatgtctccagtggggcctgacattcttggagacagtatagtctagtggttagtgtcgtagatgcgggtttcacacttgctgagttcaaaaccgacattgccacttcccagccccgtccccttgggcaagtcacttcactgctctctgcctcagtttcccagtatgtattaatggaatgggtatgacagcaccccataggattgttgtaaggcaagcttgtccaacctgcggctcaggacggttttaaatgcagcccaacacaaatttgtaaactttcttaaaacagattgtttttcggttttttgttttttttttttttttagttcatcagctatggttagtgttagtgttatgtgtgatccgagacagttcttttagtgtggcccagtgaagccaaaagactggacacgccggttgtaaggcacagtggaggccgcgtgaagcccactgaccctggcacactgagagcttgagtgatgctggccggcgtgatgtgtccttcccgggttaggtccctgggatccagctggctggcgtggagcattcctgggcactcctctttcctctgccgctgcccctgccaccggggtgtgggttcccaggagccccagaacaggcagccacctgccccctgcccccagccgtccttgccagttgctgggtgcccatggtattctggcgtgccggatggtgctgcagttggaagtgagtcttgagtgagcaattaactctgccagctgccagctcacagctgctgtgggtgggggcggccccttttaaaaataaaaacaacatgcagaaaaacagccctggagtaccgttggcttcccttagccaacgtggtcagggcttcattttgatgcttttgtggagaagaatcccgggcctggatggggaaataggatgcattttggtctggggagtgtctttatttaggggcagaggtgatggcctgtgtctggcctccccatccaggaggcaggcccctttcctcaagctgcccacgagtggctggctcatggatgcctgccacagggaaggggatttgggttccttggggccagtttttagcaggctcaggccggagagggtggctgtgggacctctcaggtctgtttccagctctgtcggctataggggggccctggggccatcccggagatccctggagctctcctctgcagcttccagccagttttctggaactagcgggaaaggaaaggggcaccaaaggtgtttccgggcatgcgactgctgccactttgaggtcttggctttggtagtgggttgagtcatggcccatgaaacataggtacacttggaaactgtgaatatgaccttggccttatttggaccacaggtcttcgcagatgtcactaaggtaagggtctcaagatgggatcatcctggaataggatgggccctaaatccaatgacaagtgttctaagagaagacacacagcagagaagtccacgtgaagatggaaggaacgccaggagccactgggaactggaagacacagagaaggctccccctgcagagtctttggagggtgtgtggccctggtgacaccttgagcttggatttctggcctccagaactgtgagaggataggtcgctggtttcagccacccaatttgtaataatttgttatagcagccacaggaaacgaatacagttgtgaactttattttaatcactcatgtattttaaaattaaaatgtaaaatgtaattttgtcttgttcactgccatatttccagtgctcagcacatacagtaggggctcagcagatgcttctcgaatgtctgatagctccaggcctgggtgaggaactcctacctgctgggagttggacccagctttcaggaagtcggtaaactgggctggagtggtgtgcattcagcaacaccatctttttgtttatttatttgtttatttgagatgcggccttgctctgttgcccaggctggagtgcagtggcatgatcttggctcactgcagcctctgcctcctggttcaagcaattctcttacctcagcctcctgagtagctggaattacgggtatgcgccaccacacctgactgaattttgtatttttagtagagatggggttttgccatgatagccaggctggtcttgagctcctggcctcaagcgatccactgcgcccggcctatttattttcagttgaggtgaaattcacatcacatataatttaccattttaacatgaacagttcatgagttcttagtacaatcacaatgttgagcacccaccccttctatccaaaaaatgtcctcatcaccccaaaaggaaccctgtaccggtggggtcactccacgttgccgcctcccgcagcccctggcagctaccaatctgccttctgcctctgtggacttacctattttgggtatttctcctggacggaatcgtgcactgtgggttttggcttctttcactccgcacaatgtgtttgaggttgatccgtgttgaatggtgtgagtccttcattcctttatatggcggaattccattgtgtggcatacatcaatagaaccatttgatatctaagtggcttttcagatgaggaaactgaggctgcccaggtcacggagccctggggcccgggattgaggaggtgcagatagccagacgtgtctggctcacggtgctgtctctttctcctgcccccaccctgctccactcgtatctgtgcctggccaggaagcagcagtgtgtggggaggaagtgagtgggggtctcttccagctggagccggatgctgaagcgtagctgcggctgtgggtctggatctggtcctcagagttctggcccccacctcccccctgggccccacacatgtagtttctgttgacctgggttgcgagagaggcagcaggcaggagctcccccattcgccagctgagccttctgatgcctcgagaggctgggggccttgcctggggccactcagcttaaggtccccctgcccctttccagaccccctttggcccaccgtcctggcccctgtggcctgcggtgaatcatattctggggggtcttcaccgatctttcccaccgtcaaagctctgctcagcagacgggctccaggaagcggcctgtcggcagattttggccaggggatgctttttcgaagtatggaggggtggtcgccgtcgaaggcttgcgtgatggggagttcttttgctgagcagataaccagacactggcttattctgaatatgagtttggttttggccacaggctctgtctgggggctgctgcctgtggctgtttctggtgtttgatgatttgtggtcttcattaagtcactcaacaaacaatttgctgcggagtatctggcggggaaggcacaggaagcagaacgagtggccgtgaagagacatgcccagtgtcaaacctgcccatagcacacagtcgctctgagggggtgggaggagttaccgtggattccagggccagcctttggcgaaggtctggatgcaggtctgtgtccaaaacaaacaaaaatgaacagaaggaggtggtgaggcctgactcggccgctctcaggcaccgcttcctggtggtgtttgcatggggccagtttggcctgggtgtcatggtcccgcctggtcttggcgacggtctgggcgggaagatggtgctggatctttgggctaaaaatatgcccgtgccttcctgtgcctcagtttccctacctataaaagaaggcgtaagagtagcagaatcccacctttggctttggggcaggtctacggaaaccccccaggggtgtttcctggggaaggctagagggccagctgttcacaggagacatctggcttccaggggcctccgcagccactatgctcatcccctcgtggccagtctgggccccctgccagtccagtggccacgggcccctgtcacaggcaaatctggtcttagtcctgaaaccctcctgtgactccttgtggctgaattaccacgtggatagcggagacaagccaggcttgcccagttcaagtcccagctcagccactagctgttgaccttgggcaagtcacctaccctctctgggccagcctcctgctctgtctgtgtgtggcggctcaggggcatacctgcctatgctgcggtggtgtgaggccagctggtgaaccaggggacccgcttagcacagtgctgggcacacagtccgagctgctgggctcggtgtgtgtggccactgttattgttattaatattattactctcaagatgctcctgagagtaaaaaggatgacaatgttattgctggagttgaaggccaggcccagagtccatctgaccacttcccctccactcctattagctccctgacctcatcgtcaaactctccccgcctcgcccctgcgccccggccacaccagccttctctctgctttgacaacacacccgcgtggtccagcctccagaccttcacatctgccatgcttctgccaggggtgccttcctcacatctgcacccccagacccttgtcatcatgtgggctgctgtccagggacacattcttaggcccaactcttggctgctaggggcagggaagtgaatctggagaccctggtggagcctcctctgcctcctgggagctccagcagcttcctctggcgcctcatctctgctttccagagcacttggagaagcagagctcagcctgccccttctacggatggaaagttgacacccagagaagctcagacttgtctctgagtcacacagctaattgcagccaaggttcagactcctggctgactaccaagccatcattgttggcctgtgtgtgtgtgtgtgtgtgtgtgtgtgtgtgtgtgtgtgtgtgtgtgtgtatgtgtgtgtgtattatttggccacgtcttcttttctaggcctgtcaccgagatgaccccagatcagaatgccagtgtgagggggtcacgctttcttttcctaggattaaaaggaggacagaaatatttgcaagggagagcctgctcctctggccatctggccctcgggacagaggacgggggagggatgggccgaggcctgggttcggaaccaggccggagccaaggcgccagagctacgctcaggttggaggtgcaggtgcggctcgaagctggacagtccgggctgggaggaagcgggttaaagtgggagaagcggggctggagctctctttcgcctgccagcgagcgaagagccgagctataaaaaggcctcacagtgtttcagctcccgagtgtcggctggaagcccgccagggttaccatggcgatgaggaattattacttactgccaaggctgggagaaaaagctcgtacttttggcttccaaacaagaggagtggacttatgtaattccctgtgtttataggcccagagtggcagaggcgagaacggatcgctggaggcccgacgtctcgttcacggcccagccgtggggtcaggcggccccgcacttgtcgccggtgggccttggcctgcccgggtttggggggcatcgggctgggagcctggggggcctggcctggccctgcagggcctccagggccgggatgggagtcgtagtctcgcgggaaggtgaggccgccctctggggccgcccctctgcgggtgtcatcctggaggaaggatgggtctgatgttggctgtggtgtgcctcctggaagccggcagcacagcctgtgtgtgtggactctgctggcccgctggctggcactttttttctttttctttttttttcttgtgagagagttacttcaagttgtgtttggagctgacgtgagcgaggttggtcatgtgctcgggtaagagaagtcgccgggcttggagtgggcagggaggtgcagtgtggctgggtcaccccggccgggggaggtgggcgcagactggggtggggggctgtggcctgcaggctctatgcaggggcgctgattgggggccgaggaattcatctggaaagagccctagttctgtcgctggaggtggtggccagggctgggggctgagtggccggccgcaggtcagccaatgggggcagctggaccctcccctggcagcgcagtgttgtcggccctgagctcagcgggatggtgggcagggctgtctcatcggacgaagttgctgcagtcacggaaaagagcgctcggaggcgctggccgggcaggccggggtgaggcttcttggccggcccgcgtgggaggggacccgggtgggcactgtgctcctctccttggtgcacatccggcgtccctgggggggagcatggcgagccttgggggctcagggggcttctgttcccggagttgacttcaggagggcatgtgatcgtgggcgctcccgaggctctgccctggggctccgcggtgggctcaggcaggggagagccaggtgcaggcagcgctgcagcccggccccggcgcccggctccccaccgaggtggcgcttggctcggtgcccatgtctggtttgaaatcagcgccaccggcccaggcttgcccagggacttggcagcgaggagccgggataaacactggaaagttggaagggcttcccgagctcacaaggagcctttagttgcaaaccggggggatgagggagtgatttgtcctgaggtctgggtgcgccgcggccatagggaggtggcgggaatggctcctggggacctctgagcccaggctggggaagggagggggctgggcttccaggcaatgttgctcctttgccacagacctgggtttgagtcctggctccgtcctctctatgctgtgtgaccttgggcgtgttgcctcccctttgcagacctcagtttcctcgtctgtaaaatggggcacagtggggtctacacaagcatgggactgacgggagaaggagctgcagttttagggggaacgcggggcagactgcctgggttcctgtcctggttggacacttcctggctgtgtgaccttgggcaagtcacttactgtctctgagcctcagttttcccatctggcaaatggaagttgcatctttccccacctcataggctgtatggcttaagggagtgaatgaaacctgccttctagctcataataggctcacagttgataattcactggcactttgttttctcgatgctgacaataccggcacctggtctgagggtggggggcccctgggatttcagcatctcagggcgatggtatttatgaagttgtagtggccggactgaggttccagtcctggctcgacccctcaaggatggtgtgaccttgggcaagtcccggaatcccacagagcctcagtttccttgtcctttaccacagtggtagcactgcagcctgccggtgtgtctcgggagagcctgagagaagcctgaaggggcccgcacagtgctggcctgggtgggcctccgtaattgtaaccacaaggttggatttaagttcgagttccgtccatttttcttttcttctttgcagagagctctcatgttttgtagaaacctgggtccagataatgggaggtaggtcgagtgggtgcttcccaggctctgcctttgtttgggatccccaggtctccccccatgcctgcctgttctgccccgtctcccactcagcctgagcccctccgtgccagccctgggccaggcaccccccacagtgcctggtgtggcctggggactggcgcgggagggccagttctcctgcagaaggtggcagccgtcctgtgtttgtaagtgacaccggatgctgggccagtgactggctcagggcctccgctcttgggccagcaggagccagtggggagttccccgggcgtccaggccccccgcaccagctgcccgctgtctcattgtcatggggcctctcctgggacctcgagaatggcctccgaaggcgggggggttctcatccatgtccccttgtcacccccagggccttggtgtccacttgggttggccacagagctgtgtcgtggctgcccctgacctttgccaaagtcctcagggactcgattttcctacccggtggagaagagtcctgggtgaggttcagaacagaagtcagcaccagggcctttgtgacgaggcagctcagcatggactggttgtgatcactggagtctgcacatgtgataagaacacatagaactaaatacgcgcacactcacacatgcacacacatacatgcacactcacgcacacacccacatgtatactcacacgcacacttgtgaacatacacaccatacacacagtcacacgaacatgcacacgcatactcgcacactcacactcacatgcacacacactcatatgcacactcacagtcgtgcacacacacccatactcacatgcagacacccacacagatacatgcgcacatgcacacacacactcacacaagtgagtgcattggaaactgctgcaatctgcatacggctggctatatccatgctgccttcctagttatgatatggatgatgaattgtcgttgtctcaggtttgtctcaggatgttattcttgggggaggctgggtgaagggcacacaggatcctgggatcttgattttttttttttttccttttttgaaaccgagtctcactccgtcacccaggctggagtgcagtgcagtggcacgatctcagctcactgcaaccactgcctcctgagttcaagcgattctcctgtcacagcctcccaagttgctgggactacaggcgcatgccatcaagcccagctaatgtttgtatttttagtagaggactcccccatgaagctggcctgtaactgagcttggtcccttggacatcccagggggtccaggcagagtttgctttgtgcctcaggatcacagagggctccagagcgtcccaggctgggggacacgtggtgcctgcagggcctgtgggggcctcatgactgagctgctgtaagggtgttcctgtcatcagagtggcgtggtggaggcttgtgtcccgtgggcatgggtcgtagcttagggtctggagagatgggggtgggatagggtttgggggcatccagcctcatgagcctcttctttgctgttctttggggcccctgatcatgggcctgcctcaggacctttgcactggctataacctttttttttttttttttttgagacaaagtctcactcccgcaggctggagtgcagagctgtggccacctttctttcaggttcaagcgattctcctgcctcctgagtagctgggactacaggcgcataccaccatgcctaatttttgtattttgagtggagacagggttttgccatgttagccaggctggtcttgaactcctgacctcaagtgatccacctgcctcggcctcccaaagtgctaggattacaggcatgagccaccacacccggcctggctgtaacctcttctgggaacaccctttcctgagaccttcagcctccctgatataggcctctgctaatggcgcctcctgagagaggcctgatgtcagttgtgactccctgtgacaccttcactactccttgtaacactgtcaccaccagggtctgcggtatgcccatcacccctgtccccaccttgttttagtctatttggactgggtggctcacaaacaatagaactttattgctcacagttctggaggctggatgtccaagaccaagatgctggcagatttggtgtcacatgggacgagggcccgtttcctggttcatagatggtggcttctcccaggaagaggggcagggcggctttctgggggcaccaatcccactcatgacagctcatcacctcccagaagccccacgctctgacatcatcccgtggtgattaggtctcaacatgcagattttggggggacataaacattcacactccagcacccctccatccaggattttgttcatctttgtcaccgctgtgtccccagcactgggtatgtagcaggcacttaggagacagttgtgcctgactcagtgtcttccacggggcctcagcctgtcccctccccataaatggggcctctctggtgaaggaggccctgcattttggggatgatttggaaaaccaggaaaagttctcatgctttttctctgactgccactggggtacccaccaagcatcccaagagagctacccctcctagatacagtcatgagaaggaacccagggatgctgtaggtacggggagtgggggaggggtggtgacagcctcagccttgtgtgttgaggaccaaggcgaggtgagcattccacataccttagttcattgtgtccttcccatagccttgtaaagtcggcacagagtcaccctctcctgataaggcacagagagggtaggcagcttgctcaaagacacacagctgcaggcctgcagtattaccaactgaatggcatttccaaggcagttgcttctttgctcaaggtcatgcttagcatgttaaggggatcatcctgtttcatccccaaaagtccctctactatccctatcttccgaggcgggtcctgttttctggggatctggctcagaactggcagggacccgtttcccaggctgagagagtgcgcctcatttagcccagagcagaggcccagagatgcccacacttctgaaggttgggggtcagtttccagtgtggcttagaagttagagggcaggaggggcaccccagagtggaggaactgccctcttcctccggagtcgttcatttgcatgacaatgagccctttgttcctgaggccagcctccttcccaggctaataacataattcctggcctgtgatgtcataatgggccctttctgtggctggggtcagaggctgggtgggcagctgtgtgggctgggccaggcctgctaataaccagggaggtggtgattgccaggggcctgtgtgccaagctgcctccttccagggtctcgctgagtcctcccgagagagcagcgggaggtgggatttgctcccctgttgacactggagcaagctgagcctccaggaagccctccctggccccaccgtttgtctggtccccctcgatgagctgcttcaagcttcttggcctgtggagtgggggtgactcactgtcagtttggccctcggccgagaggcgtgggcgtgagagtcccttgtttcctgtaaactggagggaggccaatacccagcggctactgtgttggggccactcggaaagccaggttcaaaccttggccccacttggtcccctgggcatcggctgaactccctgtgcctccgtttccccctctgcttcatggggttccgctggggcttgggctcagagctaggcagggagtgagctttcaggaaatgggcaatgtcagaaaaggcgggggctggtggagtggggtgagtggtgatacccccaagagttaggtccatgtcctagtaacccagcccctgtcagagagagaccgtatttgataaaagggtctttgcagatgtgttttgagatgagctcatcctgggttacccaggtgggccctgaatccaaagaccagtgtccttagaagagacagaagaggagagagcaagactacatgaactacaggaagacaaaggcagagattggagggctgaagccgcaagccaaggaatgcctggagccaccagcatctggaagaggcagaaaggagcctccctttgagcttctggagggagtagggtcctgctgacgccttgattttggacttccaggctccagaactgttagagaataaattgctgtcgttggccgggcgaggtggctcatgcctatagtcccagcactttgggaggccgaggtgggcgcatcacttgagcccaggatttcaagatcagcctgggcaacatggcgagaccctgtctctacaaaaagcacaaaaattagccggatgtggtggcggcttgcctgtagtcccacgctgaggcaggaggatcaattgagcccaggaggtcaaggctgcagtaagccatgattgtgccactgcactccagcctggaccacagagtgagaccctgtcaaaaaataataaaaaaataaaaataaatcactgttgttttaagtttcctggtttgtggtcatttttatggcagccctaggaaatgaacacagctggcgacgccagtctctggaggtgggggaactggccctggcgggggttggtactgttccccactccaagcctgagggtgcaggacaagtttgggtggccgagaacccctttgtgcctgggagtgcatgaagccccattcggggagtctggactttccaggaaggacgccttgctcgaacctgcctttcttgccgagaaccaaatccacaaggccctagaccccacctgccgcctgctgttcgctgtcccctcagacagccctgctaaggggacaggacccagaggcaggaggctctcggattctaccccggctttgccccaggccccggacgccctttccccacgcgtctggtgactcctgcagaacccgggttgcactcatcccccagcaagccccaggtttgccgggtgcccttgacaaatggagaaactaggcccagagagggcaggctacttggcagaggccacacagctccttagtggcactgacggccttacagtctcgccacgggggctggcactggggcttccaggagtggggatcagagttctcggccacttggagacctggagtggagctggccggctgtgtggacctggggtcagttacctgatatttgggacactcggctgcctttgatggacctggcctggtgtaggtggtaccccgaaatctgggctttaagcacaccctgtctgtgctctcagcctcagtctctctgtttgcaaactggtctttgagcttcagctccacgtctgcgattttgctcttagcatgttcatgcattcagcaaacatttattgagcacctgccatgtgcagtgtgctgggactctgggggacacaaaggtgtgactcttgcttcatggatcttgtgtttggggctgtggggggagaggaaatgcagcagcacaggttggagtccagattccgggttctgatgagggaggtcacggagctgggccgtgagggaggtgaggatgtggcctttcgtctcctcctgggcccggggtggacagtgtgcagcaggctctcaagtggacatggagatgcccacagcctgtccgcggcggcccatgggcacctctggctggcaggacctggcctggtcttgtgagcagggacatgggatgggagggctgcaaggcctggctccagcctggtgggagagacaacagtctcctctaacctaagcagcaggcatgggtatgctggtgacagggtcccaggacacagtgggtgagctggacacaggaggtggctcgcctgggtttgcatccaggctgtgcccttgttggctgtgtgaccttgggcaagttgctcggcctctctgtgccagtctctccagctgtagaatggggatgataacagaatccctcacgggggcgctgtgaggaaggagttggtgccaccaagtgttgtgttggggactggctgtgccagtggctgcgaggtgttccctcccgtggctgctcagggcagcggcgtggaagatggaagtggcatttgctcatcttcccgctgccctgctcctccctgtgcaaatagcctcagtcttccacctaggaaacgggagctgtaacaagcacatggccccatggaggtcgggaggagaagcggagctggggtgcatcagtgcctgtggggtgggggcttggggtcgccacctgctccagattgaggccttggctgcccccgaggcctggaacagccacttgttttacaacccaggaaactgaaggcctggcagggatggccccaagacatgcccatgggtacagcccatgtggtggctcctggctgcagacaatgcctcttttttctggcctggcgggagcagcccaggcttgctcaacctggcctaggtttatcagcacatttggttctgcggtgcggctagcagacattccctccaagagagatcgtgatgttcctccggaaaccgaggtccggaggctcaggttactgtggggggcggccgtcggggggtgtgtctgcctctgagaagtgacccagatcagagctgggctgtgctgggcagtgttcatctgcaaagctgccgcctgctctttcacccatgagagccactgacagctcaggaagggactgggagccacccactttcccttcagggtgacacaggacaggcctctccctggctcctgcctggccccttccccctacactgagtctggcctgggtctcccattccatttctctggcctcttcttggctggctttggacctgtcctcacctacatggataagggacctagcgggtggaagagatctgattccagggagatcctatctgagagtttgtgttttaggagggttgctatcttaggtctcttggttgcaatggacagactccctctgcctcctgcatttagcacaaatagttcaagtaactaaaaaacctcagagaagcttcaggcacagttgggtccaggtgctccccactttcagtccctgttagcctgagactaataattgcagttcagtagccccagtggaaggacagcttcttgttcccaatattccagcaaatatcatgggaatgagttttgttgcctcagcttgagagttcagagttaagcccccccccgccccccaccaaagccagtgccactttggctggagggctgggtcagcctccctgagaccccaggactgagggtgcagggggggtggttgcccagggaaattggggtgtggcatgcacggagtggggccgggtgggcagagacactgtgtcttgctccctgtgttggagatggggccaggttggggtccctgcctggcctgcctttcatggccagtgtgtgtgtgtcccattggggtggagcaggtggcgccgatgagtcactgggtaagtttcattcctgttatatttaatagttgagggcctcttgggtcccccctccaagccgttgctggcgctccacctcctgtccccccatcagcccgcttcagctccccagccttccctcacctctcttgtggcgtccagtgaccacgtcataagccacaggtcatgtcctggcagcccctgggctgtatttggctgtcagactgatttattgggttggttttatagtcagtgtttttttagaaatatcgggagatgtctcaaaattgggcttcttggctttgctggaaagatttggatgccgtggaccccctgccccacgtggaccctgttccagcagggtctggaacatcaggaatgtttgggggccacattcctgggtctctgctcagtgttggctggggctgagctgcggtcacccccttcctgcgggcccctcccctcggcgtggtgcctgcctgggcccttgtgttccggcagggtcttgggtatctacagctctcctcttgctttttgtccctgcccttcttcgggtggatcatccgatcccaggtagacgcttagcttcagccgtcgccactcctgggcgctgaagcatttgtttactgtctgagctcctggctgcaggggccataggaccttttgggttcttgatcactgtcccgtcatcagacatttattgatcaatgcccctggggtaattgaatggcccagatgcgtccacttctgagcattggacagagctgacgtaaagtggattcttcccgtttagcctgggagcccaggcggcagtggggtcctcccatccaggccctttgtggtccagcctggccacttgctgggggctgggatgggttggggaggcaggaggggacccttgttgagtgggtgggctctgtcgccctggacgctgctgctggcacagctattcttagcagcagaaacatttgtcctcattcacatgtggtggatgcctccagggatctaccctgaaatactagaggcgaccccataaattcctcagaaagccatccttgagggcctgcgtgcatggaggagaagcgggaggaggcgtttccggcagctgcacagctgtggatgtgtttgccagatgttggaggcagggaagtcggtgggaaccttgcggaggccgccttcacactcggggtctgggcatggacatgagcgggtgggacagagactgcagactggtgggcagagagaagggctctggccctggcctcaagttttggggtccaggggcccctctgaagcagtcagcccttccctgggccctggccttgaggccacctgggttggaggcagctggcgaggggagagctcagcttatcgggcgcttccgagggatcagaggtgcaagtcgctgcccagccatgccctgtggccgtcatggggtcctgaggtgaggtgggccagagacaaggcctggacgcatgctgcactcggctctgagggcctgctgagtgccggggccactggcaacactttgccttttatgggggcagcctgagcctttggggccaccgcggaacaacacaagcacaacactagcaatcagggaggtctccctggaggaggtgttgtttaattttaaattgtggtagatacatataatgtgaaatttaccttcagccattggtaagtagataattcagtagtgttaagaatagccatattgtttagcaaccgatctccagcacttttcatgtggcaaaactgaatcgctatatctgttaaacagtaactcccccttcctcgctctccccagcccctggtcccagccattttcctttttgtctctatgaattcagtgactctggccacctcctacgagtggaatcgcacagtgtttgtccttttgtggctggcttctgtcactcagcataatgtcaggagctgtgttccatgtagtctggggttgttggttcattcttagccatgaagcaaaacggatgaagacccaggaccccaaccccgtccgcatcctttagaaaccccaggtcccaccgcctctccaggtgctgtccaggagctcagccccagctcagccacccagctccctgagccccactctggcatggcctccctctctcctgccgtcacagcccaggggcacggggttaagtggtttgcccaggttacacagctggtgccagcgtctccctccccactgcccagacagcagcctcctctctgactcctcacttccctctgcagagaagattgctgttgggaaggccagatggaggagatgggtctaatggaaaacacgtccctcctggggcgcccggaacttaatgaggaagaggcggcagaaccaggcgtaatgtttgtgaagtacgcaagtggggagggccgctccccgtgcagggcttctcgggtggagccacaggaacctggagtgcagggagggttcgtcctgctgtggtttatctccctctcttccttttaaaattaaatggaaacaaaaaaaaaaggaggggaggaggaagtgattttgagcatacttcgccgtggcgggggagcagggccgagctggctgccgtccagcggacaggaacgctccaattatattggaaacagtaacgggcctcctcggaggctccgaccaacgccacttccctttctgttcactgagggcgggcgcctgggctggcagggccgtggggagggccgggggtttgggcacccgtatcctgactgtgtggccttgggcaagtcagttcacctttccgagcctcagttttctgatctgttcagtggggcgaattgtgtttggtgaatggaactggagcgtctgctgcctctggtgttagcatgagataaatgtggcctggagtggaggtggggcctgctttgcctggggtgaaggggtgcaggaatggggaagctggggggcttgaagcagaatgtggggaatgatagaggctttcccagtggccgaggagcctctctagaggaggggagagatggggctggtgctgggggtgggttttgcacctggcctattttcccctggaagcaggagcaggacgtggcactggggagacaggaataatgggctggggcatttgggctcacttgagaatcacaggctcctcccagactcagtttgcctatctgcaaggcgaagatagccatagtgactggcttggttaacatcatcgccatcacctccctccttcccccgagtggtcggcgtggcagagggcagtaacagccacgctctccttctgggggctcttctgtgggccgagaactgcaccgagattcttgtagctcttttttccagtgaatctttccaagtgaagctcagagaggtcaggacctcacccaaggtcacacagctgtggaagtggcggagttgggatttggaattgatcagcacgtgggagccctttggaatggcagtgtgtccacaggaggtggcttggttgagagggcactgactcgtttcagtgaccgaggggctcagcccacagcctccatagctcctgctcctacaggtgcagcccacagcctccatagctcctgctcctacaggtgcggctaaaactgccgaggaggagccctgcctggtgggggagacagcggtaaacaggtagctgtggcacagggggccgagtccatgggagtggcagggggagcgggccatggcaccggggggcccccttggggttgggggaaggttccaaggaggtgccagtagaggcaggagctgaaggctcaggagaagacagactgaacctgccccattgagtccaaccagccaggcagggcatgtaaacaaaggtagctgagtaggaggggacgtggcaaatagggaaagccgagcctatctggtgtagatagcctctgcccacttccagccggccatggctggaacctcagtttcccctgtcaaacgattttgtggtaaaatacgtacaaaatataccattttggctatactaaagtgaacaattagtttgcatttaggacattcacgggttgtgcaaccaccacctctgtctaattccaaaacagtttcatcctcccagaaggaaaccccaaacccattaaaccgtcactcccctctcctccctccccacaacccctggcagcctcgggcctttgttctgtcctgggaatctgcccctcctgtgaagttaatggaatcatgcagtgcgtggcctttctgagcggcttctttgccttttgtgccatgtcttcagggctcacctgcgttgtggctgagtcagcgcttacctttgcgtggctgaatcgtagtccattgatggacagactgcgtttgtttcatctgtttgtcagtagatggacatttgggttgtttctgcttgttggctgatgtaaatagtgctgctgtgggcattctaatcctttctgtttgttttgtcaccagttttccgttccttggggatgtgtagctaggagtggcatcgctgggtcatggggtaattctgggtttaacctagtgactgttttccacagtggctgcactgcacatctgacattcccacccgcaatgtgtgagcagccctcattaggagaagccagacattccaaatttcctgtgaaatccctctttataagagctggtctctggggcttagctgagctgaccctggggtgaggaagcaagtcccaggaaactgcccagagggagcaagtctgggacctgacgagacgctccgggcaccccagctttctggctttaacctggcccacgtatctctaccctgtacatctacccggggtcaaggaggaggattcccaggctggagtcctctcggcctttctcctcgaacccagctcaaggggaagatgtgctggtttatgctgaaaagggagaagtggtgccaggtgggggactcgggagagttgagaccctcccacgctgagtctgggtttgggactggaggcagttttccctagggtccttcttactcagcaggctgggacttggggagcagttatatgggtttgggggttcctgaaggcgacagtgcctttctgtgtccctcatggagctgggcatgtgggagggcctgggaatattagcaggatgaagacatgcttggccctggggattggttagaaatgtaagaccagaaaaacccggaaaatgaagcagctaagttgatatccatctggtgatgagtgtgtgcatccatccgcccatccatccatccatccatccatgcatccatgcatccatccgtccatccatccatccattcgtctgtccatccatccatccatccatccatccatccatccatccattcacccgtccatccatccatccatccatccattcgcccatccatccatccatccatccgtccgtccgtccatccatccatccgtccatccgtccgtcttccatctatccatccatccattcgtccatccatccatccattcatctgtccatcctctgtccatccatccatccatccatcaatccatcatccatccatccatccatcagtccatgcatccttcctcctttctctatccatgcatgcattcatccatccatcctcctttcctccctcccttcctcctttctcctccatcctcccatctctatccctcttccatcttctccctccatccagccaccccctgctgagcacctgggtggggagtctgccagttgggccagacctgtcactgggtgtgggccgtggtcagcagggccttttgccttttgtctgacttggtcactgctgtagctgtgcttgtacagtgtttgcacataacagatgctgaaataattctctaattgatgagaatgggtcagcaaccggagtttgggatgggtttggcttgcctggtctcagctggagggcagaccgcacccttgtgggtggcacctgggattgagctcttagtatttgaccctcagcccctccggcagagccaacgacaggctggggttgggtacctggctcttccttagggagtggaatgacctttctgccaagtgagggccaaggagtctggcctcattcctgcaggcctgccgctgtgcatgggtggaggcccgtttctctagggccctgacaatcgtggctgtcatcattcagggttacaggggcccttttacctgtgccccacactcagacacctgtgcccagtgctcctcgacacaggggcagctacagtgtcctttgaacacagagacgccagaggcagacttgccacaggagaccgcacgtcagccttgtttaaagtgcaccagctgtgtccttcctagctcccttgcagtgaacaccccagctttctggctatagccagaaagagtgacctcacatgccttcgctcaccccactctccccattcaggcctccctgctgtcctcacacaccaggctcggtcctgcctctgggcctttgcacctgctgtgcctgctgtgtggactccctcctctccccggcgcctttgcataaaaggcacctctggtgacgcacccctgactgcccactttcaaaatgtacccccattccctgcctgccgcctcctggttctgtttttctccatcgtgctaacaccttctgccatcctcttactcccgtctcacctgctggaatggcagcttcacgaggtgggggatttgggatcagtaattcactgctgtatccccagcacctttcacacagtaggtgcttaacaaatcgtggtagacagagtgagccaccaggccgggcagcaggagctctctcttcacccccttcctcattggctgtgggggcccctctggactgggctgggcgaggtgcacccttgccacgtcccaccggctttccgcatctcaggactcactccagagctggattcctgagcatccgttctgcgccaggagtcctgctgaaggtggccatcagatacttggccagttccccagtttttactgcacgccagaaagtaaacacccaaggtgtcaacagctcgacccctggagctggcgctccgcagcatcttgtgcgcacatcccagaactgctgtcccagagttccccccgggccggcttctcctcgggccagactggctgcagtggttttgtttagtaaatatttattagatgcctactgtgtgctgggctctggggatacagcagtgaacaaaacaagtatttctggagcacctcctgaagtaggtagtgttctcccttaaggtacgtctgcgtggaacctgggagtgcggccttgtttggaaagggtttttgcagatcacattagttaagatgaggtcacaaccggataggggagggccccaaatccaatatgacgggtgcccttagaagaaggggagacacagagacaggagatgcagtggaaaggctgcgtggagatagaggcagaggatggcacgatgcatctacaagccagggaacaccgggggttgccggggccaccagagctggaggagtgaggaagtaggaagggcctcccccagagcccccagaggccgtggggccctgatgacagctggatatggactcgaggcctccagaacagtgagacaatccatttctgttgcttgaagccatgcagtctgtggtggggcagccgagggcgctaatacgcctcgtgtgtgccaggtgccgtgcctctcggtggctgtcacacaataggtgcttattccacagtgagtggagcaaatacctactgagcggtgagggaggccgtatgtggctgagctgcagggctcctggggcctgcctgtcttcgcagggccaggctgggacagtggaggcacggcctgtgttcccgccgtggttccgcccaccccaggggggctttgtgccttgggcttctcagagtatcagagggttctgtcgagtgtgtgtgtgtgtgtgtgtgtgtgtgtgcgcgtgcacgcgtgcgcgctcgtgccgtgggcgctctctgcctggcaggttggtttttaatcccgaggctcccccacctgccacaggttcttccaatgtcagcacccattagttcccagaacatttcaggcacgtgcggcgcagagccccgcgtgcctttcatcctccccacagcccgcggctgagcgctccgggcacatcctgtagctcccacacctccaccagcccccgcctgcccctcaccctgaggctgtaattccaccctccccaggtctgaaccaggccgctcaagacacagaaaatctatggaatgtgtctcggtgtggcctcatcctgccggagctggagaggaatgcaggggtgggaggccccatggaagcttccagggcctcccggaaaggcgcctctgcccggccaggtgggaagaggacacaggtgtggtggtttctggcatcactgcgttgctggcatgcacctccgctgggcagagtcattcagtgtgcacctactgtgtgccaggcaccagaaggggctctgggtccagcaggaggcaaggcggacagccagtcagagctcacggcccgagctttccgctgtggatttggaaaccttaccaaagcccgcagtggccgggaacagggaatgtggcccacttggcttctgctgctgcccggcagagtgcagtgggggcggggggcacttgtgtgtttgctacctccttgcaggcatggcccagggacagacccctgcagccgtgcatggggagcccctccacctgcctgtgtgggatctgcagccctcctccagctggttcaggggccagcaggggccctggggctgtggttggtggcttggatgtgcagaggcctgcttgggcccttggtgtccccgttgggtatcccggccacctgagatctacaagtcccttgacctcacccaggcaccgtcttgttctcctcggaggcctgaccctcctgactctgcatggctgagcacctgctgttccccaggcacctctcggtatgccacaggcacagggtcctcgcagcgggcctgtgcagcgggactcctgcagcgagctgtttccgcggcctgcagagtcagcctccctcctgactttcatccacctgcccatttccccttctctgtcgctgttgccctgatcccccagtgtcccctctcttggacatttgcaggagcctccccaggtctccctgatccactcttgctgtccccagtgcctgctcgtaaaacactgaccctttactcgcccccgcaaccaccttctgtggctccccactgccctgagaacaaaatccatccttacccgggcccatggggccctgaatgactctgtccccacttccccccatattcactcaatgaatttctcaaacataaacggcacctgtgctcacccccaggccctcgctcacccctgggcctgtgctcaccgcctggcgggggctcacccccaagcctgcgctcaccccccaccagctggcgctcacctccctgctcttgctcagcggcgcctccagctggagcactctccatcccctcgccttcaccctctggaagttcttcttcctcgtatctcctggctctccccagggctgggcagagcccctggcctgagaccctccagggcctggaccccgctgggttcacaagaagtccccagcactagcccggggctcagcagggaccacagtgtgtatgtaaataaatgaatgccgcccaccctttctgaccccaccgcagccagacgcagcggcgacatggggcgtttgtgtctgaattccccctccagcccggatccatcctcagaacctcctttggccaggaccagatcctggagaccctggaggggctccctcgtcctctcctgcccccatctttgaggaaatgatgtcatcattttttttggcattcacttccaaacctgctgatgaaaagtcaaagcttatttttttccctattcgcagtgctgcgcacccgcctcctctatcaagtttcaaaacctttgcatcactgccctgtaaaaccctgtaaccattagcaggcctcattcctgcctcaccctgccctcctggtagccaccagtctcctttctgcctcgtggatgtgcctgttctggacatttcatatccgtggagtcaggcagttcgtggccttttgtgtctggcctctttggttcagcatgacattttctggttatgtgtggtgtaggacacagccgtccttcgttcctctttatggctgagtaatactccatcgtagggatggactggaatttttgctgggtctgccttttggctgctgtaaattctgttgccatgaacatgcataccgtgttttgtttgagtccctgtttccagttcttttgggtggatgcctgggaatggaattggtgggtcatatggttattctatgtttaaatttttgaggaaccgccaaaccgtttccctaacatttgttttttttcgagttggcaggaaacgtggctcaggtcgggaggggttggaaactgggtttcctaagctcgtggtgagtgagggtggcacgaggttactggagttgttccctgttcaggccccaccggcatgtgaggcgctgggtggggggctggtgggggaaccccttggtaggtgaggggccgaggttccagccccatgctccggggtgggcactgtgtaaatcccaggcagtggaaagccagccagccagctgcggggcactttaggaaggtgtcaccctccctggtctctggtgcccgtgtgcaccatggtaagcgtgtgccaggggcctgtcacccccaggcagcatctcactgggcaaaggaggaaagaaaagctgtgggtaaatgagacctctcggccaccttgtgcaactcaaaatccaatagcaatttggaagttgcccgtggtgcccttgaaagaggggcagacctcgggaacagcaccctgcagaagtgacggccttatctcctccgagagaccgggaactgtttagcacctagagagaagggaatagaatttgctttgctgcatgagatgaccagggtctgcagactttgagccgagctctagcaggaagaattttagaacagggctgggtcctggtggccacagctgttctctctcccagggccagactcttgtttctggctgcagaacggatgtctcattgctcttggggccgggcagggctagctgtgccttgcctccccatcatagcgtcactggtgactgggctgcagctgcatcattgacagtcctggtgacagcagtattaggcattctggtttgctgagcatttactgtgtgctgggagctgctgagtgcctgctgtccgccacccggcctttcctggggtccttgcaggaggacttaggcagtcggaatatgcacagacgtcttcatgtgtgtgggagtgcgtttgtgattccgatgccttcctatttattccacatagtactgggtttctgtatacctatgctgataataagcttctcttgtatgtaaagttatgcctaactgaatgaaagtgacaggcccggggctagacggctgtcgcctgggtaatctctataaaaaagtccctacgcgggggtggcacatgaatgtctgatgtttagggaacactgtgtgtttggaggttcagagagggcaagtgacttgcccaaggccacgcagcttagcgatggtggagcgggacgtgttcccatgttcacgggaattgcgccatacatcctgtctcggggctgggaaagcccacgcaggcaggaccgaggtggtggtagatgtgtcagtcttggctccggaattccttggcttttctgtgtttgaaggatggacagcagccagttgaaggggtggcctcctctgtgactccttctttccctgtgtgagcccgaattcttggtggcatgtgacagaaacccagcttgggctgccaaagacaaaacgtgcagaaggagtgccctggctcccctaatgaagtgagcaggcttcgacctgcctccagccaccatcggacacaacctgctcttaccgccctttcgccctgccttcctgccggtgggcgtgggtctcaggcaggctcctgctgcatggtggcccccagagctccaggctttcattcccagcttagatccccagcagagagcacctttctcctggttccagcagcaaaagtctcaaggcagattctcattgactcctattgggtcacaggctcatccttgagacagtcactggcccagaagcatgcaggactctgattggccaggaccgggtcacatgaccatccctggcacctggggagggagggagggtcaagtctacactaatgagagatgaggtggggcctgggaggcagtcagggcccccaaccttaaccttcctcccaatgcccctccacattaggcctccaagggctttcctgcttggagaaggacggttaccctcttcaggttgggggagggggtgttctgatgaaattgcagggctgggtatgctctgtttcccctcctgacccctgacctcgtgtggtgcagcctcagtcctccgccactggaggcccacatccaggcgctgggtcccggtgccagggtgcatttccctcagctctggggggtgtgtgcaattgtgggggtgctggagagggctttgcatgaggcaggacctgatggacacaccttttctgagggactggttcagggagagtgtggagggggccttggtctgggatgggaccctgttgtaagcccagcaggtggcgtggagctgtggctggcggaggaaggggagaagccttgttgggggtggggggtgcttaggggtttcctggcaaaggcagcttcggagtaggggtccccgtggctcccttgctgggccgtgtcttctctgtggggctgtttttccatctgtaaagctgctagcccgcttcgtgttattcctctggcgtggccacgagtagatcctctcccgtggaaggctccagtatctgccccaggagccgtttggggtacctatccctaggctgcagggcccgactggctgtcattctgcccttggctcttcctggtgtagccctccatgtcctaatcccacctcctagtttgcatctggctaacctcatatcagtcctgtcccatgtcatggtgtcagcctcctgcacagggtcatagccttgcccaggtcatgctgtggcctgtggcccgtggcccgcctgagctggccctggtccctgctgcccgggacagcggtgtgtgatgtccctgctgccggccgcccctcctgggacaggtgctttctgggaattctgccctgtgacttagaaacccgggggccatggagtgaagttggatgggcttaggggggctgggagccatctgggtggtggtgagggcagcgcagagtccctgtgcctgccgggtgaaggcctgggtggggaggaggcctctggtcccttgcgtggcttgcatggctcggagggaccttgaatgccatgcctgtctccttgtgctcccggagaacaggtgagtgtggcagtggatggaggagggtccaggcaggcccctgggtgctcgcgtgtcctcacgggaccacaggaacgactcggggacctgtgcacggaggagccagctgccccgtggctgatcttgtttttcttttcttgttttcccgcaggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggtaagggggtgcacatgtgtgcgcctggggctacctttgagacccttcttccattccactgagtcttcaccccttcctttctcctgggagccaggctcatgtggctctgagcctcccagggcagaggggaggccgccacagagacccctggtgtctgaagccttttccagaatatctgataaaatctctttgctcccattttaaagctgggaagatggaggctggggccaggctgagctggggctctgccctctctggactggtagtgggattggcacgcgaatgtggagctcctgctgtattcactttcctgcagcctagcctcacctctgctcccccgctgccgcagtattgggtaggattggggtggcttccagggggcaagggggccggataggtcacagctccccttccttcctgtcctcccgttccgtgtgtattcaccttggtgcggctcgaggctctgaggtgaggaggccccacacaggttgcgtttctgcctccctgacatgagggtccagggtgctggctgtgtctttggggagcccgccctgtggccagggcagatggcttgccctgggagcaggtgggcctcgctgcctgcccacatgtgtgccctggtcgggtctcctaagccgcaccccaccccaccccacttcccagcgggggccccatttcctgcctcttctctcactgcatggtgtggccaggacaacgggccttggtttcgctcctttggcatttatggggtgcttgctgtataccatgtctctgggtgtttgccaagcggctttcagagttgtgggcctcccccttgtgacctcctggctgctgagtgaggggatgtgaggcctggaggtcacagctggagtgaagctgaccctgccggccaccgtgggggtgcgtgtgtgcgtgtgtgtgtgtgtctgtcctgcctggctggtgtggtcccctcttgtgagaaccagaaaggaagctgtgtgggaggacgtttccatcagtgagcagaaggttttgcatataagctcactggccctgcctgggggagtccctgacacagtggcctcctgtaggttgggcccctggggcgctttgcagagtcagctgtcctcagtgggtgcgttgtggatccctcttaggacggcagttccctgggcagagtcattgcattctcctgggcggccctgtgaaagagcagctcacgctctcatcccacttcgcagatgaggagactgaggcccaagaggttaaatcacaggcctcaggtgcgattgccctaagtggggaggctgccacagcatcggggctccaagcttctgtgtccccccactcccccgtgcctctatttattgagcacctactgcgtgcctggggctaaggaatagactcccagtgggaaatgattttatattttgtcatcattgtctttatctgtcaccaccaccaacaaaaagaagagctcttgttaactgagcacctactatgggtcaaatgttgttcaaagccctgagtgtatatggttgtgtgcattcccctgatcaccccagagtgggactatcatgctctgtattttgtcaatgggaaaatatttcacagggtaggaaactggacaagttacgtaacctctctgagcctcagttttgtcacccataaagtgggggtactgagagtacctgtctcctagattctcacgaggggtaaaggggatatgctgaatgttcttaagatggcgcctggctcagggccagcccgctctgtccgtttgctgctgccgttccttggtcttgttgctgtacctgcagctgcccagaggggaacctgcctgccctgggggtgctgctggcttctggtttcttgtcctgtcctgtggaggttcccactcttctcaaccgccctcacccggctcctagccttggggagtcctcaggctgctgtggcctctgctctcccacccctcctgccctttgccccaactgggccctcggggtcactggctgaccctagacacctcccattcttctcctgctgggccgtcagtgacgcaggatgtgggtggacagggccaagcgctcaccgccccctccaggcaggaggctgaggccagggagtgagtggggcccagcctggcggccacaggtgagaacatgtctgtccttgtgtgggggcagcaggggccacctgtgtgtgctcctccctgggggagctgccccatatcggaccctcctgcctcatggtagggctgcccatccagagaatcctgcttgtctcttgaagggcaggaggaagagttctgggcactctgaggagggccctgctgccctgggcatattgcagggtggagccgctttcttgctgtgggttggaggtgagctgggggctgtgatctggaggcccctccctggaagcccctcagccctcaaacccttcctgtccttttaaagggcaagacccagttcgaaagatactacccccttcctgagctcctcatcaagccacagaaagacagatccccccgggtaaggggacagtcagtggcgggaacctggctgtcctggttcctcgtacagtagccgaggccattctgctgggatccacgggatgcctcagtgaccttcccagattcaggtcacctccacgcatactcccgacaggcctacctcctgggacagctcctcctgtctggagagtcctcttcctggtgctttgggcacggggctgctttgatggcaggtcttccctggagcctgtgagacctcagtgtggcttcgaaccctctccgtgttcagcttgctgagtggcattggcccgctcacagccacgtggaacggcctcagtttccccacctgcagtaccggtgtcctggtgggtctgtgcatcggtggcaatgtctgcacgcagcaagcgcggggtagtcatctctttcctcctggaagggtggcaggagacccaagcagggcctcttccccctggggaaccacaggaccgtggatgccgagctggcggtggaatggtgcaggccgtggaagccgctgcctctgcctgtgctctgccctggcgtcatctgcgggctgctggtgagtgattcccagcacaaatgggaggcttcacttagttgggtgcttgcagacagaggcctggaccctgagaccatggaaagcccccaggttccctgactcagcctcagccatgctccaggcttctatatgcatcatccctgccctcccgcttcctacctgccgcatccctctgtgcctcattctctccatcctcaggggcccagcttctctccgtgacagtagcaggatcctatgactctccctgagggtcctggggaagcgagggtctccagggttgagggtccagtaacaaaatgctcacagcttttgttttcccggagatcaacgcctcctcctctcctggcctcctttcaggctttctgtggcccagctgcattctgccttcttcttcaagtcctctgggacccctgaacactcctgagctcctccagaccttgggctaaacgaatgggctaaaggaatgcagttaaaagcagggacacagagtctgaatcccagcgtgactcttttctgctgtgtggccttgggcaagttacttaacctctctatgccgcagtattgaagactggttcatagcaccggttctggagccaggttgcttgcatttacatcctgccccagtgatgtcctagctgtgaaacagggggcaagtggccttaccgtcccgtgcctcagtttccctatcagttgagcaaggatagttttaagattgtgaggatccaattagttggtaggtgcagagtccttcgcacagggtatggacagagtaagcagacatttgatataatcaataatgtaatgatgacgatgctattattacaacatcgcctttagtagctttttctgtcttgccccaagggtacactttgggctttgcccctagggcaggggtgagcacaaccttctctgtaaatatttcaggctttgcaggccatgcaaccgcccttcgcggcccgtatggtgtgaaagcagctcagccagggtgtaagggagtgggcgtggcctgtgcctgtgacactggacgctgctgccttggccttgggccctagtgtgctgcctcttggcctagattagctcttatcagactccctatgggaaggaccggtctgtttcatttccagtttgtcacaaatcgatatggggtcccactgcacagacgcaggggctcagccaggcccagtccggcagggtcagacagagttggttgtgcccttggatgccagggtcacgccaaccccagaggtctgcatgctgtcatgttctgtgcccacttcgttgcagttggcaacgttgcagacctttggtggagtagtactgccctgggctaaggctcccagaccctggagactgcctgggccaggctggggcaggtgggcgcgtggggatcactggaagaggctagacttgggaggctttgcagtgtcctgagtgccctgggggggggtctctccattagcttcatggcccccttgcagctcagttcctggtgcttggtgatggctcttaagaggctgttgagggatggtttggccctcaaaagagaggctggtgggagctcccatgctggggaagattcattcattcattgggagctcccatgctgggagatccatccatccatccatccatccatccatccatccatccatccatccatccatctggcaaatacttatcaggcgtctcgggcccgtcctcttccaggcccttgcagtgcagctgtgaacagaacaggtaagcatccttgtctcagggagctgacctccttgtggggaatggcgagttgggaaggagatgaggggaagggctgaggttgggggagcccagatttaagtagagagtcggggaggagcctcactgagaagctgcctttggagctgaacctggaggaagggagagggccaggcatgtgggaatctggctgaggaatgttccaggcagcaggaacagtatgtgcaaaggtcctgaggtgggagctctcttgactgtagccgccatcattccgggagagacccgtgaatgcagccagggtctaggaatgtgctgaattcttcctttgctttcccatgaatccagggtccaggaacgggctgaattcttcctttcctttcagtgtgcagtcccaggcattcccttgacaccttctggagtaaggagccctatgcaggggccagagaggggcactcctctcccgcaaaggaacttctcccagtccatgctcaaacatccccccgcatctagcccctttctcctctctgcccccagccactcctccccacccttgggacccagccaagaaggcaccagctgggattccctcctggatgaatggctttttctggtggcctctcacctttcccaggagttttaagggtgtaatttattggtggccctgatttccagcttcagaggtgccatggtcagggagaaccctctgaggccagggggcatcacctgaatggctttttcctgcctccctttctgagcagctgggtcagactccctctgcccaagtcaggtttgctgctgtcctacagggacaggttcagagcctggggactgtcccctcttgtccctcctcagaaagccagctcagcctttgccttgcatctcagaacgtaccccttattgctgtgtgacgtggacaagccacttaccctctctgtgcctctgttttctcgtctttgtgtggggcttcttgtaatacccacctcacagggttgctgtagggatgaaattaactaatatatttagagcgtttagctgcaggtacacaaaggcaatttattactgtggggtattattgttgttttttatgattaatgttgtcgcgttggggagctctcctgcttggagacgtggcgaggtggtttccagcctgggcgtattccagctcatgggaccccttgggctccacctcaggtcagtttctctggtggggcctccccaattcttgccttcccctagagcctccaggtactcttgttgggggagtccctgggctcaaccctggtgacctgcttcaagcctagtggtgggggccagtgtggaccgagtgtctcccagggtttagggtccagtaacaaaatgcccacagattttgggcagaaacggcacccaagatgctcctaggaggatctcctaaattgggaaacgaaggccaaagggttcatgcagaggcctccccagcccccacttcgggcctcctccaccatggttggctgccgtgggcactatcgggccgaggccctcttcccagggactggaccgtccgccctgcttctctgcccacttggccttggtatgggagagctgggtggagaggatcctcctggcagactgtgaggcctgctgctttcttctcacacctctgtgtgtgtggcaaggtctttgcctggcagctgcgtcattgtcagcccagtggcctcctccactccctccctccagccccgtcttctcccttctcctcccactgagagcacctagagtcttgtgctagacactgtgggatgcaggaggaggctcgtgccttttctgccttctggaggctgctctcagccttgggggaatccctcagagaggtgagggagatgagtgtaggaggtgcaggcctcctttaatctgggctgggcacccatttcaaagaggagaaactgaggctcagagggttagaataacagggccaaagacacaccttctgttggaggccttgcagcttttggtatctacatcggactgtccagggaggtcctttccccagcttttccagcttctgaggctgccagggtccccatggattccacttgctcatccttcctggcctctgggctcccgggctcttatgtgctgattttgttgggtctgcaacagatacattatcaacgcacccacctggcattgtctctgattctctttgcaaaaataactgccttgttgaaaaagccagacaacaaaagagtgactagatttttatggaaaattgggaaaattaaaaaaaggtgccaagaagagacgaagtcccttgtaatcccactctctaaagccttacctgtcagacatcactaactgattgccgcaaacagcctcactgagtgttccaggcagacagaactaatctattggaattggtgcgtaagtgaagcctgtcttgtttttgtttgagaggcttgttactgtcttttttttttttttttttttaaacacagtttaatgtttctcaaatctgggtgtacttggcaattggtatacatctaatttgttgatattgagttttaccccctatgataatggataatgtgttaaagaaacaagtatttggactcttgttaagcaggaagaccgtacaggacaattgtgctatcagcgtcaagactgtcacgataagggagagagaccaggctcagcgccaaatacggccaagacagctggggcctcatagcctagccgcagggcggagggaggggtcggtggatggaaaattactaagaggagcgcttgagggtggggggttcctctagactgacttagcaggatgcctgcagctgggcagagccccgcaaggccaaggccaaggccgaggccccgtagagagaggatgggtcagaggagcttgactcaggtgtgggcaaggagagtctttgtcaaatggacgacggtgtgttattaaaggaggaaggtctgcctaaggcttacccttctggctgtgatacgagcggggagttcctcttttacagggcggccttggggtcaggggtcgctttgttctgaaacctggtctttgggcctcgctggctatcgggtgtttgtcgccatcatttgccaccatccatccttctcctggcgagtgaggcccgagcctcgttccctcgcgtgggcatcacttacccaccctgccaagagctgggcatctaggttgggccttttcccagttgttgctgcaaatgcatttctgtttttacaaataatgctgccccgtatgcaccttcagtcctgtcttcccaggcctgcatttccaagcttcagctcctcaggctggagggacccacagcctggcaggggtaggatggggtgggagggtagaaaagcgaagacagcttcctctactctggccccccagtcaacgccagcatggccggcagacagaggccatggttaggatggttccaggcctgtattagcctgtggcctcagacagccccatcagacctcccaggcttggcggtctcatttggaaggtgggcgtgatcgtgggtccctgggatgctgtgtgggaaggatgcagcccagggccgttcagctgtgttctttctcctccttggtgttcggccccaagggtagcctctggccagacggtccctgaggttccctgcaggacttgggcttatctgcctagggcaggagcgagcctgagcagggagtccacggccttgcccactgtgccctgccgtgccccgccatgcccgtgcccgcccacgctcaccactcctctgtcccctcctgcaggacgtcgggctcctggagtaccagcaccactcccgcgactatgcctcccacctgtcgcccggctccatcatccagccccagcggcggaggccctccctgctgtctgagttccagcccgggaatgaacggtgaggagagagttgctgcctccctgtccagggcgtgagagctccttctcagatggagaagcagaggcccgtggcagagcaggagcacacagggtcctgtgaaatgaggggatgtcgggccgtgtgttcacccttgacctggcgtgggcgtgactcggggtgaggatgggacgagcagggaagagccacgtggccctcagacttccagcgtggaacttcagtggcctctgtgggtttaggcagcagtggggacctccaagctgggctgcagcagggctgggcttctgtgggaagatttgagtccacacctggtgcccctggggcccctgccctctcctcccattcttccttcttctccagctggcagaggacaccctctggtgtgtgcctgtgctgggccagccttactttccttgatccaggtgggaagggaatgaacaggttaggtggtagggtgagagggaggtggggtggggagctggagggactacagcaaggggagggccagggctgggtcagagccagctctccatgcattcacttgggatcggtaggccacgttctttctcccatcttctctaggagcttctgctggagacggctgaggtgtggggaattgtgcctatttctcagatggggcagctgaggctgcgaggttgagggatgggctcttgtttactcagccaggactagaagtcgaggcaccaggccccagcccttcatggtaccacggaggtgtcccagggccccagatcaggcggggctggtgaactcaggtgggcgcaggcgtctggaggaggggaggccgaggcagcgtgccttctgtacctggattggtttcctgggcctgccgtcgcaacgtgccacaaactgggcggcttcaagccacagaagtgcattcccgtgatctgaagtcagggcgtccgcagggccgcgccccctcagaaggctcaaggggaggatgcttttctgtctcctccagcttctgggggctacaggcgttcctcagctgtggctgcatcggtccaatctctgcctctgcctctgcctctgtctcacgtggccatttccttgtctgtctctgtgttctcttgttgtgttacaaggatcccagtgatcctaatccaggatggcctcatcttagcttaattccatctgcaatgaccctaggtccaaagaaggtcttattttgaggttccagtggctgtgcattttgggaggatgttatatttggaggttccagtggccgtggattttgggaggacattatttgagccactgcagtgccactatcatgtttaagagaaaacaccatgcgcttcctgccaagccccatgtaatggtgaagccctgggttctgggccttgaagagggggatgtcttggggcccagctttggagggacaaggacttgagggccctccagggaggtgagcacagaggggtggctgccccgctccccgggggggccagcaacacggccccagcccgtgctgcagtgggcagcattcagtcagtctacaggcactgattgaacacctactgtgcgccagtacctggggacagccatgaacaagacaggtgaaccaccctgcgttcattcatgggtgggggaggtggccaggaaacacctgttgtcaccaagcgcgtgggagggcagtggagagagagcagacaggcgggtgtagtgtggtctggcctgggacaaggaggcgccatctgcaccatgacaggaaggggaggagctcacatggagggcctgaggtctcagtgctccaggcagagcccagcaggtgcaaaggccctggggcaggagtgcagtggcgggacagcaagggccaggccaggcagggcttgtgcaggaggggaacagctgtggattccctgcttagcctctgggaaaagcatttcagcaaggcccatattcaggctctttctggtgggtgatggttggagcctcagaggtggaggccaggagtcccagctccgtggggtgtgcttagttaggcaaggccatgccctctctaggcacactgcggaggagggttcaggagagccagtcgctggggaaactgggcagctccagtctctgcaccaggctgctaggctgagttgagaaggtggttaggccaggttcagcagcaagagttctgcgatcggccagcgatgtctgccctgcgtgggtgagagggaaatggcatcacgggtgctgttatctgtgttaggctcacagcgtttcccggatggactgtgcctgtgaaccacccaatgatcttgttaaaatgccgagtctgactcagtaggcctcagatggtactggagattctgcattgtagccagccccaggtggggacggtggggtggtccgtagcaagggaggggcagtcactctggggtgttccagtgccaccgtagcacactccctccctgtaaatgtcctcggtgaatgtggacctgaaggaaggcagcgctgcattggagtcctgccctgctgtgggaccgtgggaggtgggctcctgtgagcaccttcctggcaggatcatacagagcacggcgcgcagtagatgctcggcgcagagggtggtcggggcctcgggagttctcagagccgcaatctcctatgtgacgttggatgcctcacctcctgcaggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggtaagcctgggcccccagctgggagctcctctcccgcttgaggttctgctgctggttgggctgggtgggaggtggtgggtaggggtgcagggagggggcagctcgggcaaaggcttggaggtgggccaagcaccgggtgcacagagctgggtggcaggaagagggcaggcgctgggtctctggaggtgccagagtgtgggaagaagtggggaaggtgttccaggtgggcagagcagcaagtgcaaaggccctggggcaggaataggcttgtggtcacggggtagctggcgtgagggaggggagagctgggatgggagggcctggggtgccgtggagcagagagctgccattcgatgggggtcaggaccgtcctgtggtcggtgggcagctttcagcacattctgagagcttcctcgagggtgggttgtttggttccatgcttgcttggaacagggggctcagtgacccctgcctcgagccctgcacagcaggcagccccctgggccttgaaccccggcccgcgaggtggacagctcagggctctgccaggcacctgaggcttctggattcttaagggtcagggaggggagactccagagtcccgcaaagtgagatgagacagagttggctcagcactaaaggggcggtgcttggttaggacatggcctggacccctagaatgacaaagccgccttctactgcccagtctggctgctccttgggccaccgtgtggcactgggctagcgtgggttgagtctgcagccacccaggcctgagggaccacggatgcactttgggcaggggagccagacaacttcaggctcgtctgcatctccatggggggctgcctggcattgcaggtgggcccaggcctcacctgggcacactcacttatcccagggccctccgtccatctgccctcaggtgacccaggtgcgatttccaccacccccacctccacagctgtgctgcctttgtgcctctctgatccccatttcttcctcactgatctgggaccttgtgggcagggtgtcacctggtcatgtgggtagagggctcggctgtgggccccatgcgtgggaactatttggcacccgtgagccggcatgggtggtggtctggctgcggggccaggccacctgggccagactcggccttctctcggggagagaggatacctgcgtggaacctgggatatccctggggtgggcttgggctggcaggaggtgggggtgccgtcctggggctgggatggctgggcttcccctcctgctctgagtggctgtggccccgacacctgcacacctgccagatacccacagggctgcctctggggccaggggagggaggggctggggtgtctgtgtggtcgttggctggcttggcctccctgccactggggcagtccccgcctcaccaagttgtcacaggaaagtggaggtcagttaatgaactcctagccaacagaccacatgcgcctgagagcccactcaggaacctcccccggcggatgcagctgtgttcttgttggcactcagggactccaccctggccacctccctgctctcctgcgtacttccagtccatcagcaaatcctgacacctctgccctaaaatatctcaattccagccttctgcccacacctgaggcaacccccggcctgagctcgtcattgctctccagtaactttgcagtagcctcctcctgggtctccctgctcctgcctccctctactcccttcagtttatcttccaagcagcagccagagggctcttataaaggcagacgactgcatccccctgtgtgttcccccctgtgctccaaaccatccatggctcctgtctcaagcaggaaaaagccaaaatccttgccatgggctgcaggtccggcgtgatccagccccgtcacctccctgacctcatctccctgcagcagccctctcaaccgctcacgtacagcctcccaggccaccctggagttcctcaaacacgccaggcacattcccacctggggacctttgcaccggctgtgccctccgcaggagcgccctcccccaggcacattcctctttcctcgctccttccagccctggctgccctccagggcctgcatggcaggggagacctgtggctagccctgtggggactctcgaggccactcatggctgaggctgcagccccaccacgtcctcctggggtgtgagattcagccacaggggccctgccggccttgaagggggtctctgtggcctggggcttgggccgcctgcacttgggtctgggcttgggactggtgtcgatgccagttcctctcgggcactgccccctcgggtaccccagccagcatccctgccccgacgcccaacccttccagcacatccttcctgcccttcctccccttccttctctccttctacaccttcctccctccttcttcctccctctctttctttccacccaaacagcccccctgtcctgctcactccccttcaccccctgcttcctcagctcctgccaactctccctgctcatcccctggggcaacctccctaccacagagccactcccagccaccacccagcgccacccagcccatctgcctgcggccatctgtccttgccttcattacctgcccctccccctcacctcccagccgcccctcacccatgggttctgcctgccatcatctcccaccagtggccttgcccctcccccatccactcacctcccccattcccttgctcccccaccccctacccccatccgctccccctccttcccccactcgcctggagtccagggtcctgtgagcccagtcagcccttgcaggaactcacaactcacagccggacaagggcgcctgggggtgcttggcccgtggccatttcttggctggagaacgacacctcccacgtgtgtgtccagcctggggcctgccacgcctccagtgccctccacagccctttgatttcactcctctttgaaacagaaagtggaacctagacggtggcggtggtgaggatgtgcacagattaagcacctgtggtttgctgctgtgggagtttgctgtggtttcagtaaagctcaggacataccaggctggaggcttgttctctctccagcttccacagaggatgccgatggcagggctggtgggggaatcgcaggcagtgtccccagaggcttcagtcccccagggtcactcagccacccagctgtgtctgactgcccaggccagggtggggctgtggccaggtggcatcctaatccttgttgtagcctggtgcccggccagctgtgacacgggcccctccctgcacagccctggggcaccctaagctccttagcagcctcagggcaaaggccatcctcctcctgcagcgggagtaggggtgggcggtggggactgggagacagccccggggagggaagtggccactcaggcctacagggtccccttttctgcccagtgcggccggattggattgaatggttgacccctagggtgaggcacctcctttatcaggaggctggcacgcaggaggcattcacgcagtggtaagaatgctgcagtgatggcgggtgccattaagtgagcgccgactgcctgccacgtgccaagtcatgcccagccagtgtcattccctgatctcttcccagcccaaggaggctgggtctgtgacccccttttgtagacggccccaggctgagcgagctggacgtgggggaacgggattcaggcccaggcagctgggagtgcaccccatgcctgcctccaggttgacctgctgctgtgggtctcccctctggtctccctggtggggtgccctcctccctctgcctggcatcccccattagcactggaatctgctttctcctcttttgttttgttttgttgttacagaaggcaggagagaattttagctcagcctcctgggagagatgtttccatttgaacaactcccctgaagtggggcctggatggatagcaggccagggtgtgtgtgtgcatgcgcgcgcgcgtgcgtgtgtgtgcgcgtttgtgtgtgggtgcgggtgtgtgcgtgcgtgtgcgcgcatgtgcgtgtgtatgcgcgcatgtgcctgtgtgtgtccctgcgtgtgtgtgtgtatgcgtgtgtgcacacatctgcctgtgtgcgtgcatgtacctgtgtgtgcgtgcgtgtgtccatgcgtgtttgtgtgtgtgcgtgagtgtgcatgtgttgcacgtgtgtatgtgtgtttgtgtgcgcacgtgtgtgcatgtgtccgtgcatgtgcgtgagtgtgcatgtgtgtatatgcatgtgtgcgtgtgtttgtgtgtgcgtgtgtgtgcatgtgcacgtgtgtgtgcatgtgtttgtgcgcaggcagctcagggcccagccttggagggtgaccaacccctgagtgggcagttgtcccccaggtgcgcgttttgtctctgcgcagagagcaggcccgaggggtgagttgctgcctgcccgcctctccagcacgtccgtgcgctctggcctgtgggttctggagggtctccatcccttaccgttgctctgtgggttctggagggtctccgtcccttaccgttgctctgtggttctttctgcctgcctggctttccctcttcttgtcaggaatgcctctgcctgtggtgcgccctctgggatctctcttagtctctgtgtctgtctctgtctgtgtctctgcctctccatctctttctctttgtgtccctctatctctatctctttctctttgtgtgtgtctgtcaccacgtctctgtctttctgtctctgtttctgtcttcatctatgtccatttctgtttctcgatctgtctgtctgtcttcgtctctgtgtctgtctctctctcctctctgcttggaccacaaggtggaggtgtgatgagcttggtgctggggcctgaccagcctggccgcagtaattgctccaggccgtgaagagatttggaaagtctgagcaagggaagatgcctgggagagcgagttgagaggttttctgcatctgctgtgtggaattcagctgggcgcctgaggcaggaatttgatgggatttttctgtgtgtgccccctctgccccaccgtgttcctgttttctgatgcttctctgctcttcagcctccggagttttgtggcatcagagacttccttgggaattcaccgaactttgttttggggactttagaattgtcacaaatagcactatctctgaaaatccctaagggggacagacagcccctatcaaatataaacatgaattctggctcacataactgaagtccagcattggttagcttcaggtaacagcttgatctaggtgacacgatgtcctcaggaccctgtcccttttcatcccttggctctgccatctttcacagggtcttggtgtgttagcaggaaggaagccggtgactccaggccttcctccaggttcaaggccagcaaaaagagagaactcttcctcctcctctccgcatttctagccccaaactgcttttcctcctcaccatgagtgggcccatgcctgtcctagaacctgtcattgtggccggagtagggggtgtattgggagtgcgtgaagctgggccctgctttttcctggagctggcacaggggagcccaggggcttttctgcctctctgtcttcagttttgcataataaacttttctctttcacgctagcttgaagttttacaccaggggcatctgatgagtaagaggtacccactgccccctggcaacttgtgcggggtgtattagtttgttgttttgttccctgcagctttgggtgagtgggaaggtggacagtcatcaggagtgcacctgcaggcctgaccgccaggctccctcagcccccgtcctgggaaacccagcaccaggggaagcgctcttggcaatccgggtttgcctcttctttttcagttgagggtcggttcacaaaaaagtaaccacattaaagtgaagagctcgttggcttgtaggacatttacaatgttgtgcagctgtcacctgtctagttctagatcattctcatcaccccaaaaggagacccccatactcattaatcagtcactccctgtgttagtctgttcttacaccgctaataaagacatacccgagacagggtaatttataatagaaaaaggtttagttgactcacagttctgcatggctggagaggcctcaggaaactcacagtcgtggtggaaggggaagcaaacacgtccttcttcacatggcagcagcaagaagtgctgagcaaaagtggggaaagccccttataaaccatcagatctcatgagaactcactcaccatcatgagaacaggacgggggaaaccgccaccatgattcaatgacctccacttggcccctcccatgacatgtgggaattatgggaactacaattcaagatgagatttgggtggggacacggccaaaccatgtcaccccccacttccccctcctcctttttcctggcaaccacgaatcactgtccatctctctggatttgcctattctggacatttcttgtaagtggaattgtacactctgcagccttttatgtctgtccacttccactcagcatcatattctcggggttcatccacagtgtagcctgggtcagtgcttcattccttttttttttttttttttaataaagatggggtcttgctatgttgcccaggcggtcttgaactcctgggctcaagcaatcctcctgcctcggcctccatgtccagcccttcacattgcttgtatggatatgccatgttttatttatctgttcatcaggtgatggacttacttgtgcaattttgctgcgaataaaagctaaacccgaacttaaagaagaacccattaaagacaacggcttttatccatggagagtttaaaggaagtaagttttcagcaacttttccaagtgttgctagtggttgccagccgctgcttttactcctggtgctgcctgttagccctggggatggaaatcttctttttgttaatgttgctttggagaattattcccaggttggacgagcagtttgctctcagagttttagggtggcctggcccccatagcccttccttccacatccttgtccttgctctgttatctctcttcttggtccaggtggaagagcagagataggatagcggagatgtttcttgccaccagtagtgcgaccgggctctgggtgccatgtttgctgccaccttttgtcttaagaacctcaagaaatgacatgggctgtagggagagaccagccaagcacccaaggtggaccgcagtgagggcctgggcggtggcgtggggatgtctcacgtcagttggcacagaaggggtgttgggcactctgggtagcggagccagcctgtgcaaaggcccgggggtgccagacgcatgagctgtccatggtttgctgtgggtggggtcagatgcccatggccccctgcctgccttcctgttggggagcagtgagggccccacacccactggtacgtgcatacacactcctgaggctttttctagggagtttttcttccacacacacttttgccttgagtttctggaggtcctgcactctgggtccctggaaggggtgctgctttggcgcttatgctcagccctatggttctgtggggtgaacggatgtgtggctgggaccccacgtggagtccccacatggctcagccccacggttctgtggggtgaacagatgtgtggccatttctgacgtgggagcccctgcagcctcccccttcaagcaccttccaaggtaggatgctgagtggccttgggcatgtcgtcaaacagaaatcccacttcccacggtggttatgacggttacgtggattaagatttgtgaattgcttagagcaggaggccagcaaactccagcaagctccaaatctggccctcagtgtgtttttgtaaataaagttttattggcacacagccatgcccatttgttccccgttgcctgtggctgcttttgcaatacaatggcaggggtgagtagatgagacagagaccttgtggccctcaaagcttgagctatttttaccatctggccctttataggaaagtgccggcctctggcatccagccccagtggcctccaggctctgtttctgcctctgcgtaatggagatggagcagcagtcccctcggagggctgttgtgggatccacttcatggggtgtgcagaggacttcatggggtgtgcagaggactgggataggctgagctgtgagcggccccaggtgtgatttctaggtgtccctgggggaggtggcctgaggagcatggaggactgcattggggcgattgagggatatgagcccttttctctgtttccctcgaggagtccgtgtgtgtggagggagcaccgggttgtccaggcccctgctgtccttgcccccacatctcacatggtaacagaggccagaggcaaacctaatgtgactccaagactcttggcccctgtgggtcttgctggggctctgtggggtgaggggaggacagaggccctgaggatggcaggagtggacagaagatgatgcagcctctgtgaatcctgaggttggtggggcactcggtggcccccgggctgcagttgtccggagaataatgcaccctgtgtcctctgggtgcagctgctgcgggggcggggaggtggtggcctggcgctgctctgggccttgtctgccagcagctgccggcttggccccaaggatggcacagggcgggggctgggttctggagcccagctaggggaggaccatcccagccaacatttattgaggcttacggtatgccaggctcagagccattaactcattcaagactcacaaggaccggggaggtgccagctgttctccccattgggcagatgaggaactgaggcaggaagcagttgaatgacctgctggaggtcacggaactggagagtggcagagggggctgggatttgaacccagggctgcacaggtgaggcctgggttgttttttctaacctccttatcctgagagtgtttccagcacagcctgggtgcaccagactttagctggtgggatgaaggcgtccatggataactgaatgcaggcttcctttgttgttaagcacattttcaaaaacagctgtattacacaaagagtgactctcagtgaaagaagatcagaaaaaataacgggcaaataaaaagaagaaagtaaaaataccctcttctgccctgctgccgagataactccttttagcttaactgtagcccgttctgatggcttttccgtgtgtttgggaacatatgttttctgcaaagccacgtgtgtgttggctgcatggttctggaacttgcgtgtttggactgagcttcatggatgaatgtttacagagggtatgcagaggccaggccttgggagaatggaggctgtgggtcttggttccttgggctggtggggaacacacagatggggtaagtggaagaagagaggtgtgttacgcgaacagggagttggaagacttcacaacttgaggagaggctgggaaaccattcatgtagcaagagcatttgaaccgcatcttgaaggctgtaagggactctgaattttggagaatgggtgatggctgggatgggaatgggatccttgaacaggtgaggactgtcctgacagatgtccaggactctgggcctggagtcagggatggaaacccggggtgtattggggagggggtgtgtattagtccgttttcatgctgctgataaagacatacccaagactggtcaatttaaaaaagaaagaggtttaattgtactcacagttccatgtggctgtggagggctcacaatcatggcggagggcaaagaggagcaagtcacatcttacatggatggcagcaggcaaaaagttggcaactacattagtcagggttctctagagggacagaactaatagaaaaaaaatatatatatattacataaaggggagtttattaaggagtattaactcacacgatcacaaggtcccacaacaggccatctgcaggctgagaagcaaggaagccagtctgagtcccaaagcttgaagaacttggagtgtgatgttcgagggcaggaagcatccagcacgggagaaagatgtaggctgggaggctaggccagtctcgcctttgcacatttttctgtctgctttatattcgctggcagctgattagatggtgcctacacagattaagggtgggtctgccttctccagcccactgactcaaatgttaatctcctttggcaacaccctcacagacataccgaggatcaatactttgcctccttcaatccaatcaggttgacagtattaaccatcacagggttgtacagactggggggtgtcccctgtgctgaccccatgcccgttttttttctgccacaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcaggtgtgaatgggcagggggagggggagtgtttgttctgagtctccattctagcagcagtgacagcggtgtcacagacatgtgccaagcccttcccaagttcctgggtgctcactggtttttatgccctttacgtttattggacaggagcacatccacagaactttctgccatgatggaaacactgtgtatctgcaggatagccatgttccactgttgagcatttgaaatgtgcctactgcgactgaggaactgatttttaatttttatttaatatacgtattaaatgtgcctttgaatagccacacaggctgccgcattagacagcacaagaatggagggtgaaagttcaggatttctagccagtctgtccaggttcagatcctgtttcttccagtaccaggcaacgtggggtgggcagtcccttctctgtgcttcactttccttatctgtaatgtggggaaacagcccctggctctggaatctgaatggactggcctcctaactgctctttactagctgtgtggccctggaaccttcatctcttggagccttggtttccttgcctgtaaaatggacaacttgtagaggagggagcaagatcccgagattaaaaataaatcctcattgtcactgttgaaaccacacaaagacaagcggagaaaaagctgatataaatatttataacattcattttataactttgttttaaatatgagttaatatacaattctttgataatctgccttttcccagctcttcatggtttgctccctggtatcattcaggtctctgctcagatgtccctgacaccaagaggccactgtcagccttgtacaggaacacacacccccaaccctcctctatcccgggttcagccaatccagccaattctagctgctgctggtttttgtaaataaagttttattggcacagccacgaccacttgtttgtgtatctgtatacacatgtgtgtttatatgactgcttttctgccacagtggcagagttaagtcatcacaacagagacctgtgtggcctgcaaagtcaaaaatatttgctgtttaggcctttaaagaaaagctttgggctgggcatggtggctgatgcctgtaatcccagcactttgggaggctgaggctggaggatcacttgagcccgggagtttgagaccagcgtgggcaacatagcgagaccctgtctctacaaataatttaaaacattagccaggtgtggaggcacatgcctgtggtcacagctactcaggaggctgaggcaggagtgcctgagcccaggaggtttaggctgcatgagccatgattgccactgcactcttgcctgggcaacagagtgagactctatctcaacaaaaagaaattttgctgatcactgatctgtctcatcaccctgctggtgacatcattatttgaattaatatagacccagctttgttatacagtggtcctctccttgtctccctgttaactgctgtgttctgagcagcatggggtacatagtaggtgctcattaaaaatggttgattgagtcattgtgacactgtctgggccccagggagcgtctagactaatgggagaaacaggctcatatctagtgccctccagacaaggaagtaggggctccaaggaggatcaagggctcattttagccactgtaggcaggtgggtgaaggctggtgagagtaggcttccaggaagaggtgccctggtagctgggttttgaaggacgctccagggggagagcattgatttcaagtgtccatcgtggctgtcacgtggttgggggaaccaggatttgaggatagtccagcagtgagacccggtcctggagactctgccaactgtcctaggcttcagtgggcagtgggtaggtctcatgttggtggcacaggcatcccgagaggggccgggccccagcggcgtgggcaggcattgccagggccagcctggtaccgcaccgttaggcttccaggcctggccttggggtggggctgaagctgcgggtcactggcacacattggtgactgcagctggaagccaggtggctcaaggcagccctcaatggttaggtttttgtttgtttgttttttcccctctaaattccactttggcattttttaaaagtgaaattctcaagcataattattttaaagtgcacaattcagtggcatttcgtacatttgcagtgttgtgcagctgtcacctctctctggttcccagccatttcaacaacccacagggaagcctcataggagctaaagcagccactccccgttcccctactctctgtctctatggactgacctgttctagacatttcctatatagggcatcacacagtatgcgtcctttctggcttcttccacatagtgtcatggttttggagtttatcatgttgtctcttgtctccatccttcattcctttttatggctgaaacatattccgttgtatggagatgcctccttttgtttatttcatcatctgtggccatttgggctgtggctgttgtgaatagtgctgctgttgaacatttgtgttgaagtttttgttgggacacctgttttcagttctcatgggtatatacctaggagcagaattgctgggtcgtgtcgtacagtaactctaggtttaatttgctgatgactttccaggctgttttccacatcagctgccccattttacattcttaccagcaatgcatgaagattcctggtttcctggttttccacatcctcaccgaccgccccccagctttttttttttttttttctgagatggattctcactctgttgcccaggctggagtgcagtggtgccatcttggctcactggagcctctacctcctgggctcaagcgatccttctacctcagccttctgagtagctgggagtacaggtgtgcatcaccacaccgagctaatttttgtgttttttgtagagatggggtttcaccatgttgcccaagctggtctcaaactgctggtcttgagtgatctgcccaccttggcctctcaaagtgctgggatttcaggtgtgagccactgtccctagccacaccaacccttttttatcttcctttaaaaaatgtttttgattccagccatcctagtggttgtacagcggtatctcattgtggttttgatttgcattagagagccctttatagcgtgtcactgctgtgcagcagttttttcagcattatctccttgatcttccaaacaaccttatgaggtaggcatatacccacaggttctgctgaagtagacactgaggtcagggaggtgaagggccctggctgaggctgcagagctggtgagcggggggctcaggcttgaatccaggcccagcagagctagtcaccctcttagctgggtctctgtaggtgtcccaggtagtattttctctagtacctgaggaagggccaccttccctggctggagggagcctccctcctgcccaccctttcggggctgtgggcttcttccccttcttggctttgtttgttccgtgctttgggggagcattttgatgcccttcttgaagcgaccaccaggggtcgctgtgggactgaggcagttctgctcaaaccgccagcgatggagtctgtaaaagccagcatcctggattttctggcttttcctgtgttcacttcttcttgggcacctttctgggttcatactgatctgctctgtggtaatgtgcaggctgtgcgagcgtcataagtggagcagaaccatgttctgatctcacttgtgatgccctgtcacattgcagaatggggcattggccttccatctgaccttgggccagtgccctaaaccctctggtcttcagcctccctcttgctatgaagcagacggcagcatgatgggatgctctttccaacggtgttaggaggagggggttcatacatggacagatgaggatgaggatgatgggggtgatgaggatgagggtgatgggggtgatgaggatgagggtgatgggggtgatgaggatgatgggggtgatgaggatgaggatgatggggtgatgaggatgaggatgatgggggtgatgagtatgaggatgatggggtgatgaggatgaggatgatggggtgatgaggatgaggatgatgggggtgatgaggatgaggatgatgagggtgatgaggatgatgagggtgatgggcgtgatgaggatgagagggtgatgaggatgatgggggtgatgaggatgaggatgagggggctgatgaggatgaggggggtgatgaggatgaggggggtgataaggatgagggtgatgaggatgagggtgaagagggtgatgaggatgagggtgaagagggtgatgaggatgagggtgatgggggtgatgaggatgaggatgatgggggtgatgaggatgagggtgatggggtgatgaggatgaggatgatgggggtgatgaggatgagggtgatggggtgatgaggatgaggatgatgggggtgatgaggatgaggatgatgggggtgatgaggatgaggatgatggggtgatgaggatgaggatgatgagggtgatgaggatgaggatgatgggggtgatgaggatgaggatgatgggggtgaggaggatgaggatgatgagggtgatgaggatgatgagggtgatgggcgtgatgaggatgagggtgatgaggatgatgggggtgatgaggatgaggatgagggggtgatgaggatgagggtgatgggggtgataaggatgaggatgatgaggatgaggacgagcagggtgatgaggatgcaggtgatggggtgatgaggaagaggatgatgggggtgatgaggatgagggtgatgggggtcatgaggatgacgaggatgatgagggtgatgaggatgaagatgatgggggtgatgaggatgaggatcatgggggtagtgaggatgaggatgatgggggtagtgaggatgaggatgatgggggtgatgaggatgaggatgatgggggtgatgaggatgaggatgatggggttgatgaggagcacctgtgtgtcaggtgctgcgtgctttgcacgcatcatgagctcatttcaccttcacaacggctctctagagtagtaactcttttatccccattttccagaagaggaaggtaaggcttagagaggtccaggagcttctcaaggctacgcagtaagtaggagtgggagttgggctccagtctcaccagtgcagctgtggagtctgcacagcctctcctagcactgatgctgcctgtaggaaccgtaatgggtaataatgccggctcgcagcaggcctgactgtgcctgcctgtgtaactcattcagttctcaccacagtcagaatggcggcacggcaatcagccccgtttactgatggggcaactgagggctagcagggtgaggctgcttggctgtgcttccctggctggcaagtcacgaaggcaggatttgaacctggctttggagcttggaggctgcagctggccctggagctggggcctctcccgggtgcggagtccctggggtgactcacaggaaatgtgtagcagcctgacttcctgtgcgcggccgtggcccgggctgcaagggggcctccccgcgccctgggggctgcagccctccttccgcccgctggggtgctcatccctcacgttctgcctctccccacagcaacagctggaggaggaggctgccaagccgcccgagcctgagaagcccgtgtcaccgccgcccatcgagtcgaagcaccgcagcctggtgcagatcatctacgacgagaaccgggtatgtgtccccgccctggcctgctgccccccggtgctggccatgaggcgcttcacagggggcaccatgaatcaggcctcagtgtttccatctatgtggggaggggacctcgccaccctctcccccagagacgcagggtttatgagtgggtgggggaaggtgaccggtggaaagccatcctggtgtggcctctgggctgttctgctcagacactcagatgggtgtggactgtggctggtcagcaggatgcaacacaaaacagaggttttgggctccaggagagcaccagggtccagctcatggccaagggtaaggggctgccactttaggtgctggtgcagaagaaatccctttaaggcaaaagataatgacattatgaccgcagcagtgaggtttcatggagcagcccctcctgtcagtcctggaagggcaggtacaggtgtcatttccattttcctaaggcccagagaggttaagtgacttgtccagagtcacacagctaggaagcattggacctggatttgaacctgtgggctgtcagaccacagggcctgagttctcagcactggcttccactgacactgggccctggaaggggcctttgagatgattgaaacacagagtctggagcaggctgtggaggcccatggagatcccactgggggcagctatagtgggtctggtcttgctggaggggcttgggatgctcagagcagtgtctccaggggctggaccctaagggtctgtgcacccccaaggtggaaccttgtgtctggtgaggtggtaagctccccatcttcccagtcaagccactaccagctgggctttaatgatttacagtgtactttttctaaatgtactcaggatctgtggatgttgatcccctcccttattttctggatgaggaaactgaggcccagagagggactggtccttgtgaagcatgacagatgaggaacctcctctccctgccttggcttctctggttcccctcctgcctgtagtcccagccacccttcccagctgccttttctgtaatatcttccttggccaatcagtgctcagagttgaggtgggggtggggaggcctcgagtcacgtggtgggtgcctgcagtggcagcctgaggcagggaactactggatcaacctgtttggctatgcctccacctctagaaacagcgatgtcatgcagaatgagacaagcctgtttggggcctgggaactgtgtgcccggctcactctcccacaccctgacccctcaccccaagcaccactagtaacagtcataggagagccaaggggccacacatccttcagccagccatcctgggttcaaatcccatttctcccacttcctggctctgtgaccctggagcgttgtacttaaaccttcctgtgcctcatgctccacagctttaaaacaatgacaacgacggcatcacctagtacagttggtgtggggactaaaggggtaatttcctagtgcccttaggacagacagtgtctggcaccaaagaagtgccagctggtgctattaattgtcattatcatagctctcatttcttcttgtgtttgtttaccttgtgcatttaatagaatactatttgcatttagtagaactactgttattctctcaattttgctcatcaagaaaccaaagctcagagagggaaggagacctccctgagattgcagagcaagtgagctttgagcctgggacttggagccaagattgagatggctccaggagcccaaagtggaggggacatgggcagggctcctgagagtgtcacctctacctgccctctctgatcctcggtggagagcagacacggttctctccagcagctgtggaggccaggtcagtggcccagcacattgctgcagtgccttggccctctgcctggagctcctctccttgcaaggctcatactgtcacttccctctttgctgaagtggccccttctcagcaagacccgtttcaaccctctacttaatactgaaaacccttttttcaggaaaaggagttttcaggatgacacccgttttcctcctttgtggcttctgattctccttagcccttgtccccatgggacatgatttctgttttacttatttattctgtttattatgaatggaaactccgtaagggcagggattttattcctgcccacttttatttccagtggcatctccagcacctaaaacagtgctcaccacacggcagatgcacattaaataattattgtgcaaatattcaggcggcaggaagggaggggagatggaggcgggtggccagctctggcctgtggaagaggcctctggtttgggggcgtgggggctggtggggatcctccgcccgggctgagtctctgagcctccaaagcctgcagcctaatgtgcgggaggcccccagccgcctttggcaggagcagccaggacttaccgccccttgggggatcagtaggattaaattttaatctgccttccttccctgctggttcctggagagatggaggacaagggtctgtttttcgagccagccggaaaacgcagcttccctgccgggcagggcccgcctggcagttctgagtgctggagtctggctcattatccattcggagcacattggtgaggcacccgctgagcgaggcttttcccgcctccccgcctcctgggagctgcctgcgtgggtgggggccgggcaggtgtgcacagatggcagggcagccatcagggtggctgcagcctgagagcaggagcagacggggtggcctgggcccaggagggcagaagcgtgacctggaagtgggtgctgggaaaggcttcttggaggcagcgggtgggccggaaggagggcgttagggtgagggggcatggcacaggccaagtcccagagaggggactggcgtctcctttgatcttcaaaggtggtgggcacgaggtaggagcctgttggttccgggacaaggcacgcacttggaatctggataaaacatacacagaggcagcgctagcgatgtgtggatacataaggggcatttgtgcagcacaggttgctggtaccgtaggaattcaggacactggggaacagtcaggatgggcttcatagaggagacgggccttgagctaggtcgactggggaaaggtagaaggctgcttccaatagagatgtagatggctcattcacaaggtggagaggaggcaggattgatggaagcggcaaccccagttgctgagtaatgcggaaatcagcagaagactcaggtccttgtcttccagtttaagcgtcttaaaaggaaagtgtttatatgatgtgattaggactcagtgtgtgcacagtgtgatcgggactgagcagggcaaagaagaataataccattaacagtcaccgtgaacgtgaagcattcagtagagccttttgggggttttggcactcctcatgcttgtttgtagggcccagcatcagatcccctgattgaagattttcagagcagtgcttcagaccccgtcctgtggcctcagcatcctgggccaggcccccacctctggcctccatgcccggccacctggtcatcaaaactgcccccagggtccaggggttctttcagattgtccgtttcagccccgcgaggctgctgcacgcgtcctctgacctgccgcttttcctgctcgtcacccaccctgggagagctctgcacggggctcatgggcatggggctctgtttgcagatgaggaagctgaagctccgggtaggccgttgccctgaggcactgctgcagccagcggaggggcttgggtgcaggactgggggctcggggcttcttgggtgagtaggtgctgcccccaatctgcagatgaggaagccagtgtggcagagaaggggctaggatggggcttccaggcaggggagaggctagggagtgatgagtgtcaggtctgtttctgtgctctagaggagagccgcatgtggatgtatgtgtggtttgtgtgcctgtgggtacacgtgtgtatacgggtggatgtatgtgtggtatgtgtgttagatacacgtgtgcctttggatggctgtgcatacttgtatgtgaatacttagagtaagagtcagcttgtgtgggacgagcatgtggtgattcgtgcattgatacagcacacttgggtgtgtgtatgcgggcatgtgtgtatgtgtggacctctggatggctgtgtgcacatgtgtataagcgtatatgagtcagcatgtggggcctgtggttatctgtgcacttacacatccatgcatacacacgtgggtgcgtgtatgtgtgcaggtatacctgtgggtgctgtgtgcacatgcgtgaacattcatccacgaattggcacatgtgaggcatgtatataggtattcgtgcatctgtgcacctgtgtgcatacgcatgtgttcacatgggtacacgttaggctgtgtgcatgtgtgtacaggtggatgtgcgtgagatggcgggtgtggggcgggtgtggttacatcatgtgttcacttgggtgcacatgtgtatgtgcgtgcgccttgatgtgtgtggacatgtgtgtatgtctttgcgtgttcctagatcttggcatgtgcacttggtaacgtgggtctggtgctcccgtggacccgtctgcataggtgactaaggacttgtgtgccccagcacagctcctaggctttttgggcatgggaggcctggccacgcagacccagagtctctgcaggggtgccactgctcgaatgagaacgtgcccggatctcagttggctggcgagagcccctacagggggtggacgccacggtgagcggggccgctcattggcttgagtccctaggttttcctttcctctcagagccaggtgagcttgggcagtggcttctctcaggcttggccacctcccctgcggcgtcagccccacccaccacgatcagagcagagacctcggcccccaaaggccaggaacgtgggaggacgtgcgtgggggcagtcgggtttcagcgggattgagaaaggcctgtttcccttctcccccaggttggggctgagtcccctgaattccagcctcccagccggaaggtggcagcccagcctgaagccctcctttgggccggagcagtccctgagttttgccacccttgggtggagttagttcagctctaacaagtgtgtcctggcgtcccctgcaagctgggccttgggcccgcatggggaagatgcagacaggagctcctgttggagcacttgctgtttgccaggaccaggggcagccagggagacagtgtcgggaggtggcccccaaaggggccgaggagatgtggagatatcagccacgggaatattggggttggggaatgttctagatgggagaggttcaggtgggaagggtttgggattttgcctagaactgtgtggattggtgacctcctatccaagtgtcctctccgagcctcagtttccccatctgtaaaatggggcagcccctgcaccccagaaacaggttactgggaggcttggcaatcctgattgtggcttggagagcagggagacagggcctgccctctcatccacctctatggagggggcagagaggactccgtgtccttggaaaggccaggcacatccgggatgtggactgcttcccccatggccctggagaaagtgcccactgccctcaaccctgtgctgggccctgctggacgatagcagcttggtggccagcgctggcctcttctggtcctggtggagaggcagggaggccctgggccagctgcagcgacgtggagagaggacagggttctgggctgggaccggacagcctgcaggtacaagaatgctttgccccagagaccgcctgagcgagggagccagccgcactccatttccaggtatttagaccattcctgagcatccactgtgagccagacactgtccaggcactgtgggtgcagcagagaacagagcaggcaccttgctcctcatggagtcctcatcaggggaggtggccagtaagataaacagtgggacgcagacccttatccctgaccgcatgtgctgtgaagacagccaggtgggaaaacgagtggtcgagggaggtggaccgccctgctgcggggggtcagggaaggcctctgtggggaggggaggctgagtcaagacatgagcaagaggcaggcgagagcatgtgaagatgtggggaacagcattccaggcagggaacggtaggtgcaaaggctcagaggcagtagtggctttcagtgtgcaggggacagtgaggggccagcagaggtcaaggtcctgtgagggctgggaccctgttgaccctggcgaggagtttggatttggtgctcagggtggcaggaagacagcagccgaggaggtgagggggaatttttggcatgaggctgaatctgtggcctgcgtccacgttccccagccatgccacgttctagagggtatctcctctgcattcaaagagggaagggatgacatgcacttcactttgctccctgcagaacgtccttgcagaggtcatgggagtttggtaccctgggtgagtgtggccgtttcgtgaatggggagactgaggccagactcagtcaggagactcagattgctgagggttagagcacagccgactcccagatgttgggcaggtgtgttgagaaaggccagcccatcttgggacagggctccacaggcccacctccccaggaggctgacaagcaggaccagagaagaccgtggagcaggaacaaacccaacactgggagcaggggatgtgggggcaggaggtgaaggaaacaccccagagagacaggaggaggtggggctccctgtggctttggcaggtgaagaaggggtcttccttgctctctaggtgctagctgtgtggccgtgtagtttctagtggcttggccctttccgttggtatcactcttttatctagatggacagttgctgctgatccccacagatcatacacaaactcctattcatccctcaaaacccagcctatatagccctcctgttacctttttgggagagtgacttgtgccccactttcacacatacctttatctgcctgagcatactaatctgctgttactgctcttaaccaacagccattgtttgggtttattccaggcaggggccaggtctcattcattccatgtctctccccaggtcccagtgtttgggagctgccctgcccccatgctaccccatacccagtccttcactgggcctggcttaggggttctcccatcttcagtaccccagggcagactctttcctgcttcgagggtgtggctgggacattgactctccgggtgatgtctgcccccatccaccggaaatactagtcccaagcctaggggtggtcctgcatgggacctggcccttggcttcctctgtccgtggatcctggaggtcataagaagggcttcttccctgtgttttgtttctgtgcctcagtttcaccatctgtgagatggggctactcctgcctgtacctcccatggcgcttatgcgcaattgacatgttaagaacacaccgtatgcccgacgcttggctcatggcaggtgcttggagaagtgaccatcgctgtaatagttctcccctgctcttctggcccccagccgcaccttgaggctgcaggtctcggggttttggctcagcctgaaggtggccaagagcatggctctgctcttggtgggccgggctctgggctgtaggcggaggcagctctaggttccagcttgagcccacctacatacctgctgtctttctccgggggctggggagggggagtgatgctggcctgccacgccctcctctctctgctgcagcccgggagcctgggcacctccgccctgcgaggagatcttggcaaaggctgcgtcaaatttttgttggcagccacatttcccagggcttggggtcacctccttttggccaatctggtttggggtcactggggacagtttcagtatggtgatggtgacttctgcggcctgtccgcctagtccttgccaaatactgagtggctgccccaatgcagctgagtcacagcaggggctcgcccgcgtgccagcctgtgaacacccatttgccagcacacacgcagtttagcctggtgcagggggcacccaaacccacgcaaattctgcccctgccctccgccacagcccccatgaagccaccttcaggagcccctccgccccccacctccctgtacccggctggcctgggctgccctccaggcctcctgtgagtggaccctggtggtcccaggctgcgggctggtgggcctggccgaggcacaatgtctgccttcacaccgagggccggggtgggggcccggaggtccagcctattgatggagcggccaccgagccctgcgccacatgttcctgttttcctaataagtccccagttgtgagtggggaggaggcggggaggccccggggcagcccagaaataatcacatgattgtgaaacacaagaatcctagaaagggtatctccgagcgcctctatctcaccctccctcctcctcctcctcctccttccctcgctggctgcactagctctgaggtaattgtagacaacccaaccagcttccagggcgagggaaggcatctcagggctggcagtgtcggctgggctggtggggagcggtgcccacgtcgctgggccctgggggagcgaggcctgcgcgcctgccggggagcaggcttcagtggacccggcgcatttgctaaaatcgaaacttggctggcttgctggggccgctgtgggggtattgaggctcctctgtgtttttttccagcgtggggagggcctgcagggggccccgggcctccctcccccgtgctgaggatcagcatgctggactgggctgggcaggtgcccgctgctccgggaagcctctatttataatctgtgtttttttgttttttaaaaaaattcctcctcttcgccatcaccctgcagaagaaggctgaagctgcacatcggattctggaaggcctggggccccaggtggagctggtgagctggggtacagggtcaggggctcaggggagggcgggggtggctggagaggtgggcagggaggcgggagggtgcggcggaggaggaagtcatctattaccaagcgctgcccaggcggcgtccgcggaggaagcaggaaacccaccttcctgatgagaggacggcagatagcgggtgggcgggcctggctgggctgggtgggggtggggagtcttggcagcgagcgcctccggggccacctgcgcactcctgtgcataccgtgaagcccggccgctcgggctgtgaggagagtcacacatccgtaggccggtgcgcttgctccagctgagcgcggagagccggttctctgggtcacacaatctcggtccactcccaggtgcaccgcttcatggcggtgtgaccctgagcgggtctgttaccctccctgtgcttcagtttcctcatctgtaaaatgggaatcctaacagcacctattccactggattacagtgaggaggagctgtgttaatatttttccaacatcgggtgccgcgcctgccttgtaaacagtaagtgctgggcattagctatgatgatgatgatgatgatgatggcgatgatggcgatgatggctgtcactagtgtccttttgctgcggaaagatgccatgtcagcagcagagctggaaagcaggccccaggcctcctggagtccctgggctgaggatgggtggatgcagaagccctagcccccagagaatgggccgcagcccctgcctgccccacagccatctgtgcccactgagctggtcagcatggatggccgtggtgggcactgaaggcatatgctacccacatgtgtgccggatgagggagagtctctgtgtgcatggtgggctagggtgtgcgtgtgagtgcgcccagggtgcagataaaggcttatgccttcgccatgtgtagtggctcatacctgtaatcccagtgctatgggaggccaaggcaggaggattgcatgaagccaggaatttgagatcagcctgggcaagatagcaagaccttgtctctgcaaaaaattaaaaaattcaccaggtgtggtgatgcacgcctttcgtcccagctacttgggaggctgaggcaggaggatcgcttgagccctggagttcaaggctgcggtgagctatgatcacaccactgcactccagcctgggcagtagagtgagaccctgcctcataaaaaaacgaaacagaagtctgacaccttcagagcctcaatctaaactcagctccactgcatgtttgccaagtggccttaggaaaggggctgacctcccagtaccacagtgctctctcatctgggacaggcggaggctctagggcctccttccagggtcttcccagggttaaaggcagtgctgcctgttaaaggctcacctagtgcagctcctggtccctacgaagcgctcagtagttgtgaacaatttggtgatgagctgctccccctgaagtttctgcaggctgctcagttttgcagtgagagctccccaaagcccggggtccgtctgttgaggccactcaggaactacaagccccgggctcccaggcccactcagaaggcagaagcagggaggagatggcaagggctcctccagctcagaagcagggcccagctgcccacctggctggactcaggaacctcgctgggctcccccaccccttcagggctctgccccctccaggcacatcctcgggcctgggcgatctgggtggtgagctctggcctagggtcgtgcttctctcagtggaagtgatatctggggaagttttcagcagcagcagctgctgcttgcttgtttttttgttttgtaaacagctttattgaggtacaattcacacgcatgccattcactcaaagtgtccagttcagtgggttttagtgtattcacagatgtgtgcaactgtcaccacggtcaattttagaacattccatcatctcaaaaagaaacccttctgtctctatggatttgcctattctggacatttcctataaatggaatcttgcaatatgtggtcctttgtgtctggtttctctcactcagcatcatgttttcgaggttcatccgtgtcgagcgtgggtcggtccttcgttcctttttgtggctgaatcatatttcactgtaggggtaggtcacgtgttgtttacccactcatcagtcggtggacgtgagattgtttgcatatttggggtattgtgaataaagttgctgtgaacattagtgtgccgtttccatgtgaacgtacgtcttcatttctcctgggtgtgtacctaggcgtggaattgctagatcctctgttaaccctgtttagccccttgaggaactgcccaactgttttccaaagtggccgtaccattttacatctccaccagtaagctgcctcttgcctcggtttctccttttctgccaaatagggatggcagggttggatgaagttcccaagcatttccagatttccgggtcctcccgctcccgtttcctgattggtccccgggggcctcctgggggaaagggcctgtgtcttagggcccgaggaacacaggcgaggaagcccctgtccgtgggagtctgtgggcagatgggggtgggcagctgctggtgtcagaagctttggaaccagggaccccacagtgagtcttctctggttctttggagacaaggggacggggttgtcttccacttggggatctcagagcagaggcttccacaaggctgatggcacaggaggctaagatctagtgtttggactcttgaaggcccctggcttggtgccagtcagtggggacagggaggacgcctcacagagctgttgccgtcccattttctggatgaggctcagtgagaggagtgccttgtgccgggccacacagcaagagatgaggcgtggaggtgtgctgagcccctgggagagcggccggccagttctgcacagatctgccaggcccgagtggccacaggcatcctccaagcagaggcagctgcatggtgcaccctctacagggtcctgtctaccaactgggtgccagaagcccgggccagggacggcctgaggtgctgtgggtcacagagtccagttcccagggtgtcttccatcagaagctgcagttccaacgcccctcccctcggcagggacggatccctgtggccttcctggaggaatttgcattggaaaggatgaaaatagcaccagaggtgctaaccaggggtcgggggcactgagatggtggggcacggcccctccagcccagctgtggggactggaccaggctgggagcgggcgcagtggtggagggcgtgcccagcagccccgacctctctgccgctttgagtcattgcttccttcctgttccaaggcgttattttaagaagctggtgtcaccagcgggttgagggctggggctgtcacttcatttattgccagctcaggccgcctgggactctggctcttcctggtggccctgctggctggctcaaagcccgaggggggccgcctcctccctggcccctgctggctttcttagtcaccaccatgcctcatctctgcctgcgccctgcgtctggcacctgctcccctttgccctctttctgccctctgagtggctgtgcctctgattttagaggagacggaggctgagcaagagagagctggaccttggggcctcctgggtgccgcccctaccaccccaggctccacacgcatctaggcctcgattccctcactggcgtgagtccccccaggggtcatttctcccgggaggataaggcctgggggtgagggacaggggccagccatgccccccagcctgtgtggctgtggaggtgcctcatggccccatgtggggaccccggctagcctgggctgggagccgccaggcctttgtgcagccctctctgcagaggatgagggggatgttggggagtcccctcgggccctgcgtcccctcagcaatgcacctgccaggacatgtcactgtccctccctccccccactcccttctgggctttccaagatggctgtcctcagcctgttgccatggcggtgcacggcattccaggcagctctgggcccagagcctcccctgggctcctggggttcaggggcctcggggagtggctggtgagtgcctcccaggggggcagctcctgtttagaggccgcagcaccccacagtatcctcagtccttcggggccttcgccttgtgggcccctcaccgatggccgccttgagaagcaggggctgtgtccctatctacagggcaggggaggaggccaccaagtggaagtggccttcctcccctgtggctttggtgggttggaggctgaccgggctcttgctgcccccgggagccggtcctgcatttctgcacccgccctgtgccgcagaagcactgtcccctctgcccacctcgccctcccagggctgcgtgctgtgggcttccagcccctttctggcccccttcggctgtttgctatctttaaaaccaaaacaagacaaacaccaaatttcaccaagtctgaaattttctgggctatccaaaatttccgtgaagtaggtcctctttgacctacacccatattccagatgaggaaaccgaggctggagtgttgagggcacttgtccaagctcacagctagtgagggaggaggcaccatttaaattggggcctatctgtttccaaaacccgaacctttaagtgatgtccgcttgcacctggcctgcatttgattggcatgtggggaacataaaggagccagtgtggttgcccgggttacagcatgggcatcttcacagggccccttgccattcctgagacgaggattcgcaccctctgcagggatgctgcactgcaccccttccctccactgggaagttctgcagtgagtctgaccgtgggctctcttgttcctctgcccacttctccctcttgttcaaacttccagggtcagggtggggaaactgccctctgttcagggctgagaaccttgggaggggagcctgacccggcacggggagaaatggcccatggcagctgcaggatgacatctctgtccccaggagagtagctgagcaggagcctggaattgcccgagcccagtggtgaattctctaggaggggatctggggctacagggggaaaggcgacattgtcaccagccgagactgtctgtgaggctctgtagagctgcagaggcccttccctggggatgggtgggcgggggtctgggtggcccactctgctggcgtcatcaggaggtgtgttcagctctatccccagggaagagacttgtgtgtcccttctgtcgctgcagccctgccctgaggctgcaggactccacgtctccatccttccctgttccatctgatcactcacactctgtacctgattttcccaccatagtcacccatggccaccctgggaggctcctgctgtgtgcatgggtgtgtgagagggagagggacaggaagagagggagacagacagacagaaagacatacacacacacacacagagactcaggcagagaggggagcagactccttcctccagcgctggggctgagaggcgggctgtcattcaggctcatctcttaccagctgtgggcaaatgttgtaacctcttaaggactcaatttttctttctgtacagtgggggatgattgtatcagttacccggtatggttacatggctactgctggggaacaaagcagccccacatttagaggcttgaagcagcaactgttcactgtttctcacctgtctggaaggcaactgagcatttctgctggtgtgggctcagctcttgcacctccgtggccagcgagggagtcggggggccggcgttgtagatcagcccaggctgggttgcaccacgctgctccttgcctctctgcccgcttcctgcaggccaggctaggctcattctcttgacagaaacagcagaaatgcgaactcgcatcttcaagcctctgcttttgctaagtgtgcagcaattccactggccacagcaaggtcatgggtggttacagggaggcgtgaaaggtgggtgccattagcacagccactgctccctgatggcggcaatgtgactggcacctctgggcacttcagcctgcaggtaccagcctgagagcttagcatgcactgtctcgtttgatcttcacaaaatcctatgagtttaaccccattttatagatgaggagaaatggaggcacagatggaataagtaacttcccagggagacccagctagaaagtatcagaaccgggacttgaacctaggctgtgcccttggttgctaagcaaggttcttccatctgggaggggacacgtggcagctggcttggtccctgcaccatcacagatgctgccgtgctttctgcgtctcctggtacgctctttgaagccctgtgcttgctacatgtgggccctgcctccctttctcactgctgtgtgggatttgtggtgtaaccgagtcctggtctccttagctgctcttctggtggtggacggctagcttgcttctcactggccgctgtgagcagtgcgttaggaacatcctagcgcccgtctcctggtggagcacagtaggcaactgcaggagcatgggggtcggaagcgggggcgtcggtgttcgttaccaggtagtggctgttgtctctctgggggatgtgtgcccatacaccatgctcccaccagctatgtgccagccttcctgtcaccccagacctcaccaacacttggcattcaacgtttttgtcttttgctggtcagtgggggtggagtggtatcttgcagcgttgggacgcgcgtttccatggtgagctaggaagccaagtggctttccacgtttggtggccagggccaatctctggggtgtgtgtgggtttgtccgggtgtgctctgggctgtggccccttccaggccagcactgctgaatgccccgcagagcagccatgacgaccttggtgggggtggtcacagtacccacagctgttcccgaggaaccagtttcagcctgttcctggctggggctgcgtgctgggtccctgtgttctgtttcatgcctgcctgcggctgagccctcacccagaggacagctcctccgtgccagggctgtggctcctaccggtgggctctgtagtggccagtggccagccaggctctgatgtgcttctctctctccctttgcagccgctgtacaaccagccctccgacacccggcagtatcatgagaacatcaaaatgtgagtgctcgcgggcagccgtgcagacacacagaggcagggtgggcgagcaggctctcagcagcctgcatgggatgtgggacgtgggctctctgttcccatcaggggctcccggccagggccaggtgctcccggaggggacaggagacagtcctaggtggcacctggggtgggggtggggagcagagagagtgtccccctgaggttttgggagacaggctgggtttgggagggtgggcgagggagctgctggtgcacaggtgggtctggagagacggaggtcagaggtcccaggctgtacatctgcatcctgttcgagcaggagggagctgttgcgggcagaaggcagccggctcagggagatggggagtggccccagagcaggcgggggcctggtgttttgggctctggcataagcatgtttgggaatcacctggtgtctgcacagagaggtccctctggcacagcccactatggggcagatcagagcactcatccaggccctgaggctttggaggtggccaatgtgatgtattctaatgatgggggccttttcccagaccggtgctaggagggaagaaaatgtcaattaagtgccactgccattgggtgaggcagtgctggaggctggtagcattgtatcttcaagcggggtacaaggcattggaggtgtggcagctggaagggggctggctttttcttgggatgcattaacgggagcatagactgttgggccgaggagggcatgttatctcatgttagtgcccaggaacccaaaaggtaaaaggggctgcagatcttgccccttgaggaacatatggccacgtggtgggctggtaggttggaggtgagactcttcaggatcatagctgttgaatgttcaaggttcgtcatggtgagagggtacaggcgtttgagtgtggctgcaaagggaggcgtttagctgattcggtgggtagttcagcccggtccgattgttcaagcgttcctgggatggaactacagagtgtatatgcggtggtgagctccccgttcctgaaagcgtgcaaaccttccagtgttttcacacatctgctggtgctggactagtcgacggggagatcgctgctgttgtagtttccagagttgcgcgactggtccaagctcaggtgatcaacttggccacctggtcattgttgcagcagcctagaaaatctctccttgctagttgaggcccttggcccttctcgggttcaggagcacctgacaaagatacttcaccagcgtggctggcgggggggtcatcctcagccagtggccagcaggggctgcagagtgtgtcaggaaggggcatgtgttctgcgccaggggtcccgggctggtacagaaggcccatgtcagatgcagcctgggctcctcatcggcctggcgggctcattcattgcccaggtcccagatcccttttgactcgacatagtttgtcttccaattgggctacccctgtcccttctgcagcttcctgggacctgccttgctctggggcccctgtctggggtgggaagccacagatggaggggtgctgaaagcaagggggacattcttaggacctcatcacaggtggtttaggggatgagggtggggtgttctcaactgagtccaggctgtttggggcattccctcattcattcatcccatctttattgagagcctgctgtgtgtcaggtcccgttctaggccttggctattcagccttggataaaacaaaggcctcatccctcatcaagatttgtctagcagtggagacagaaccagaatgagttaagtaaacaaaacaagagaatgtcagctaatacagccgggtgcagtggctcatgcctataatccgagcactttgggaggctgaggtgggaggattgcctggggccaggagttcaagaccagcctggccaaacatagcaaaaattgacaagaaattagctgggtgtggtggcacgtgcctgtggtcccaggtactcaggaggcgaaggagggagaatcgcttgagcccaggagttcagggctgcagtgagccgtgattgcaccactgtactccagcctgggtgacagagcaaaaccctgtttctgttaaaaaaaaaaaagaaagaaagaaaaaagaaagaaaataccagcgaatctaaagtactatgctgacataactatcttaagctctttacgccttcatatacctagttatgatttttctttttgacataataatttttgatagccatattattatactgacaattttacataggtttttttcacttaaagtgagtgatattttaagctgaatactgtggttgatttcaggtaataaagacagccatagaatctaaacaaaagaggagcaagatgctcatatagatgacaccagcaaatagatattgcttcatctttgtgtaagtagaataaaactgtaagcatattaaagccagtgctgtatttgacatctcataatcttcctcagagaatgactgtggtccgttaaagtgcattttgactaaataggtaaccgcctcactgaatttgttccaaatctaaatcacaaacaaacatgtttctatttaaaacaactagatgtgctgggcgcggtggctcacgcctgtaatccccgcgctttggaaggccaaggcgggcagataacttgaggtcaggagttcgagaccagcctggccaacatggtgaaaccccatctctactaaaaatacaaaaattagccggctgtggtggcgtgtacctgtagtcccagctactcaggaggttgaggcaggagaattgcttgaacctggaagatggaggttgcagtgcgccgagatcacgccactgcactccagcctgggcaacagagcaagactctgtctcaaaaaatatgtgtaatatagtataatataaaacaaatagatgaataattaagatttcctacactgtaagtagtcaacttctgttagaaaaacctttgtgtgtaaattgttggaactgatttgtcctaataattttagttttttggatattttctactaaaattatcatcccttctattttttagatttcaatctggttatcattaaatttcattgtgcagtcattcattttttaaaaattctattactctggtaagtggggtaatgggagagaaaatgagggggtgacattagccagagaggtcagggcaggccatgacagttaaggggacccttgtaggctgagcagcagctggctgtgtggacctctggggagtgtcccagacaggtggaacaggaggtgcaaaggccttcctgagctggcaggggtcacagagaaggctggcatggcccaaggaggtaggcaagggagaggagggcacaggccaggtcacggggggctggtaaggagttccggttttattatctgttgggataataatgatgaagtttataatagtgatgaagtttatcccaggaagcaatgtgatcagacttttgttttaaaagttcactttggtggctgcagggaggaaggacctgggggtaggggtgagaataccatgggaaggcccctgcaggagctgccgaggtaggtagtgagcaccctgtcactgggaggtttgcaagctgagggtgcataatgttgaggaaatctgcagtgcccaggaagctgcccttggcagcctctgcaccctgcactccttgcaggctctgatgttttgtgaccgctcatgctagactgcagaaactgtctcgtgtccagtgctgggacatgggaagggaggccccgtgcaggccccgtcccaccatgtggctggacacagggacctcaagtgggaccgcagctcgtcctggctgtttgactagctgtgtgtccctgtgggaagtcacttgccctctagggctcagtttcagacgtgctcactaaggtcagtgctcagcacgtacagcacatactactgggtttttggttcttctttcttttgtctacagagacccagactcattcattcgacaaatatttactgagcatctactacacgccaggcactgttctgggcctctaggagataggagtgaatgaggcctgacattctagtaggggaggctgataagaataaatacattgtgataagtgactgccgccatgggacaatgagatgatccagccggggtcaggtggggctcccagcttcccctggagcagcctccctggcgctcacggcctcctcgcccccgctgctgtcattgcttctaggtgggaggtcgttccctccccagagaccttgccccgtcactttaatttctctgcgtctgcatgctggggccgcggagtgaaagttaatttcacgcttgacttcctgccgcacagacgatttcggacgcgttggagtcgcccgtagccgcctccgctgccctcccaccgccacctgcttcgggcgctgctggtgtcccctgctgcaggagggagcgctcagaccaccggggcggggccggggcagccgcagaggggcaggagatgggggctccatcgagggatgggccccaccctgggcaggatgctccaggaattcccgggagtctatggagcccgcgtgggatgtggtgaaagtgcgtgggacctggggatgagcggcagatggcgctcaggcacattctgcctctgcctgcccgggggttgccctggttcaccggccccctcaggcctggaagccggtttcttccgttgctcgtttttctcttttcgcagcctgatttcttccctcctgctgcctcatttgggggtcggctgatgggaactgtcagacccggggctgtgcaggcggaaagggggatcagtcagaacccaggttactcttagcaggtctctctggtcttgttcagagacatcagatgactcccccagggtcacacagacaaattcctagaccagtcctaactgcacatccagccaacttcctctcctgggtctctactccaggccctgcccctccctacctgggtgaccttagacaagtcacatcacattgtttggcactgtcacagcttttggttggcgctcagtgatcaggaggttcagaccatccccccaacccgcagtctcttcccaaggtatccgggccctgcatatctgcctccctcttcctctcccctgcagccggggtcaggctctccctgagcaccccttctgctctctccagattcactattgctgcctccctccctagaacccagggctctgctcattttcttcttcccaccgcattcctctgcttctctcaggcctcagctcaaacctcccttcctccaggaagcctcccctgattgcccccaagctttccttttccagtaccccataaaccccaggaccagtcccagctagggtccaaccggactcccctggaatactctcataattcctgcctccttatcctgccctcctatgtcctgcttctcctctccagtgccctggcagatggcaagactaggtttccttatagggtgtgtgtttttaaaccctgacttctttgcaccccatgagtgcctctaccagcaaactcatcacatgctgcttaccccatgcctccagagccctcctacagactgtggtccttatgcttgccggacagaagctcagcagaaaagatttgtctgcagtaagctatttgcatcttcattgcctaaacactgcttggaacaaaataaacacttaaaaaaacgtttgccagaggaatgttgaacacgtgggcatcataaaccaggagtcccccaggtggctgcctccaggagcgggaaggaaggtttgagtgaggagggctggtgtgaggcaatagggagtagtaggggctgaggaacggggagctgggcgacctttgaaaggagcagccaagcctcagtttcccagcctgtggccatgaaggggtgtggcccgatggcctgatgttttcaagagaagctttaggtttggctttttgtgtaacagcctctggttttcagtgctggcaatgaatttaggattttagaaagcaccagccgggtgcggtggctcacacctgtaatcccagcactttgggaggctgaggcaggcagatcatgaggtcaggagtttgagatcagcctggccaatatagtgaaaccccgtctctactaaaaatacgaaaattagctgggcgtagtggcacgtgcctatagccccagttacttgggaggctgaggcaggacaatcacttgaacccgggaggcagaggttgcagtgagccgagattgcgccactgcactccagcctaggtgacagagcaagagactccatctcaaaaaaataaaaaataaaaaataaataaataaagcaccacagcccaacacaacaccctcagaggctgtctctggcctgtgcactgtgcagtttgcaccctgcggacttgacatgtgtttgcagacttgacgtgtcctcttgcgtggtacgtggatgtctctgggtggcaggcagtgtccttgctttgggaggaaacctggatcagccagggtggattcacaccctcagttgctgcccatcggtggcaaacagacggctgcatgcacatcaccaccaccccgaggcctcatgctcaccgagtcgttttccagctgcagtgacagcaccgcggtttgtggaagatcacacgccggactagcttctcagcgctgccttaacactcggccgtgaaccgggcagctgaaaatggcaggaactttcttctctcacagtactggaggccagcagttggaaatcaaggtgctgcaggaccacattctctagaaggctctgggggaggctgcttccttgccggttccagctcctggcggctgccggcctccttggcgttccttggctgggagatgcgtcactcccgtcttttgtattcgtgtggtgttcttcccgtgtctgttcgcgtcatctcccctccgtgtgtgtctgtctttttgtccaaatttccccttttcataagtcattggattagggcccaccccagtaacctcattctaacttgcttctcgctctaaagactctgtttccaaatgaggtcatgttttgaggtgctggggcttaggactttacacatatcagtttttttgtagttggggttgggggtgacattcccacctgtactaggcagtgtaccacctgcaaaccccaaagtcaattttgtatggtcttcaccacggtgtttcaaagtggattctatctctcttcttttgtgagaaggtggaactatttattttgaagtaactagattgtacgttgtgcaacagaagagttgcaaatacgctccacagagttcccccacacacgtcacctggcacccctcatgtggacagcttatataacagcagagaaacacttaccacaactagggcctgccatggtggcccacgcctgtcatcccagcactttgggaggccaaggtgggaggatcacttgaggctaggagttggagacgagctgggcaacaaagcaagacctcatctctaccaaaaaataaattagccaagtatggtggcatgtacctgtagttccagctactcaggaggctgaggcaggaggattgcttgagcccaggagttcaaggatgcagtgagccatgatcgagccactgcactcccgcctgggagacagagtaagaccctgtctctaaaaacaaaaatcaaaacaaaacaaaacaaaatactaagaaagaaatagtggcacatgaccctctgctaaactaccagctgtctttgcattttcacccgtctctccgccaacgtctgttttctggtccaggatctgattcaggttctcacgtgacatttgtgctcgtgtctctttagtctccagcccgtgacggcttctcagccttgccttgtttttcaccaccccagcacttttgaagatcactggtcatggctttctttgacaggtgtttcctcctggtaagactgggatggtgggttttggggaagaccagagagaggtaagggggctgcgtgatgcccacatgatagggggctctgccctaggtctccgctgtcgccttagagttatccctcctttgctctgttctttactagggagtcaccaagtcccacccatcttccagggcaggggagttaagctccgcctcctggagggaggaatatagatttgtggagccaccgccatgattcatacatacttgcggggagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctctgtctccctctctctgggtctccgtctctctctctctctctctctctctctctctctctgtctctctgggtctctgtctctctctctctctctgtttctctgtttccctgtctctctgggtctctgtctccctctctttctgggtctctgtctccctctctctctctgaaactcccgtctcccaggacgtgcctccttctcttggagcctgcagtggtatgtgtaacctgcttggttgagaccccatgggccctgccctgaagtctgagaccgcccccgcccgggggtttcctgaagtccatgcctggtggccccaccagctgccccacactgcttgtgtccctccccccgcagcaggactgggtgtgctggaggtccatgcacagcacctggttggagccaaccctggggccacacaggccacactctgacacccggcctgtgggcggcagcaggtctcggggtctcgggctctgtggcctgtattcctagttggaggctgtggctgtttctccgtggccatctttccgtgggcagatgtggctgccggggtgcatgtgggcgggggcgggaagccacaggcccctcggctctgggaaccctcttgcctgcacactgggctcaacctaaacgttggcgggggctgcctcgcgcgcgggggagtaaggatgcacgttggcagctcacaggtctctctggggatacagcacgggtgggtctcatctccctgagaaccaataacggggcaaatttggggctcactctcagcaaacaggatggcacggggtgcagcgcctgagcccggccgggctgacctgtctgccgcttccctcctgcacagaaaccaggcgatgcggaagaagctaatcttgtacttcaagaggaggaatcacgctcggaaacaatgggtaagtccacaccgtggcccccatcagctttccttgagatctggggagaatcgagcgcacagggggccacacctgccggggccctgtcagttccgcagctgtgtcctccctgagtgtccaggctgcggaggaaaagccaaggccggccagaaaaggaggaaagacaacagctgcttccagaaggccccagggtgggtgggggtgggggggctctatggcccctcttccagcctggaagggaagaaagcaaaatgttggcctggaaaattagttgctaagccctggtcacgggacctgtcctgggcttttcaggcagaaagagaggttttggagagaggtggaggatcagggtgggctgtgtgccgggcagcaggggccgcaggcgcacccttacaaatgagcctttcctggtgcactgggcccaggtccaggctcagggaaactgagacagtggacaagcattgagccccctttccctgagcctgcatttgtggccagtggcctcatccaaacagaaaaggatgctgattcctgcttctcactgtaggctgtggatctcagcccacggcggggaggctgggtctgccagaggcatgtggtggtggtttcaggcggccgtggccatcacccattccccggaggagatcagggttgagtattctcccagctgtcaggggaagaagcgcggactcagatgggcttcaacaggaaaggaatggctgtagctggaaatgtctgttgggtgtagatggcaggaatagtctttcaactcaagtcttgccttcatttcatttcattacatttcatttcattttatttatttatttatttattatttatttttgagatggagtttcgctctgtcacccaggttggagtgcagtggcagggtctctactcactgcagcctccgcctctcgggttcaagcaattctcctgcctcagcctcccaagtagctgggattacaggcgcccgccaccaagcccggctaatttttgtatttttagtagagaaggtttcactccattgaccaggctggtcttgaactcccgacctcaggtgatgcacccgcctcggcctcccaaagcgctgggatcacaggtgtgagcactgcacccagccccttcattcctgtgcagttttttcaactccttatgttagaacattgacaaactgaacctgaattcccatagcaggtgggagccggagagagctgtgctttctcggatggtatcacagatgctctgattaggccaggagagggcctgcgtcctgtgaaccagtggctgatgccggggagatggagtgaggctgcctggttttggctcatgggactttctctacagttggggatgatgtcattgactccacccaagccacggggctgctgggacatggtagggaatgggataaggctggggaggccctgaaaaggtccccacctggggaagaggcgggctggatggggactgctgccttgggattcttggataagagacgcggcaagggctgggaactaggtttgctggaggctggaggggctcccctcatacctgcagccccctgccccacctcctctctccctcagctgtgttgaggcagggcctgcgaggcagctccctgtatcctttctgggcctccagagaggccctcccaggcgcgggcctggctcagtcatgcccagcgcctgtaggtctgtggtacacagtaggtgatgaccaagtcctgcttgaactgaaatgggccgggacagggtgttagctgatccagtgcctttggggcctggatgccagtagtcacggagcacctactgtgtgtgaggctcgcagttgctgtgacacgggccctgtcctcagacctgcaggctgcagggacaggtcgtgcgtaaggacgaggaggatgcccgcacaccctgcccttccggtgcctgttgtgttgcaggcgctcttctgagtgctctccatacattagggcatttagtcctgcgaggtgggcgcttggtcagccacatgtttcagaggaggaaatcgaggcacagagaggttaagtaacttgccctaggtcacacagctgggaagtggtggagctgagatttgaacccagaccacctggttcctgagcccatgctctgaacccccaaggggcagttccgagagagtccaggagggtgtgtggggtatggtggtgtggtgagcggccacatggtggggctgagcagtgcctggggagggggaccctgggcaggcatggggtcctgggcaggtgtgtgggcacgtggggccaggtgaggggcttagctggggcaggaggtcctggctttggaaggaggggctgtgctatatgggaggagggtcttcccttggccctgcctgcctgctctggccccgaacttggttgggtactagagggaggagacacttccagccagatgctggtgcctgggaagctgcgggcagccctcgggacccaagccctgctcataggtgaggagaggtgggctgcccagcagtgccttgcccagcttcctcagatcccccaccttgactggatggtgcccacaggcacttgggctggtgcgagaggctcttgaaacgagcgtccaatctgtttatcaagttaagagatacccacacagggctgctgggtgcccaggagtcacaggccaggaaacagaccggtaatccggggagaagagctgcacagagggctagactctcgagatgggctggggacctcagtgctgaggtgggaatgaccagaaaggactggctttgtgcggatctgggagtcagggtgtcaggcagagggcatagcaagtgcagaggccctgaggcaggaaccagcttgggacagaacctggcaggccagcagcaggagccaggtcgcgtggaaacatctgccctcaggctaggatggaacattcaggttttattccgaatgcagtgggacaccgaatttattcttaatacatgtatttgtagtaaagaatccaaagtccttattctaagaaatttgacagaagagtacaaggcacatctatatacccaccacctagaatcagccacggttaccattgccttgtatttgctctgtgtgtataacatgtttgttgttgcactattggaaaataggtgcagaggtgccgaccttcacccctaataaatactccccctctgtctcctgcgaggaaggaaatcctctcattttcacctaaaatgactgccaattcagcgcgatcttgccgcctccttgacagccccccatggttccccccttggggtgaaggctcctctcgggagggcaggagaggatctgatttccatttaaaaggatcgctgcagctgctggaaggagctcaggctggaggtggagttggggtgggcttgagttctttaaagatcgccagtggctccttggggggtctgtggagggggtggagggagaaattggcttatttaaagctagagaagaggcaggcagaaaccaaggacttccaagaagggtccggtgtggctttgtggcccatcttaggagggatggaaacaaattcaacaccccctgaagctgcggtggcgattgggatggtctctttgttgtggtataagaagccgaagtccctgacttcattgatttcagtaaggcctggggaggggggcttggccgagaactctgatgtgcctgcctcacccccactggggagtcagacccccctcagaccctgggacccccacaccttagcaggttcctggggacccccatacctcttcccagagagcagggcctcgtccctgtcatgggatcctcagcaccagcacagccccccaagcctgccacatctcctgggaagctgagctggaccctctggaggcccagttggctgagagactggctcagcctgtggtcccagaggcatggctggcctgcttcttctccctagtggatttgcgctcctagcaccccgcagactagctggcgggggtggggggcgggagggggacggctccagtctttccctgtgtgtgtgcgtgtgtgtgtgtgtgtgtgtgtgtgtgtgtgtttgtgtgtgtgtgtgtgtgtgtgtgtgtgtgtgtgtaagacagagagagggagggagggaagggaggaagggatctgtttcctcccctggccagtgggtctgcccttgtagaaaaatgccagtgagcatcttccctgctacccaggccaggccggagctgcccgccctgcgctgtccgaggcagaccgaatgcacacccagcacagtggacataggcacaggctacagcaggtggcactgtggttagacccagagggggacttccttgttctgggcagaaggcagagcccagtgcttggggccatggaggtgtctggatgtcccctcagggacactactgctggaggcctttgccacccgtgcactccacgagggacccagctagagccgggccgtcttgccagcgccctgccggcaatgtggacaggctgaggccccgctggccagtggcctgttggcttccgcccgctggtctgcaccagtcaccacgtgactttcctctgctggcttgaggtgagcttttctcacccatgagcctggggcctcttggacaggggccgaggtggcatgggctggttgttgccgtccctgcagtccccatccctcactggggctgtcagcagccactgccccgagcacgtgtggccgttgtctgtcaccagaactgcctcttgatctccagcgcgttcctggcacagcctgcatgcatggggttaggttctgggccacccagcaccagcctggccacctcgtggggaccgtcatggtcacggggctgtcgaggatggagggcacagcttgcccttggtcagcagctgaaatatggggtggggtggggctgaggtgtctgggctccaggaccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggttgtgtgggtggctcgccctgcgtccccttccccgcccccaccccccgccccccgccgccacttgctcaagtcaccttggagatgtggaagccaggcagctatgctctgggctgattggggatctcttctcaaaggacatgcagcaggcagcactgtggttagatgtggagagggacttccttgtcttggagggaaggcagagccccctctctgggagctgctggggtcctcacagctggtccttggggtgaggctggggaatgaggaactgcttggaatgtggttttctctggcggctgcccctccccagggctgacgggcccgcatgttgtacagcacagcttcctgtggtgtggcagtgggctccatccgggctgtctggtgcggccggagccccagccgcatgtggctgctggacactggaagcatggctggggagaactagagcccgactcttaaattttactggatttgtgatttcagttgagccacacatggtgggtggcttccatttgggaccaggcctctgcagaggaggccaggtctgggtggccggttcaccaggaagggaggtgaccgtgtcctcaggggaagtctgtgggttttcttcaggggcccccgtctgctggatagccatgcaactatgtgcctgtctttctgtcgtctgcctgtgtgatgtgtgtgtgtctgttgtgtgtctacatgtgtgactctgtgtatgtgtgtccatcatgtctgcctgcgagaccctgtgtgtgcatctgtttgtctgcctgcgactgtgtgtgtgtctgtcatatgtctgcctggatgaccgtgtgtgtgtgtctgcctgcctgtgtgaccgcctgtgtgtctgcctgcctgcctgtgtgatggactgtgtgtgtgtctgtcatatgtctgcctgcatgaccatgtgtgtgtgtctgcctgcctgtgtgactgactgtgtgtctgtctgcctgtgtgaccatctgtgtgtctggctggctggctgtgtgacttatgtgcctgtgtatatatgtgtgtgtgtgtgtctctctgtgtatctgcctatatgactgtctgtctgcctgtgtgactgtgtgtctgtctgtctgtctgcctgtgtatctgtctgtgtgtctgccatgtgactgtgtgactgtgtgtctactgtgtgtgtaccgtgtgggtgactgcatgtgtgtatgtgactgtgtgtgtctgtgactgtatgtgtgtgtatctgtgtgtctgcctgtgtgacttgtgtgtgcctgtatgtatgtgtgcctgtgtatatctgtctgactgtatgtatgtgtgcctgtgcatatatctgtgtgtgtgtgtctctctgtgtatcttgtgtgtgcctgtatgtatgtgtgcctgtgtatatctgtctgactgtatgtatgtgtgcctgtgtatatatctgtgtgtgtgtgtctctctgtgtatctgcctatatgactgtctgtctgcctgtgtgactgtgtgtctgtctgtctgtctgcctgtgtatctgtctgtgtgtctgccatgtgactgtctgtgtgactgtgtgtctactgtgtgtgtaccgtgtgggtgactgcatgtgtgtatgtgactgtgtgtgtctgtgactgtatgtgtgtgtctgtgtgtctgcctgtgtgacttgtgtgtgcctgtatgtacgtgtgcctgtgtatatctgtctgactgtatgtgtgtgtgcctgtgtgtgcatgtctgtgtgactttgtgtatctgtgtgtgtctgtgactgcatgtgtgtctgcctgtgtgacttgtgtgtgcctgtgtatatctgtctgactgtatgtgtgtgcctgtatgtgcatgtctgtgactgtgtctgagtatatgtgtgtttgtgtgactgcatttgtgtgtgcctgtgtgacttgtatgtgcctgtgtgcttgtgtgcctgtgtgtatctgactgtatgtgtgtgcctgtatgtatgtgtctgtgtggctgtatctgactgtatatgtgtgtgcctgtgtgactttgtgtgtgtgcgcacgcacctgtgtgtctgcctgcatgtgagtgggcaggggggaggcggcgggtgccaggtgcaggagcatcttccgcagtgccccctgcgctctcccaggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagaggtgagcggggcctgagcccagggcccccgacgtcagggcccggggtcagctccagcatcctcagtagaggtggcctggccaggaaggaacagaacagcacagcagcttctcaggccagtggccagggccctaccagaccctggcctgtgtcacgtggagcctctttggcctaatacttacttggaacttaaatacattttggggacaagcacttcttcccgtgtgccatagcgtgcacctgccagcttcactcatttctggggcctgcacgacccctgaaggcagctgagtttgagatccctggtgtgggacaaaggggagagacgtggctaagagaccacgctgtcagcctcccccagtggctgtgaggactgggtgggccccatctgagaggtgcctggtgacaggcagctgtggttctatggccatttttctttggatgcacagataaggcgattcattggtaatgataacaacacctttcacccttaactgaagtcacaagccatgtctcattaagttccccacaacagctctaggcagccaggtgccacttttgaatcctcatatgacaggggaggaaactgaggcacagagagaaacacttcggcccagggccaaagaggcagagctgggctttgaacccagatctttgtagctgggcttttcagggtgttttaggagagaggaagggactgagctgcccatgtcacagggtttggccttgctgggttggggtgggggctccatgcctccccaggaccccgggtgtggggccggcccctctgctggccgctgcccacacttctcctctggggagggcgtgggctcagggctgcgccacaggggtctgctagtgtccccgaccaccagaagaccggtcctgagtgtgtccccttggtccccagcagggtgggccagcggggcagtgggctgtccatgtcggccgcccgcagcgagcacgaggtgtcagagatcatcgatggcctctcagagcaggaggtgagtccaggccctgactctggcctcagctccttttccctggcatcccccgtgagggtgcagaggccctagccagaaaccacctcccgggtggtttacgtcgaggggctttgccaccgaagcgcgggtggaatcaaggtgggtattgaggtacccgtcccaggcctgcaggggcgagcagagagaggggtgttaatgtgtctgagagggagggtagcaggaccccctgcagggagggccctggcgctcccccatccagatgccacaacagggagggggttgggggacgaggaccctgcctctcactcttcccatctcctgcctccttttggaacttcccattggctgagtccagccagaagcccaaggggcgggagtgcctgtgggttccagggtcagccttccagggcccagagcctggcagggtggggggagcatggcgcaggccgaagagttcccagcacgccagctgtccacgcagccacgaccttctcgcaggcacctcagccctcctggctggagcagggccggtttcccctcaggcctctttggggtgccaggacaccctggggtcagcctaggtgaccctggctgccgtcactggggcccacagatggccaggaagcagagaggcagccttttctcctggggaggaagttggtgtcagcctgttccctcccgggtcctgtgggtcaggtacccatgatgacactaccccctgctcctaacaccacagcagacacgaggcagccacggcacgtttcttccttctggggacttttgtccagggagagcttttgtccagatgggagattatagccctttagctcagcacagcagagccacgcatggctattgaaatcaaaattaattaaaatgggataaaattagcaattcagttcctcggttgcatctgacacatctcaagagctcgacagccgcttgtggttggcagctcccctcctgggcggagcagacagcgaacacctccctggctgcagagtgctctgttggacaacagaacgcgctgccctgcgatgctgatgctcagattagacagatggaaggggccccagggagggggcggctggtttaagtagcagtttctcaccagagactctgattcagctggtctggggcagagcccaggaatccgcatttttacccagccacccacttgattctgacgcaggcaatccaaagatgaatctggccattaaaacataatttttcattttaaaacttctcgtggtacgtttttgtttacaacaacatccagttgacagaaaacagagctcagaaagccatcgcattgcacagccacagggcccggccctcgaaggctgggcgccggagctgggccgtgtcagcccctgtctcaccgatgctgtgcacttatggacatcccgcagagaggctggctgtgggtttagtctgcactggaaggaggaggccggtggccctctcctctgcattcctcacctgatggccaagggtgtggcacctgggctgattgttgcatatacacacacacacacacacacacacacacacacacacacacacacacacacacacacacacactggccacatgggaatgcagtcatcagagtcctcagggacatcaaggatgctgtgtccggggtgaagggtggaagtggaatttgggacagaaacttccccagccagcctggggtgacctgaggttcccccgggagtgtgcaagggagggggctgggccggaggacaggcacttcccatccttctgggagcttcctgtggtcagagcacatggccggcatgggaaggacaggaaggcagctgtgggagggcagagcagaggtcctgcctgtggccgtgccgggggtcctgccattattacatccctgggatacccgaggaaggtcgccgttccgtatcaggggtgtaggggacagctccaagggtctgggagacagatgccagcctcttggggggattctctcccaccccggggtcagagctgtgccccgcacccgacctgacccctggctgggagtcctgcacattgagtgaagaggttggatgtgggcggccgggcagctggatcgtttgaactggctgaccttggctacgcggagtcctcgcctacctccggagatgggtaattaatcgccagtaattggctggctgcgagatttggggaagtgagcccagctgagtggcggctcagagcctcttaatagtcatcccagtgcattaggagcggccgcctgactcctgccgcatgcagggctgggcaggccagatcccaggtgggccctctgaaggagcggggtgccgggagggggcgtgtagtgtgggggcaggaaagacctctccaccagcgaggcgctgaccctctctgcgcccctgggctgcctgcatgctgtggggccagctggaccccagggcccactcttgcctgcggaacctggaaggccagcctgtctcccgggctccctgggcccagctgggctgagcatccttcctgcagtgctttatggcgcttgcatttccaaagggaagattcatggctcccctcccactgcagagaaggcggctgctgctctctgcattgaatctacagtcctgcccaccataaacctgtcggggaggcctttacattctcccttcccccagcatgagctattattatttttaaactcatcattctccttctcctcggtttcgcgttttccctgctctggcgcagaccatccgtcccctctgtgtcttccctgggtcccctgcgccggccggagcacctcgtccctgggcctctgaccctgccctccgtttccctgcagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagtgagtcctccatcacctggcctggcctcccggccccccacccccatcctgttgaggcctgcgctgtctcccggcagccaccacaaatgagcatgccggggggtgcttaaaaccgcagggatttactctctcctggttgtggaggccggaagtccaaatcctggtgtttcgtggggttggttctttctgggggccgtaagggagagcctgtccctgacctcttcccagctggtgctgccagcatccttggccttccggggcttctagatgcatccttccatgctctgccttcgaccccacatgacctttgtctctgtgcttctcctcttcttataaggacacccgtcacactgaatttagggtctagcctaacccaatacaacctcacttcaactaattacatctggaaagaccctgtttccaaataaggccgcattctgaggttctgggtggccatgaattttaagaggacacacttcaatatggtacaaagtgtaagggcagctggatgtaagacggggcactgcgagtcggaagaacaaggcaggagggacttagaggctgggccgcagccttgggcagggcggcagctggccagtggcttttggtggtttctattttgttttgtctttgacaatagctgctggctgagtgggttcgtgatcccatcactgtgcctgtgtcttctcagcttcatgcattttccccctcctgtcccttatgacagctcagccaggcccaccccagtacacagctgatgacacggaggctcagagaggttcagacagtgcacaaaggccacacagcatgcacacaatggaggcagggttcagactcctccagctggaatggagaggctgtatagggaatggtttgtgaatggggccagggaggggggctgtgcagagcagagacgggagtcgagttctctcaaaagctgtgtctgagggggccaaaccccacagtgagaatctgcgatgtgacatccaggcagaaggagacctccatccctggcccggggtccccagaggagatcgtgggccctgctgagccaccccacgccttagggacagtgtgctataattccggggaatctaatcttttggcttccccaggccacactggaaaaagaaatgtcttgggccacacagaaaatacactaacattaatgatacatgatgagctaaaaaaaaaatcacaaaaaaaatctcataaggtttttttttcctttttttctttcttcttttcaagacagagtttcgttctgttgcccaggctggagtacaatggcacaatctctgctcactgcaagctctgcctcccgggttcacgccattctcctgcctcagcctcccgagtagctgggactacaggcggccaccaccatgcccggctaattttttgtatttttagtagagatggggtttcaccatgttagccaggatggtctcgatctcctgacctcgtgatccgcccgtctcggcctcccaaagtgctgagattataggcgtgagccaccacgcctggccaaaaatctcataagggttaaagaaagtttacgaatttgtattgggccgcatttaaagccgtcctgggctgcatgtggcctgtgggttggacaagcttgctctaatcacttgcacgtagagggctgggttccctgcccaggacatagagcacctcctcaggacctcagagctctgggaggcaggagagtgggaaactgaggtgtggacggaggcctctgtgcttggccaggaggggacgcagggaagagactttgtcactgcccgacgttcacccggcaggctactgagctgccttggggaagaccctgcctccggacaagagcttcctccaaagcaatgacactccttccccagtgccctgggctttggtccagggttgtggccccaaagaggtgccaggcaggacctaagggatggggtgactctgggtccccggcaggggtgagtggacccgcaagtgcagataccgaactcagaaaggacacagtggctatccaggagggtctttggtggaaaacattttttaagagtagcttttgattatggaaatgttgaaacgtccataagaatagaggggtggggtaatgagccctggagtgcccacagcaccgagtgagtggtccttcacaggaaacagcgcttggttcctgagcaggaatactcggttacttaatggctcgtgcctgcagcctcaccatagcaggcacgatctttctacgtcaaatcaaagtctccgtcgaatgcttcttacagttttgaacgagggaggtgatggtgggacggtcacgggtgttaagaattactgaattactgttgcgtttgagattcacgttccccctggtaggcatgatgttttagtgtatgtattttttctgaaatacaaaaaaaaaggtgttctgggagactttctgcggcttcagcctttcggaagatctcatgtggctctgcaggtctgataatgtcaccctctgttaattcagtaaccgaagggtgggggacccaggctgggctgctatctgccggcccgtggggctggcgtaacttccatcctgtgtgagccgcaacttggccacttgcatgcctcaaggactgtgggcttggtttgaggtctcatgtgcagaggaattgatagcactcggggctttgaaaatcacctactgacggcatggggctccaccacgtgctggccatgtgaccattccccctctgaacctcaatttcctcgtctgtaaaatgggtatagcgacagggcctcccttgtgaggtatgcagggcataggaaacttctaataaacgtcttccaggggtgcaagtgaggtattgggggaggggaacaggggacctaggagattcccaagtttgattcctggtctcttgggagcccccactgtgcctggggaaaccccgtgggaggggtttgcagggaaggaaatgtcactgggacaaggagagggagcggagaggaaaggactctccctacctggaagagaagggccttaggatggctccggccttgccagtcgcccgaggtgggatcccaggccagggaagcctgccattcctcactgcgccgcttccaccgggaagagagcagagactgttcaggatcctcgggtgtctggctgggaagcaggcgcggggcctgctggcctcctgcccagccatctggagggccaggcaggtcgggcactggtgctcactcagcctccctccgtgggagcccatagtccagcctcactagcagccagccgctgctctccctgcgaaggctgtggggctgtggcacgtcgccgggacgcctgggcctggggccagggactccacccagcacccctggggtggagcaggccttgacccacatccccgcccccaccatgctcccgctcctttggccctcacatttcagcctgggcccagtggtttcccagtaattctcctggctacgcaggaagccagttgggacagtgccagcgacccgccaccgccctccgacttaagtccatgcttgccgcctccttggctggccagccccctcctgctgccccacgggcactcagagcctctgctcccagctcttctggggaggcccagcagcctggtgagctatgaccccactggtggggccctgccatgttcccaagcagaccctgtgtgggctgggtgaggccctgcttcccagatccagctggagagagaaacaaaagtggattttaaaggggggggaaccccaccaaagagctgcatgtcgtgtcctcatttttcctggaagccgcctccagcaggacaaacaaatatattttcaaaggcgctaaagccagtgactcactccaaggaacgccctctcttacccctgggtccccacccctcccgtctgccgcagcagcccttcccacacccccctgggcttaattgctccaagtggggcggtgcccgccaggcccggccagtggggatggcaggcgcctgggagccgatcggctgccccgcaggaaagcccccctcggccaggtctcacgcccacccttctcgtcccgcaggttcatgcagcatcccaagaactttggcctgatcgcatcattcctggagaggaaggtgagtcgctgcccgccccataccccttcggtctccacctccgtgggcaactgcgtggactcagggtggaggccctccctccttgcccacaaggccctggcctgcctggccccttgctccagctgccatgctcccctcctccctccctcccttccttccatctgggagatagatcagtgcaggccccgccctggcctcctgggcccatggaggaggagcctcaggttgctgagcacctgggaatcccgagaaccccagggagagctgcacggccaggcttcctggagccccgtgtgcccgacgggtctcctgccagctcctcaaaggccacgtggagcgtccttgcaaactgggggtggattctggaagcactacgtgcctggcatcccagtgaagttttcgtaggcaggagtggcgtgcctcaaagggactggagggaccagcttttctaggtccctctgagggtcactgactgctttctgacacctctaatgccaaaccagacgtgtggcctgcaagtccccatcttctttggacaaacctttgtgtggacctgaggcctaaagcccactttgtgtcaagcccaggcccggagcagctccaggtggccggtagacacaaagtgtccccagagaatggtaaagccgttgttttgcacccacaaggctggttggactgtgcctggagaggctgcaggtgggagaaggtggctggatgaggctgcatgttggacgtggcccctgggccttcccccagcatcttggggtcagaggagaaaggctgccgtccgtgtgtcttaagcagcattcccctgaatcacgtttctcagagatggggacctgcccaccccagcttggtggacaccctgctcgggcttcctggttgtaggagggaggccaggaggatgaggcacttattttaaaggacagctgttcccagcgcctgcccctcatgagctgataaccgtagaaggagagagaccgagcagtgtggggaaaaatctctccatgcctgaaaaaccagtgtggagaaacaagccctataaatagcccatcttctgagtgacgacgtctccctcagggagtggacggcacggcggactctaggttagggctccccaggatggaagcatttcagaaactggccatcgagcagtcctccttcaggatgaggggattagaagtctttgtgctggggagtaaacttcatgatgttctttggctgagaggcagcccaggacaaggcttcagtagagcttccagaggggtctggagcaggagctgccaacggagaggccggcggggacagtcaggtcttgacagtgagtgaggctgacgtctggctgggagccaggtggaccagccagtctgtgcccgtctgcgggggcagctgctgtccggagccgggctgccattgctgagcgcaggaaggagctctcttgaattgttaaaggagaagtcgggcacccacatcccctgaattgcaaatattggcatctgattataaaacgtctttctcgattgccatgtttgtgggctgggtttagcctggggccgcctgggagcccccctggcggtcgtacttggcaggaggctgccagctgggggctttctgttgagggcagtgagatttgaggcccagctcagaggcctcacagaatgcccattggaggtggggtcctggcttggcactggccagagcattgcagaaacattttacattgtaaggggaacggctgtgggcattggcaagctgggctccatgcccgcaagtgggggcatcgtggcatcactttctgaggctgccccttttactcgtcccatttggccggggttcatagagggctggttgctccggctttcagacccaatctacatggaaaagaccaaggcagagaaaagaaggaaacgcaggaagaggcgcgtggggcgtggggcgtggggcggtcccgatgcacaaggcttggaagaggctattcaggacctcaaatatcagggaagagaaggctgaagccagggaaaagagaacccggacctatgtttggggaaggctttgagtttgcccggctgtgggctggagtccttgtttcccataagggctgggggtgacatggcgacgtcagcgctgtcattaaccatagcaacagcggtgactgtgataacaggaaagacttccatcatgtttgctctgggccaggcctcgtcccaagtactttacctatgtattaactgatctgatctttgtgataatcctgtgaagtatgtacaattagcattcccattttacagatgagaaaactgagacacagaggttaggtcatctgtccgaggtcacccagccggtacgtggaagaggcaggatatgagcccaggatgtgagctcctggctcctgccctgaatgcctgtgctgtaccctgctcagcgtcctctttctctgtcccacagacagtggctgagtgcgtcctctattactacctgactaagaagaatgagaactataagagcctggtgagacggagctatcggcgccgcggcaagagccaggtaagaggcaaggtgggggtgactgtccttgcaggctccctgcatgctcagcggccacttgcttggtggccagcaccccgcatggctggcggtaactgtctccatgagttgttgttgcttggccaccggcagtgtgagtgcaggctcccctccgtggtagcagcagatgtggggagaccccctctggggtgctcaccctgccaggctatctcgagcctcccgtagtggccaggaagatagctggggagaaacagccacgggcctcctcagcctgtgaaatcccagactcctgactgggtgacctgtgatctctgtgcgtaaaaaggctacattccaaaagtaagagcttcccaggatgacttggggtagttcacaaacttcatgtttaaaatgttaatggttgtgtgtgtttatcttaatacatacttgaaagaaaaaatagccagtacttcagctcgccgttttttcagacgccgttgcttgggatgagactgaaagattatttacgctagagcagaggctggcagactgggactctggggctaatccggcccaccatctgttcttgtgaataaagttttattggaacacagccatgcctgtttgtttacatattaccatggcagcgtccttgctgctctggtggagttgcatggttgtgaccaaaagtgtatggcgtacagggtctcaaatgtttactagctggcccttcatagaaaaagtttgctttttcctccgagttagaggaaaaggagttggtttgaaaaaatatccagtaaataatggtagagatgagaggctcagtggcacgcctttgaaagggggatcctgggcgctcggtgtttgggagaatttgttttgcatccgggctcttgaagcatcgtctcagagcagatgctgggagcaccacacagaggaggcgggtggaggcagtgggcactctggcagctgctggattggagtcggtcgaggcatttccttcctgggggcctcagtggctggggtgggggccgggtgagagtgacaaaggccaagaatagcacgagccgcgtggagcgtccttgcaaactgggggtggattctggaagcactacgtgcctggcatcccagtgaagttttcgtaggcaggagtggcatgcctcaaagggactggagggaccagcttttctaggtccctctgagggtcactgactgctttctgacacccctaatgccaagccagacgtgtggcctacaagtccccatcttctttggacaaacctttgtgtggacctgaggcctaaagcccactttgtgtcaagcccaggcccggagcagctccaggtggccggtagacacaaagtgtccccagagaatggtaaagccgttgttttgcacccacaaggctggttggactgtgcctggagaggctgcaggtgggagaaggtggctggtactccctatagtggcaccctctagcccctccccagagctgcccgccttccctttcccaggctgccagaggtcgagacccataaggtgttgagaccagccatcacgggttgggggcggggtcccagtgtctgccgtgaaacagccactttcctacagcctaagaaaactcccatgagggaaacgaggctgttgtcaggagcatgagccacccctcgccgcattcccaacatccagccacgatgcctggggctgaactcggtccttatccgcagggatcgtggaagggtggctgcgtttgtggagagggttttcttgtctagttttctgtagccagagttgaccagtctgcttgcccttctaacagatgtgtaaaaccaaggccgagtggcacagagcatgtattccaaagacgtagctatgttttatttttgtttttttgggatttgtttttttttttttttgagatggagtttcacaccgtcgcccaggtcagagtgcagtggcgcgatcccagctcactgcaacctctgcctcctgggttagagtgattctcatgcctcagcctcccaagtaggcggcattacaggtgcgtgccactgcatcctgctaattttttgtatttataatagagacagggtttcactatgttgcccaggctggtctcgaactcctgacctagatgatccacctgccttggcctcccaaagtgctgggattacaggcatgagccactgtgctcagccgctacggtgtttttgaaattgaagtgcattcaggaattttctagactgagaggcaaaaaggtaagtgccagtcagggagtatatagatgctgaggtatgagaggcagcagggagcggtggggattatgacaaaggaagggtggctaacggcctcaagaggtatttggaaaacatcatcaggcgtctgttgggcccctactgtatgctcattctcttgctggccttcccagttcccctcccatgacctgtttgggggcattgaggctgggcttgtggtgggagcccttcctggtagctgggctgggggctctgaagagcagaggcccatcccctccccctgtgtgagagccacatttgcacagagggaggtggggagaccatggtaatttaagaagggtggggggtgtcggtgcccggcatatcctgttgtagaggcctggcctgtactgtggtagagtgagtgtccagtagaatgagtgtccggcttgctcttcgtggagtgagtgtccggcctgctctccgtggagtgagtgtccggcctgctgtccgtggagtgagtgtccggcctgctctccgtggagtgagtgtccggcctgctgtccgtggagtgagtgtccggcctgctgtccgtggagtgagtgtccggcctgctgtccgtggagtgagtgtccggcctgctctgcgtggagtgagtgtccggcctgctctccgtggagtgagtgtctggtctgctctccgtggagtgactgtccggcctgctctccatggagtgactgtccggcctgctctccgtggagtgactgtccggcctgctctccatggagtgactgtccggcctgctctccgtggagtgagtgtccggcttgctctcaggagtgagtgtccggcttgctctgggcggagcgaatgtccagcttgctgactcatccattgattgagcatttattgtgtgcaggacatggggagcttcatgctggttgttcagagccattgtaaacaggtggcttcaagacagtgccgcgggtctccctgtgcggcgggtctatctgtgccacggggtctccctgggccacggggtctccctgtgccgcggggtctatctgtgctgcggggtctccctgtgccacgggtctatctgtgctgcggggactccctgtgccgcggggtctatctgtgccgcggggactccctgtgccgcgggttctatctgtgccgcggggactccctgtgtcgcgggtctccctgtgctgtggggtctccctgtgccacgggtctatctgtgccgcggggactccctgtgccgcggggtctatctgtgccgcggggactccctgtgccgcggggtctatctgtgccgcgggtctccctgtgccgcggggtctccctgtgccgccggtctccctgggaggtggcattggtggcacatccttgaagactccgtagaataaaaggccccaaagatgaggttgaggagcagccccacaggcggacagggatggggccctcaagtgcaaaggcagggagcatgagagacagcgcgtgtcttcaggaacagcagggggcctgagtctttggattcgtgggggtcccggtacctcccagggccttaaaggaacaaagaaagggagattatgtgaccctctttcttttgctcatttttgatgggtaaatagagatgtttttttttaccctgtgaaaaatagaagtgcaaactcgataaataacagctcacacttgccttcgtgtctggggagggagtagggagtggtgaggcctgtggctcactgcagagcttgggccccgtctcagctccagtggacgcttggccattggccctgaattgccaggtgttctgatctttgatgacgagctggaaatccagttttatgtgaaactgcctgattttaaatcttaggtcacattttttaaaaagggaaaaaacagctcaacactgtatatgccacacaactcttacttgctgttgaaatcacccccagccccaagtagaagacctctgggttagactacagtgagaccaggggaggagggcattagatgtctggggccaggctggggcaccggggaagccctagaatgttccatagcagggaggaaacatgcccctctttacaccggagatgtcctggtttagccgtggtatctgcggtgcctgggagttggtggggctttgctggtgagtttttatcccctgctgaagctgccgttccaggcaggggctcccaggatggggaaatgatgcttgtctgctctgcgtctctcagaaagatggcagaaagcaagccgggcaggaggtccctgtctgtctccagggctcgccccttcctcggatcagctgcgtttgctaaggaggtggtggcgtggcctgggccctgccaccccccacaggcctggttcacaaccacggggtaaacaggggttctcaagtgctaactctggggctgagagtcctctctgccccatggcagcaaggaaaatcagcggcagcttcaggctcagcctgtcttgttaagtggagatgcagtgactgccgccagctgagcgtctctgtctgtggctggatttgtggagccactgacactgctgatcagtctgccccaggtgagggcacagcaggcctggggtgggcccagcaccgctgcttggaaggctgcggtgacggacgggaggtgcaggcagtggtggtctctgagtgcgccaaggctgtgagcacacagaacctgcagctccttataggagggtggggaggtgaactgataccactccccacccactaccccgctgcctcagcatggctggcacctgcaggctgggacaggcatctgggactcttggtgactgtgggctggggagccactgccctgtgctccaggcaatgcaggcacccagggtacctctgtgggccggttcttctttctgacctatcctggcagctcaggccttgtgatcagatgggaatccctggccatggagcacacgagcccctgcccagccccactcccctcacagctgccccaggacacttgtccatgcttctctctccctcataggtttctgagtgagcagacacagccccttccccctaccgtgacatgggccccctccccaggcaccacgggaagatggagaacccgggtcttcccagccagtgagcccacccaccctcaggggtagggtgcccactgccaggagatgctgtctgcctcttccccgatgtcgtctagtgggagggagctcaagctcccttctccgtgatgtttacctggagggcagcaggtcgggttctccctcccttcctgggccctctagttttggaagaagacttaggttatctcagccaatatgcattggaccccttgatggctggtgggggatgggacctgggagtccagtgagacatgggagccttgtcaaaattccaggggcacctggccctgctgtgtgatggggatgggtgctgctggccgctatggtggcgatggcgatgatggtgatgatgacggcgacagtgatggtgccggccaacagtcatgcagcactatcgccacacactgtgatgatttcaacctcactagtgttggggacaggtgtgtaattatccccactggccagatgagacagaggcacagggaggtgaggaagcttccaaggagcctgctgagtggcagactgagggttctagcctggcacatgcagcccggggagttggagggaggcccagccgtcccctcggcagcacactggccataaagccagccttctggaagccagccctgatccgccaggtaggacaggcctctcctgtggtctgtgcaggagccctgcgagggcaggcggcagaggggctcatgatgaggctccatgtcagtggggagtcggatgctggatgcggggaccccaggtgagccaggctggatctgtgctgtggagacaccctctgatatggggtgggtgggagtcctggggtggggggggctcagtaccccccgcccaccacctgtgtctcttcccctgccatgtgtccctcagctcctggggacagcagctggccactgtctctttctctctcagtgcctccgccgttaccatatatgtctttggggagttgctgagggctcttcctcatctccctctctcccgccttgtctctcctccccatctctgtctcccgctctgcgtctcttgcgctctctcagcacccccactcccagtgcacagcccctctctcctgggttgctgtggaggctgctgtgggtggccgcagagaggctgtggtgcttgtggtcctggcgcggtgcccgtggctccaggccacatctctgctgaagacaggcacgagtggcctctctcatgtcaccaggacagaggccgctcgcaggggccttcctgcctcgtgtccccaagcttgctcgccccacagaccccccaggaggtgcccatcggatgcacagtatatgcatgttcatccgggggcatttattcagtgcctactgtatgccagggttgtcagactctaccttcagatgcgaatccgaccttaatccttccgaaaatagggtaaagggatcagccgcgcctggcccatctcaacaccccagactgccctgattccacgctgcagaggtggacacagggtaggacttccgaggtgtcggggagtgggcacgaccgcccctcccagggtcaacagcgcccacgtgcctcctgtgggtttcctgagttggggggtgcatggcccaggaccaaggacatgggtgcccctcctttcgccatttgtcaaggtgggattgaaatggaggctgtggtgggatcccgagggaggggaagcctgtgggctgggggtgagaagtgactccagggacactggaccgtgcactttccccggcagcgaggcttccgacttcctcagacaccactgaccacgctgggatggctgtagccagcatcctggggctgtgccctcctggagttccccctgtctgaggccaaggtctgttttgtgaggggacgtgtcccagtctgagtcctcagatgtgagtgcatgtcggaatcaccggaagggctggggaaacccagtcactgggccgcacccctcaccccacaataaggccgagatccaagactctgcatttccaaggagctcccaggcgttggtctaggacgctgctgagaacctcggtgctgggggtcagcccctgagcagggagcagggtggctgaaggggttgttaagcccgaggtgggctaccccacagcccagaccacccatgggagtacactcaagctggaacggcccttcccaggtgtttggggtgggcaacggcctccctggccagggcccaacttggatgaggcagctctgagctgagttattgtcagcgcgcctgacagccgatggcagccagccccttctagaagggaggtctggccagtccagcccaggaggcagcctgtgcatctgcatgtttgcaaagccacgcttcatagatgctgtggccacccgaatgcttaaccacagcccagcagcaagacgccagtgccaccgtgtcatctcaaggacacctgccctgtctgaagtgcttgcaccaggcccttctccgccctgtcacccccacaccatgtgccctgtaccaaagcagtttgtgtgtcatttcgatggttacgtttctgaaacttggatggttataaagtggaatatgaaagtccttgattaaaagtgctggccatgggacgtctctggactcagacccgcgctgtgtgcggccgccttcactctggcccaccttggcatccatggcactggtgcttagccttgtggccggctggaggcgagggatgtgcatggctgtttagagtggtgggattgccttcttgtttaatggagggtgccatcctctttctggaagcttctctgtgttctgacacggggatgcaggcccgggcataggcttttggaatgctagcccctccacacccacccccatgagaccccacaggcctgagctttggcaagggagggccgagcccccacctcccggaacctggcccctgagatcggccgtgagcggcttttgagcctggaggctgggttgaggcctgagcatcctctcttgggctccgagccccatcaccaccaccctgaggtgaatcacggactgtggggcggtgcggggaacagctcaagcgctggcacagtggtttatagtccatgattcattgatggaagggccgcgttatcctagtgaattgcaaaaccagagcccaggaatgctggggcctgactgcagaccgttggggagcgaggatgtgaggctggctaggccaggtggcagggcccggcccctggtagccaatatggccttcccgcagcgatgggggttcatgtggccaagggggcctctctttctgcagagatgggacactgagacgggaacagcccgtcctgggctccagtcatccggcctgggtccaagaaggaagcccagggaggccgaggctccgcccccgactgctgccgtccactctccactgttccccatctctgtccctctgggtctgctctgcccaagcccctggctctgaatctcctgcatttttctaggtttctctctctctctctctctgtgtgtgtgtatgcgcgcacacgggtggctacgtctgtttctcttcccatgtcttcctccctctttctatttctctgtgtctttatctctgtgtccacgtctcgtctgtttctctgcatgtgctttcccgtctctctctctttcccccatctaagtcttttaactctgtctctagctctctctctctctccccttctctctctcccccatctctcctcttcctcctcccccgccccctcccctcctcaccctgtccctgggtctctcctctcacccttcctcctccaggtctctgctcctcccccacctttctccctttctctctcctccctcccactacagccccctgtcccctgcctcctccgtctgtcctctcccagctctttgcggagggactggtgaccttgttccccttgctgtggcactcggacagtttgcacagggaacagtatgaccgggaaggctgttccagggcaggagcagccaggcttggtccctggggaggggcagccgctgtgcggtgggtgttggtattcagggctagctgcctgccctaggtgctgaagtcacttgatggtggggaccggtggcagggcgggccagatcaccccaggctgtgtttcagctcccaggccgagggcttgtatcttgtttcaaacctgctgcctgcttggggctgggccaggatgggcccacagccttccggtggtgccgactttcccaggcctgccagaggaggtggctgggtcctctccagtcagggccagctgggctgggcaggattgggtgcagttttagggttgaagtgagcagatgtctctggtttcctgcccagctttgtgctaggtggggagacagttgggggctccccacgtcctgcagtcagggatgttgctcccagggaaggcagctggtgagtgggccggagcccagggatggagcagaccgggctgcaggttgaggaaaagaccaacatggcctttgcatgggccaggatgcagtgcaggggcgatcgcatcagagaggcagaaggaggtggaaaatgtgagcgctccccaggcagcagatcggtcaggatcgagggggcctgggggacatctcaagctgggctgctggagtcaggaagtagttcccagaacagcagccttggtgtctgtggcagctggaggcactgagggaggggccctggcaggctcacaggcggcaggttgtccctgggggatgggtggtgtttgagtctgttctgcagggatgtcattctaggtgattccctcgtggacaagacaaacaaggtcaccccggtgcggtggctcatgcctgtaatcccagcactttgggaggctgaggtaggtggatcgcttgagcccaggagttcaagaccagccagggcaacatggtgagaccccatctctacaaaaaaattaaaaaattagccgggtgaggtggcttgctgctgtggtccgagcttcttgggaggctgaggtggaagcactgcttgagcccagaaagtggaggctgcagtgagccgtgatcatgccactgtgcacctcagcctgggcaacagagcaagaccctgcgtccaaaaaaaagggcaaacaaggtccctggagctgacacccatggggaacttggaccatgtgcaagcctccaaaaaaaagggcaaacaaggtccctggagctgacacccatgggggacttggaccatgcgtaagtcaatcagcatggcaatttgagagagtgttgaagggcaaacatgtaagccagggtcaggaggccactgctgggcaggagggcagcttttatagggagctggccgcaaggcttctctgaggaggtgtcccttgggctcagacctgagtgataagaagggactggccaggcagaagtcgggggagcaccccaggccgtgggcacagcacgtgcaaaggccctgaagcaggaacatgcgggccatcttccaggagacaggtggtgggcatggggagagctgccctgagggaggtgggccagggccaggaatcctggcctcagagcaggagcagggactgtggatttgatgccgagttgcgggtcgggatctgaattaggatttacaacagagcctcggctggcacagcacacatctgtacaggcggaacaggcttccatgtgcgtgttaaatgttgctcacgttctgtcgacacgcatctttctgccgtagagtgctggtaaatgtttaacaaccagctttctgtagggggaagctgcgtttgtagcatgtgccggttgccatggtgtaaataaatcctctcaccgtgcccagtgccacgtgacaacgtgctgccgctgacttggaactggggaaagatgcccctagcaccaggctgtcttatcctgttctcaccctgtgcatggagttggcggaagtcacctccacggcacggatgacttcgtagctccatgtagccagatgatcaggaagcaatgcccttggagtgcttgtaaccttcgctttctttctttaaaaaaaatttattatttttttagagatggagtctcgctctgtcacccaggctagagtgcagtggtgcagttgaagctcgctgcagccttgatctcccaggtttaagctttcctcccaccttagcctcctgagtagctgggactacagggatgcaccacctaattaaaattagcaccaccagctaatttgtagtgacagggtctcactgtgttgcccaggctggtctgaactccgagccctagacgatcctcctgcctggccctcccaaagcactgagattacaagtgtgagttaccttgccaggccataatttctttaattgtaaggttaagtgtttccatttttaataatggccatgagctggtagccactggctccagcacgccttggtatatctttttttatttatttttttttgagacagagtctcactctgtcacccaggctgcagtgcagtggcgcgatcttggctcactgcaagctccgcctcccgggttcacaccattctcctgcctcagcctcctgagtagctgggactacaggcgcccgccaccaagcccagctaattgtttgtatttttagtagagatggggtttcaccgtgttagccaggatggtctcgatttcctgacctcatgatccgccggcctcggcctcccaaagtgctgggattacaggcgtgagccaccgcgccccgccacgccttggtatatcttataaaaagacaacccttaaacgcactgagatggcctcccctgactgcattttccccagcaaggacaggagactgaatccgagggacagagagcaggtgttagggaagagctgccagcaacagggaaccctgttctgcctcggctctgacccctggccccactttccacaccaaccccaggctcctggaatccccatccctacactgccaggaggtggaaggtgtcatgaggatgcgccctctcaggggcacctggcacatggtagatgctcagtgaagtgtttgttgaatgagtgcatgagattgagccacagacggtgttgctgggttttgggaagttctcctgacacatttgtaaggacttagcatctgagaattaaatctcatcaacccctacgtgggtggtcgcagcaccttctcactggactgtctcctctcattcccggaatccaccgtcttccttcctgcgacctgctattggattgctctttaacatggggtgggtcatgtgactccccgcgacccctgcaccttttgagaaaggtccccgggggctcccaccgccctcagaatgcctcctgtatttctgagcatgggtgttagccctggccaggccctccagccatgccccaaagtgccacttggtaggcacaggggccattttcccattgccatgccgcagaggcctcctgctctgccaaagccccttccctcgccctgcatgtcagcacgccttgctgcctcatctgcatcatgaatgtgccttttgaatgtgtcctcgtcaccggcgcctccatctggcctgtctttgtcaacctaaatacaagctccatacagttgggggccacatctttcggtggctggtgtgccccttgggggttcaggttatgctggcggaaggaaagaatcaggcaatggcatcatttggtttaaatgggcatagggaggaggctgtgaacccccagcccagggcggaggtagggcacctggctgtaggaccttctaggaaatgctgtgtgaccttggatgagttacttaaactccctctgtctttgcattctcatccataaaactgggatgataccagttgttgggaggattcaaataacaggtaggaagtgattaggagaagaaggcctcatcaaatgtgctcagcgagcttttgctgtttttaattaagatatttttctgcatagcccccagtctggggcttctgcacaggcccagtcatgtgctgcttgtctggcaggctgagggttatgggttcagtgtccagatctgggggcaggtgtctcttggggctttgggccagtggctctggctaaccatagatccagtagggtttgtcacagagttgtactgtggtttggggggatgtttctgaccacgcacagggcacaaacccactgtcagcctgaccagtggcacatctgaaaggcagaggtagccctccaccacgagggcggggtcctttgagatagtggagctggcttctagttctttctgattctcctttcagtcccctcacgttgagggaatggtgcccacaggcgttttctgctgcacagagtcctttatgtgccttgtgagacaaggattcttgaaggcctcactcctcagtgggatctgaggccagccgtggcagcttctcctggcgcaggttagaaatgcagagtcccaggccccaccccagaccgactgagtgggaattggcaggggatgtgtgtgcacctgcaggtgtgggtaacactggcctggagcagagtgctctaacgaaagcccacaggccaaatccggcccaccacctgcttttgtaaataaagttttattggcacacagccgtgcccttttgttgatataagggccgctttcacaagacagtggcagaattgagaagggggttgacagagacggcatacttatcctctggcccttacagaaaacgtttgccagtccctggtaaagcactggttctcaaatctggctgcccatcgggataacctggaatttaacatacgaacgcctgggtctccgcccagagatttggatgtcattggtgtggggtgcggcctgggcatcaggacttcgcagggctccccacgagatctgagtgtgcagccaatgtcatgggaccttgagaaccatggcccccagtggcccgggaagcccagcaggtgcagttctgccgctctatggacaggcccaagacccagcagcccagcctcgccagtgtcggctgctgcacttgctgccctaaaacatagaaggctttgggggctgagccggctgccgggtccccccagctcctcagggggagttgtgagctgggacctccctctccctgcataatctcccagcagcgagtatgagcggccctcaatcagtccctcggcctcccgggtggccactgcgagaccctgcagatgttcatcattaaggctgccggggtctgtcccactggaaagcatattttaaggccagggctgctctgctattcctccttttcatcttcccccaccggactcactcagcgtgggctgcagggatgcctctcccacaggagatgttgaggccacaggaagtgaggagcctgtgcacagggccctaggccttggctgcagggtggcccagaaggtgctgtgctagtgggtgttgctgcacccactccaaccagagggtgagggtggaaggcacccctgccctgggggcttgttaacatgtcagggaagaggaggcggcaaggcttggtgccaggattgcactcggtgcctcagtttcctgttctgtaagatggacaggtgggtgggtaggggagaccatgtgggacggagccaggcacgtggtgccatgagcgatcgaatatggagacatagggggtgacgttccaggagcgagggggttgtgggcaggccctggcggggcttgtagagtctggagtgggaggcaggtagggataggtagatggggcgtgctggcaagtctgcagaacacaaactgtagatcctggctgggggttggctgagactctcagcgggggctctgggggcagcagggccccatcccccacactctgggccgtcagcctttgctccgagacctcgaagctttgcctctctgagcctgtttcctcctctgcagaatgtgaccagtgatcactgctctcctgtttctgaggctgggatagtgtttgcaaagcacttggcatggtgcaggggtgttactcgtggcgttttcatctccatcaggacttcagaggggccaggagccggcccatagaaaatggacagcacagtgctgggcacatagtcagctctcggggatctgtggggattttctcctctgtaccagcctcttcttccttggggcttttctgaggacttggaggagagctgcggtggggaaggctcgtagctcagggcctggcccagatgcatccctctcccaactggcccctgcctgcggcctgatgggtgtggagctgcatttactggccatgccggagcagacattagcctgattcgttggtccatgggtgaggccccagggggtcatggagcccccaccagcctaggtgcaggggctgatgggcagatgctctgggaaggaggctccgtggctgctgctcccatcgggagggacgccacagcccaggtggggacttcttggcacagacgtagctgaatgtggtctcaggagacaccaagcccgtgtgattcaaaagccccggccctgcccagactctggccctgggctgttgccagggacatctgacccggggagacggcatccatgccgggcagcccaggggccaaggctctctccccagccagccacatcactcctccctccccgggtccctacctctgcccacatcgggcaaatgtggacagaaaggatactgtgtaggaacaagccaaaaaaaccctccctgccccagcttccacctccaaaagaggcttcacctgccggctgtttaaacgttacgtttgagggttcgaggtcaggagagggagaacaggttgatcccaggatgccgggcacctgttggggaatcagcagcaacctgggggccggggggtctgttccaggtcgggcaactctgccccttcctggctcctcttacagaacatggtggcaagggattcctggggaaaagaggcagatgcaggcccgaggctctgccctggacctggcagcagcctcagggagcccacggttgcctgcagcagtcagacacttgctctgtttttctgccccatcctaaatgaaaagaggctggagagagcgttgtgtgcgggtcaggcacctgttcctggcaggaaggaaaggcaagagaagggagtctctctcacctccccgatccctcctcttccatctgcttggagttcttgctccctggtttgaaacattgccgtgactgtgcccctggtacacattaaaaggctttggggtttatttttatttcgcttggctcagagggatggaaagatggtctggtttggcagctgcctgcagggaggaccttggggtgtccaagaaaatcagtgtgtgctttaaaagaaatcaggcgggatgacaggaaatcgggaggcggtgccaggaggagctcacactccctcctctatctcggtgaggggaggggcggtaggcccagagtggctgggacaggtcggggaggcagatgacaggaagaggcccaagtaaggaggctggcttggctcccagcctctctgatctgctctgtaaaatgggcttgttctgtccccctggggtgctggcatgcgagggagaccaggcccaggcagcagagcagccacctccacgcaggcctggggccttcctgggctctggggaatcaggggcatccccccacctccccgttttacagactcggagaccgaggcttagagaggtggcctgagctctgtcgggggcagggcagggctggggcatcaggggtgtgtccccagcttcccagatgctcaggcacccctgccgaggctcaccagggcacctctctcaacccagatcacatctgcccctcttaaatatccgggccagatgcggatgtaagcatggtgaggattctctcatttcaacctcccagccctcagctgaggcacaggcatgctgaatacccccattgtcaaggcgaaggagtcggcacagagaggttaagaccctcatccaagctcacacagccactgtgtggaaagggcaggaattgaagccagcacttctgacaccaatgcttcctgcccctcaccccgactccgcctccccaggcccctagggcggcaagaccccaggccgtgcctctccccatctcatgccagtggggcctggcttcccggttgtttatgacctcttctgggtggactccacgggttttcctcctcctcccccagctcaggctgagcccaggtgcagagattcacctgttcacggttttcttccctccccactcccctctgccctcccccggggtctgacagcagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaagtaaggcagcctgctgtcccctgcagggcccggccgctgacccaacccgggtggcacacggttctgggggaccctttgtagagacgggtggggtgcccaccaattgcctgtgagcaggggggagggctttctgctcgtttgcccctgacagccccccttccggaagcccacccatcgccctactcctcctccctggctcccccctctcctccgccctcgctttctttctccaaccctctggagactttagtagactgatagctcatttgagctccactcctgagctaataaatccaggcaatgactttggaactctctgcctccctgcttcctcccgctctttcctcctgaggcgccaggaggggggaaagggggatcagaggccctcctggaaggactaggtgtgcaggcggctgctgtcacctttagaatcatcgatggcagtgtgagttcttgcagatcaaggcacagcctcaccgcgggggccgtgacagcctcctgtgcctgccaggggctgcaggagtgcagccagctggagaaaggggggcggcacgacttagcgccaggtacctgtaatgggctcaggaatttggcttcagagaacatctggcttcctcaccccgtctcccagacgcttccagcaagggcctttcaggaagatgaatgggaaggcagaggtgatcaatctgagcctcccgcagtaaaactctccccagtcacttctgcgagagccccagctcgggtatcgaggttgtgagcacccccacacaccacagctaggcctgcaggctaggcctgcataaaaccagcaagagagtttcctcctgccaatgtctaagatgatgcccggcccttgataatactgaaggccaatgtattgcctcttatagagcccctctggaaatagctcctctgtggcgaataaaatggccctataaattgctgccagcccacgcccccatttagttcaccaaatagtcttgcagacagtatctctctatttggtgcataaaatggtcttgcagataaccaccagcccagaagaaagtagccttgcaggaaagctcccagtacctcccatttggggaataaaatagccagccaattaactacctgtccacgtggccttattggtgaattaagttgatagcccaggttacacccccatcctttctttttcttttttttttttttgagacagggtcttgttctgtcacccaggctggagtgcagtggtataatcatggctcactgcagcctcgacctcccaggctcaagagatccccctaccttagcttcccaagtagctgggaccatcagcatatgccaccacgcctggctaattttctgatctttttcttttgtagagatggagtcttgctgtgttgcccaggctggtcttaaactcctgggctcaagcagtcctccaacttcggcctcccaaagtgctgagattacaggtgtgacccagcacacctggccgcaactcccttttgagaaatagcatggtgttgtcctgccagctgtactcccacttctggtgaacatggagcccctgcagacttgcccctggccaccctcacctcaggcctctccccctctttcctagcgtccgattagtgccatggctggcagccagtgcaaatccagctaaagaaacagtctcctccagtggctgtttgatttcccggctcgggtgaagccatcctatctcccctctctggcctgtagggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctgggtgagctgggggccagggatgcgggtggggaaggggctggagacacggcgggttgcgctcatatgaaagtttcgtgcaatttgagttaattggcaacagccaaggggttggtgtaagtcatggttggagtcaaatcccagcgctacctactggatgtgctgtgtggcccagcatgaattcctgaacctctctgtgcctcagggtcctcatgttctcagtgggaggaatcggtggttacctctaacgtggggggacagttgtagtcacttgctatgtgagaagcacctagaacagtgcctggggtgtaggaagagttcagtggcttcaaccacagtgatttcagagcagggagatgtcacaaaaaattcccagtgaccagttccggattttttggttgtcgtttttaaaacagaagatctggccacgcttggcccaggttcccatgaggtggctgttgttgggagccgagtaaccaccactccttcttagaatgtcatgggctctacttgtccccacccagcctccaccctggtaggcatctggttttgtaccttcacttccgtgggcctcagtttccccttctgttgagaagggtgttcatccctcactaccctcccagaaagtagaaaaaaatgagatgatgtgagtggcagttcccaagattcgccgcagggggcagcggtgtgcgtctgttgtctctactttgtttagctgttagggtccagccctccagccactgcgggaacccacccaggggcccaagcgctcaggccgaagccccgcctgccagggctcattctcagggtggagatgctgcttcatctcccacagacccccaccgtcccctggggtccgggtcatgcacctgtctcttcttctcgtgggatgtagtttggacctatttcataaatggcccactcgaagctcagagaggaaacgttccctctctaaaaatttcattgtagctggggttagaactcagccccattggccacagagcctatgcagctcctgcagatattttccagctgcctcttggtggcggtgtacttggaggcccagggtgaaagggctttcttcctgcctgatctctggggatagtcctctcggacccaaggctgatgctgggggctcagccgcagggtggaaaacacactcctaggccttccatgtctcttctggcactgggcaccctcagcacccctggcacccctggcttctgtaggcttcctctgggagtcctgtggggaggaatgggagcatcgatgaggtcccagagaggcccaggctgtggctgcagagatgggggaggctggggtggctctggcctgtcggggctgatggggctgcccatgggggtgggggccgtctcccctcttctgctggaaccttccgccactcctcagccagcctctgttggacacatactccccctggcgcagttccaggtgctgagtccatggagctgacgtccctcgcacccaccccactcatgggtcttaagcaactggaaaggaagggccagggctcacatccagaggagctcggcagacagacccaaaaatagtgccactgcagagatgcagccacctccagccaaccccaaggccaggttgtgtcccttcccagtaacaccagaagcccctccttgtcctggatgagtgggggtatgaacattccctctggagcagggcttctccgccatgggcgattttactcccccactaggggacgccaggcagtgtctgtgaacagttttgatggtcacaattggagtagggttgctggagtccagcgtgcagagtccagggttgctaagcatcctgccgtgatgggacagccccacagtaatagaagagctgggctccgagagggtcctcggtcagatgaggtcccggcccacctgaagcttgtgtcccactgtcgccacgtcaccaggtgacccctttcccaacagagtgcaggcagaggcagtcatggtcaaggcccttgactgcttcagtgtccccttctataaaatggggtgatcgcaggtgccccgacttcagcggcttgtgtggaggttggccccgaccaacggcacgtgggactgcccagcacagctccagcccagcataaaggctcagggagtcaggtgccacggtgggtactggctggggaggggcgtctgaaatgtggccttcccacggggttcagagccgtgcggtgacaccgtcaaggcctggtctactccctccctggctcaaaggagagaaaagggcagaaggcaaagtgcctcctctcccggctcctgccaataacctggcatcttcttttcagcctccatggagctgaatgagagttctcgctggacagaagaagaaatggaaacagccaagaaaggtgaggggtgtgtggcggctttaagccttgttggtttgcatccagggcgcctgaagctcacgtgctggggagggtgttgacacatttggccttgagccaggggctgtggtgaggcctctggtgaggttctggttctgggctgttctcaggtttgtcaccctggagcctcagttttaccttccagaaaatgggtctgtgcagctgcgctgtcaggcttgtctttgtgacttgagggcgcagctcagagagacacagcttgtgctgtgcatgtagtcagcgagtggcttctgggtgacctctgtggccagcacctctgggccttggggacagagcagtggcagcacacctgggtatctcgggacagtcagagcttgccggcggccatctcggtagagtcctggggtcagggagacctgcagggcgttcatccagcccttagagccccaaaggtcctatcctgggctcaagtgtgctggggctttggaaacctgtctcaggtttgagcaccccaatctgggtgacgggttctggagtggatggggacacccaggccgttggggacagtcgtgggagtggctcacacggcagggagccagcaggcattggtgctggcagcagaagccatcccgagcagatggccttgtgatgtgcagcaccgtgggggctggggtccagtgcctcctaagccggatcccctctcagctgtgctgtctcctggccaagatctttacttcccagcacagtgacctgcctctgggcctcggtttgcccgtctgttgagtgggagggtcgtctaggttggctgtgcggaatcagataaccctgtgtgagggcccatggtgggctgagtgggagcgaatctcctccctccctcggccgtgcctggcctggggcaggggctgtcggagctggcgcatcactggcagcactgctgaggccggggcagcacctggctcccacggcacgctcactctcggttatctaagaggtggggcctgctcctgtccccgcccatgtccctgtttgtgggcaaggagccaggaagcagaggccaaggagtgccacgggttccggagctggtgtgtggggccgggagcaggcccaggcccccactccccgtccctgtcccgtgcttggtcccgtggccctgctggagtcgaggctgtctgtgacgtgcggtttctttgtgcagaaagctccaggtcgtgacttatggagggaacaaaggccctttatagcaaacgctcttggcacataagggcaggtgtatctgagaacagcctggatcacggggctcctgggcccggccccgtcctccactgtagttgtggggggtgctgagggtccccacagccctgagaagacccccatagcccccgccctcaccccgggaccctgcccctcgccctcagagctcctccgggggcagtctgccctccgccccccaggctgaggtgaacctggacccagagagaccctcgcaccattcaggaaggagggcctgcctgccgctgcaggtcaggctctgtgtgtggtgagtgagaggcatgccagcggggcctgggcactgtatccagctggtagggcctgggcactgtatccagctggtagggcctggggctgctgtcagcccccagagaggccacattgttgtttctctgtctttaatgtccacttggtggtttctggcatgtatttcattataggctgcaaaagaagctttattgaaattgtgtgattcccgccgccttttatttaattttgagatgatacacatggcacgaagctcagcattctaaccactggaaagtgaacatctcagtggcatgaagtacatctgcattggtgtgcaaccctcaccactgcctagttccagaactttttctcaccccagatggaaatcccatacccattagcagtccctcccagggccccgccccagccctaccagcccctggcagccactaatgcactctctgtctctgtggattggcctgttctgggcgtttccaatgaatggaatcctacagtttgtggccttttgtgtctggctcctttctgggagcatgatggttctgaggttcatctgagtagctttgtacggctgaataatattccctcacctgcacggaccacattttgtcggtcgttcatctcttgggggatgtgtgggttgtttccatgtggctgttgtgaagagtgctgctgtgagcatttgtgtaaaattgtgtgagatttttaatcacaggtgagtccctgggatctcagcctgttggctgggagatttcccagagcacccacccatcggaggactccgcgtggacatccccaaacggtcagcccagggtcccaccgcctctccatcccttctcgtgtctcgtgttgtcactaccacctcctcaccggtgaccacccccgcccccaccgcccattgcctgagaactgggaagacagtgcctgccctctgtttgccttctggaagggcagatccggaggctgggaggacggctggggatgactcaccggcggagaggagcccgtgtcccaccatctcaaggttgggtcctcagtgatgacagtgagctcatcctgggtcctgcccatggagacggcagtgagcgtcccctgggggccgtgcacgcggaggccctgctcagtgacatttgtaataatgtcgtgagcagcagcatgttcgtctgccgtgaattacagcaatctggacaattactgctcagggtggctgctaatggctgtgtgttccaggcgatggcaggagggagcgggggtggggcggggagacaggtgctggcaggccccagcaactcctccatagggggtcggggtggagaagctaggaacgttctggagcccccgcccagaaaaccaagagttaggaaaagggactggagaagcggctattgctgaggcagatggtctctgcccatcctttacccatcatttcagcaacatagtgcctcactctctgtgtggcaggggcactcaggaatgagccagccccacccctccctcggggagcctgggcaggtaagcagccaggtttccccagggccttcggaccccagcctgcctgaagcctctggaagactttagtagcatggccctggaggatgagcagcagaggggccccattcctagggagaaaccaggtctcaaccccctggatgtttcagctgtgtgacctcaggcaagtcagccaacctctctgtgcctcagtttcttcatctgtacagtgggattcaaggagcgcccactgtatgtttcctgtggctgccataataaagggtcatgaactgggtggcttaaaataaatgtattctctcactgttctggaggccagaagtccaagttgaaggcatccaagaggctgcattccctccagaggctctggggaggagcctgccttgcctcccccagcccctggcgcctgcctgcagccttggcagtccctggctcatgaccacatccctccaggctctgcctttgtctttgtgtgcctttctccctgcgtgtctctgtccacattttcctcttcttacaaggacccaccccaatccagtatgaccccacgttgacttgatcacatctgcaaacatcctttttccaaataaggtcacattcataggttctggtggacacaaaatgttggggggatgctctccaacccagcacacccaccttcctggggttttggtgaaagtacacagaagagctgagggcagtgctgcccggggcataccgacctccccatcactttgtagctacaagcagctccttagccccctgaccttggcctggcccatctgtttcaccctcagttaccatcgttctctcagatgaggcagggatgctacctcccaggggcactttaaagacggagcgagccacataggaacagtccttggtatacagtaggcactcagaaatggcaggccgctagcttagggcgcagtctccagaccctgctccctaggtttgggtcccagctgtgcctcctgcagagtctgaccctgagcaggtacctacactttggggcctcggcccccgccacctctgtcttcgccccggcgatgggggtcggaggtaagtcacctgccaagcaaatgtacagtgacaactggaggaacttccatggtgctgggggccaccagtcagagggctaccccgaggaaggggccgacacccagagcacgaaataatagtgaatatcacccagtaacaccgtggagcccatcctgcgtgctgggcactgctggaagctttgtgtgtatgaagtcactttatctctaccaacctgactaggaggcaggtgctgttaatacttctgttattcaaatgaggaaaccgaggcctagagaggcttagtgagcagcctagggtcacacagctgtgaagtggtagagctgggatttgaacccaggcactctacttgcagagtaggaatggggttggcatgagagctgaacaggttagtccatgggccaacctgttgaccaggtaacaaaggcaggacaggcatgtgcaaaggccccatggcaggggcagtgtggccccatgagaagtggttgaatcccagaaggtagaggggccaccgggagcctggccttgccagcatgggatggagtgtagctattactctagagcgtgggaggccactggggaggggctggggacatgatggccatagggtttctggtgggcaagtgagcaacctcccttcttgtgtgcatgcggctgtggctgcctgccctggggcttgtgctgcctgaggaccgagaatgttcaggaggcagcttccccaggaaccgggcagctccggggagctggccgcctgccctcgggcccagcgccaagtggggaaggaggggcagggcaggagcagggctgggatgagggactcggttcccctgggaaaggtcagcctggcctggcttggaagcctgacccagctgtgcgagaggcccgaggctctgctggcagctcctccaggccccagccctcttctctggcgggcagagaacctgctgtggagggggttgggaggctcccggtcacaccattgtcacaccattctagaccgggagttggctctggcccgcctccgggctgccagtccttcccaatctccagggagcggccaacagtgggaggatgtgcaagaccaggccctggtggctcccagtaagcccgggcagaccccagaggcctcccccaggactccagctgccttgtctagtggccttgccacttctcacaggagcgaggcaggaaccacccattgctgtgcacatgggctggcctgacgggcttttatagatgaagcgtctaaggcatgggaaggggaggggtgagcccccagcctggagcctggagagcaggacctcctccactacatgtccactgggaaagccttgggctgtgcccaccatgggccccccaaaagaggagcgcctgtgtgctctgccgcacaaagctgccagagcttacagtggggtgggcgggccggtaggcagtgctgctgctcctgggtttgggtctgcccggctacttcctggtgcagctgtccgtcagggcccagcaggaggcgacactcgagctgtgtgactcaggaggggtggtataccaggcagggacggtgcggtgcctcggggctcgcgtccaaggagactgtcaccacgtgtggtctggagagagaccactagggagggtgcatgtctggggctggttggcctcccggccggatatgtgagaaacagtctgttgtgatggtttggagggaggaaaaaattggggtttctgcaggaacttggggtacagccagacacaggggcagggtctggaccacactcttgctcctgtcagcacccttgaagatgaaatcaggcatcaacaagccccccttccctcctaggggagacccatgaatccgcatccacatggctcctgactcagggaaggagcacctggcggtcgatgcggtagtaatgatgcctgtcgtcacgtggcgtggctggtgctcacgaacaaggcaggccctccacacgcgtgtgtacacacgcacgcatacacacgacttctgctttgcacaggagaagaccaaggccagagggagagccagtgctcacccagcccactgcggtggacacagggcatggggtggtctgtctgaccccccaggctggcttccaactttgctctgctctgtaggaaaacgtgacattgaaaggtgtaacgtggcacttccggaaatggtaggcgagacagcgccaggtcgtatgcaggtgactttatttcatcttaatgagtctgggtttttttgagagctgggagaagacgtagctttttcacatcgtacctatgatttacgggtataattgctgatgcggaggctaaggcagatagcgaggctgatttttgaaagagtagatggagagaaaagagtggggaggtgcaagtccaggtgtgatgttatccagccaacatcctgataggatttcaggatggcaggagttcgggaagtcctgacaagacacgcaggagtgcccggcctgtcaagggtgtcaatgcggaggcaccgtccctgtggaacccccccccgccagggcttggggtttctgaaatgaggaagtggcatgactcaggcccaagacggctgggttcttttcctcccaactttgatagggttttaggcagagcatgctgagtttctcggggaaaatggcaggtggggggcggtggtcgatgcacccctctggcaggcagcctgtgagtcttcatggaaggggtgggaaacgtcaaggctggaggtgactggctggggtggggagagcgagtgtgtttccagggttgggggctgacttccagagaaaacagctgcaacatccccagatgcaggtgggcggtggtgtggtcccctcggagtcctagctgtggatgcaggtttgcagacccttggagaaaagcagcttggaggcatctgagcggcagcacaggcctccctgagggccagagcacctgagccgaggaggctgagtcctggcccccacaagaacagctcgtcatgggcccgcggatggcatgtgggacgctgccccatgggtgcccagaggaggattagcccagcggggccccaagcacccactcccgtggccgccgggcccctgcgcctggctctccactcggcgtctgtgactcagacctcctggctggacttcctgtcttggtcaatttcacttcctagttcctgcctcctgactcttcagaacgaaactccttccttagaaattagaagtggggtcggggaatccagaccacagggcatggtggcagaatctgccatctccgccctggcacagagtgttgggggcgtgtgcctggatgtcaagggggataccccagcctcttttgggagggttcggggccccctgcagagctaaacgcacagccccctcttcctttgcaagctccttaccagggacccagacgggtggcagagatgcccagggtgctcagcaggccccggacacctgccgatgagcagtgggacgagggagctaatttcagaggcggtgaaagctatgaagatgatcaaaccctgggatggcagggcgacgggggggggtcactttggaggggcgggcaaggaaggcttctctgaggagccatcacttgagccaagaccagagggaagacaaggcacatctgtgagaaaacccgtggaggcagcaggagcagctggtgcaaaggccctggggcacacacgagtgacccagagagaggctgggcgggttcatggagctggctcctaagggtcacctgggccgtgctagggcctttggattttattccaagagcttcatgtggtcactggaagattttaagcagaggagtgatttcacggggttggcatccttaaaagtgcactgagacctcccctgcagagggcagagggcaggactcaggtggagaggcccagatccctgatgtggttgaggtttgttgccctcccctggcatcgtgccccaggacgagggctgggggtgcagggacattccagagacgccttctgctccccagatttttagggggcaggatggaagggctgggagttaaagggaaaagcaggttaatgatcccagagtcagggaagtcggtcgtgacctgaatctaggatccaaagttcagctcagttaactttcaaccttctgggtggctccccggcatttcccacagtgttccttcacggctgcaggggctctcggaggaggacgaaaggggcagctgtggtcccgagacccccccagcagcagagggctctttggggaccccaaatccccaaacccttccccctcccctaaatggttggcggtctcatgtgcaccctgcaaaggctcctcaaatcccgggatccctccggaatgcgaggctagccctgcccacccacagtccccgacagagggctcggtcagcctcggcagcatcaggccaggcagggggcagagctcaggtggaactgacacggagggtggggggacgggcggcgggggatgatggcggaagaagctgtttgctccctgtctgccgggggtggagaagctctgtttttctggaaccctcatctgttcttaccactgctgacgccgccaccgccgcggatggggagagagggagggggagccagtgccaagttggcccgccccttgtgaacctgggcctctgccacgctcccccgcccgcctgcccgcccgccgcgagcctccgtctggaggtcacattcagtcctgccgcgtctcgctgggtcaggcagcaagaagatcagagctgagcccggctgcgggggacacggctgccctgctgggcctgggtccttggattttgcccggcccgggggtctgtgggctctggccggcattgctcgctgagcgtccgcactgggcacattggtgctggaggagctcggcacgctgcgccccggtgatacctggcccaggggcatcccacacgcaccactgagaacttcccgccacccaccaccctcggggaagggcacctcgcgcgcccacagcggcttggggacggcgtcagaggtggcagcggccgctggaggagccccgggccaccacaggcaggcggacttgtgaggagctgcctcccgcccgcccctctcgagccagcctccgcccgccgcgtccctccttccctcgctccctccctccctccctccctccctcaccgtgggacggagaaggatgtgaggctgagctgagccgccagcagacgccaaccagcagcctcgcagagccgaccgcggccgcccagcctgccggcccacttcggcccgctccctggggcatcttcccagccctatgtttccggaaaacttggccgagggggagacgcgaatgagaggatgtgagtgagtggtcctggggaggggatgggggactgcgggtgcagggacagggaccgcaacgtggccatctgggatttgaggctgggcagctggggagtcggagttctgggcccctggagtggatgggggtcccagcccatcctttcccccatgccctctcctctctctccctgctgggctgaagctctcctggaagcaggggtgggacctggatctgtgcctgggaaggtctgtgatgctgtgtgcacagggggtctctccaagtggacgggggcttcaagctgggtctggcggggtggtctccaaggcacggtagggtagaaagtctttctctccgtgcctggcagcctctgcctgggcttcccagaacaggaaccagaggaagccagtgccagcctgcccctaccccgcagccctggccggcactaatgggacacccactctggctcctcacacggcagttaaggaaactgaggccggagagcagaagggctggccaagactgctagcgagctctggccaggcgcctggatgactctgcccagctcctttgggagccgtatgttttcaggaagggctgggtgacccccacccccacctccatcccctctcctctgccctcaacccactcccactgcccccatgatcggagttaattagggtccccagcccccagccaggctcctagctacctccttatttattgactgagtttggaaatgtcaacctccccagtgttgttgggccaccctcaccccaccccctgagctctccatgcccaccccacccagcaggcccagatgggagacccgccccctctcgccctctcccacccgggtgccgggtctgtgatccctctggcccggtgtgtttgcctgggctctcttggccccggctggggaaatataaataaacgcgcggccctgtccgccaggttctggaagtggcagctgctgctggcgcgggcggagggaaaggtcaggggccgggtgccacttgatcccacgccccggccctccccttctgcgcctgtccttgaggaaccctgaggagcgggctgtgaggccacgtggctcccagggccacggcaggcgaacaggtggcctgtcagtcagtgccacccccacgccacgggggccagaggacccggagggcaggaagtctggggccccacgcccgcgttgccccccttggctggtcctctaagcttgggtgagttggcgggaccctctgaaccgagatttccccctcctggggatgggaaaatggtcacagccatgacagcaaggatgagacggaaccaagtctttgaagggctttgcaaactctgtgtgtcagttagccgtgccacgggctgatgtgttgatgtttctgctgctgttgttttatttgcattagagccttgtgtgtagcaggcaggcagccagcacgtgggtgggtgggtgggtggatgaatgaatgaatgaatgaatgaatgaatgaatgaaaataccaacacagacggctgcccctcagctccccaacctctgaacaattttagctggagcttggcttgcagcttgattttattcaaggaaaatggttaaaaccttcattatgggaaatccttcattaaagtccttacaagtggagctccagctcagagaggctgccatgtcccgagctacgtgattcagccttggggcctgctgccctggaggggcaccctcttgccgcacagacccctaggtcaggagcactccctgtctctcccacagccctgggaaagtgggcaggccctacctgcatggactggctgggccacacaaggtcacgccgctggagacacaggcataaatatagagctgcctggcctgtgcctgtgtgtgccgcagctcgccgggcagacaggccgagaccgggggcttggcttcccaggcactgcctccggtgcagcaggggctgtgtttctgccgagcctggtgtttgtggccttgaaactagaacctggggggcggcatgctctggttctggcctgagacctagtgatggagggagctttttctgccgattcctggagggtctcttcccacagcaggaggtctgtgaggctgagagaacctcctggttgtgcgggttggggtttgggagcaaattccagctgcgcaaccaagcctggtgggccccgagtcctgagtgggcctttaggtgcccttagggagtttgggccctggaggtgccccagttaacctgggcctggaggctcctggccccagctcatccccaccctgacttccaccctcccatcccctgctcaccacgtcccttcctttcgctgggccggtgtggccggaaaacaacccgtctcccgaggcctcgcctgcagctgtgagcgagtgtcagggctgggtcacgtaggccaggccctccgcccagcaggagaggtggggcctgggcagaggctgtgcgttctggatattcacagccctccgcccccagactcccgcgcagtggcctcggtgggacttcacctgtcgcttttggctcctccagcccaggcctttcccatgcatcctggcctggagtcaagtgactgagaaaccagaccccagaggccaggactgccaccctctagtaccttccccgctaggggacacgtggcccatcactgtctcttcttccagaggtcctgggcctgagcagggagccccaggctgggtttctgctccaggcccgtttgccgcccaggccatggatgcaggccccctctgcgtgccgggcctggcctcttctcactgccctcctctcctgagacaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggtgagcccccagtcacgctgcaccgcgcctctgggaagctgggagaggagcccagactgcctcaggagatgtctctgcaccccaggaggcatgggccagggaggggctattatgccgccttgttagaactcagcttctgggggttcaagcccgggagtaccccgagatggctgcaggcggcaatgctgctatgagtgtccctgccttggagacgggccgggccaggctgccctccacccccaccctgcaccccactcctctcagacagacacctctgggggccctcagccctgtctcacggtgtgggggaaggagcgcggtggaccagactgactcagccaggaattcgggctgtcagcgcgttggaatgaggacccggaggcaaatgggtcctgagcgagtggctcccccgccccatttgacctcacagctttagggctgccgtggttggggagggacaggtctgggggggcgggggcggacgtctcagccccagcatcctggagggcttgaggcaggccacgggaggctgagacccttccctcctccacaagcacagaaggtgcaggctcgcctcgccagcgtgtaaatggcctctgaggagcagccgcttcttccacagctgtttctgggaattgaggagcattttggggagacctctgctgccttccctctctccttcccttcctcctccttcccttcctccctcctttctccctctttgacacacttgccaagcattgtcccctttttggagctggggaaactgaggcttagccaggctcatgtgcgactgaattgcgatatgcacccacagttatgagatcagcacccacgctcttcatcgctaggctgcgtgtttcctcatcgatacagaagcactgagggaggggttgcatagctcccctcccccaggactactcctccccccgccactcccaaaccatgacatcgggctgccttgtgcctgggtgtaaagtgtgtgcagtgggttccgggcaggccatgctgaattgctccctcagtgcaacctgctgaggcccagagagggtgagcaggctgtgaggtcacacagcctgcagtgggaggaccaggtatagcctccccctgtttgaactccgcccaagcactgtgcagaatttaaggacatccttccaccctcccgagtgggttcttagtgagtcatgtgtgcgcgcggccgctggtggctccgggaccgaggggccacggtcccacggccctgtggtcagggctgagatccaccctctggcctcagggaggcccctccccatcacttccagttaagcagtgccccgcgtgccctccacattggcccctgggatttgtccccagagctcagggcttcaggcagcgccttttccttctggatgcttcgggccttctggttgggtgtggaggaaggcaccgcatctggctgaatgtgcagaaccccgtccctaacacttgctgaagtcccttgtggcaaagagggcctgagccagagcagcctgggggcgcagaagggggcctgggccgggggatgttgtgggccattgattctgtcagccaggtcaggagtctgaggtggttcatccaggatgacttgggggcagggctttggccctgagcatctccccaggaacaaaaagggcctcctgctttctccccagctgtcctttcactttctctctcctccccccgcctcccctctctggggctccctccgcctgtccccctcaccccacgaccatggacgtctccccccgctgcagcctgctgccacacagcctggctttccaggcttccgcagggtgtggccccactgtacccctagagactccaaaacctgagagtggcttggaggaccagagaccccagcacggtgaaccatcccattaggcccagggcgagactggggtcaaggcccagcttgtggatttgggcacccctgtgaccttgggcagtgaattcagccttctaagcctcagtttccccatctgtaaggtaggagaataacagttgttatccaagaggtcctatgaggagtgaacgagtgattacctgtgaggtccttagtgcctgccagaggggcagcgctccgggagggcgacgtgccctagttactcttactgctgtggttattgttattttatctggatgccatctacccccttctcagggccacctgaggccccctctttttttttttttgagttggaaggttttattagactaggagatttgtgggaggtatgagcactgggccaaggtggcacgggccatgcttaaggcaccctgttgagtgtggtgaccaccagtgaagccgctggcgtggacgaacatgcagccagagatcccactgacgagggcgcctcttgaacggtgcgtgcaggcacagccacagtgtgctatgggttgggagcagggactgggcccaggagagctgagtttgaacgtaggctctgccacctactagctgtgtggccttggggaagtgacctgtgctctctgtgccttagtttccccatctgtgaaatggggacaataatggaacccacttcaaagggctgttatgggaatacactgggtggctgcctgcagagtgctgggaatgcggcctagtatgccccagacactctgctagtgagagctgtgatggtgctggtggtggcacactcacgactgattgattcattcattcattcatccattcattcaaagaggcatcccagaaggatggtgcagagcagggctttggagctggtggctttgtaccccagctctgccgcttagtgactgggtccaaggatactgggcttcacctctccgtgcttcactttccacctctgtaaaatggggataagaatgggacccagtcgtagggctgttgaagaacaagtgtgtttctttttgtaaagggtggtgcctggtccttggtcagccctcaataagcattcagtattatcctcactgtccattcagcagccccatattcagcgcctgctgtatcccagggaagcaatggcagctgccctgagggcagagacatggatggggttttcctgctgggctgtggagctaacacttcgttagtggaccgtggagggagtgggggctgcattgaaggattctgagctgagacacagcccccatccagggctggactcaaagtgggtcgtcctagtgtcgatgaaagtgattctgatccgaatgacacagtcaaagctgataaagaaggtggcccttctgtcccctgacgctgaagactctggaggcgtggacaggaggggaccccgagatccaggttgggacctggatgagaatgagtgatttgggagtgtggggttggttctcgctcctggccgaccttgaaggagcaccctcatatcgcgggctgcagagaaagcggagcagatgcagggacccactacaggaagtggggctcaggccaggccatccgtcttgacagtagccgttcttggtgtagtggtgagctccccatcgctgcagtaagcaagcaggtctcaccaggagaggtgccgctgaacctggtgacctccacctcctgcccctcccctgtgcctttcagtcccagggaggagggcatatcccagtgaatcctaacgcagtatcagccacctctggctgctggcccagccctgtctggagtacaggaagacatgtcacccttggccagagaaggaaggagtggggaagcagagggtcagtgggtgtcccctcccgccttgcactaggtctggcccgagtgtggccgcaggcgacgtcagcaggaagcaggatccggcggccgggcgggcggggcatgtcccggagttatgtaacacttggcatcagtgtcttctacgaggtttccctccccctccttatggccgaaggttacccttttctcccatctgtgaattcaggcccctggggctcggcttccacgttcctcagtctctgtccgcctcagccttggcccagccccgccttgttttctgctgttaatctcttctacctgaggctgcacaggcctgcagagagatggtccagccacgaaatgtttgaagctggcctgcattcaaatctgagctcctcaactcatgagctgtgtggtcttgggcaagtgtctttgcctctctgagccattgtcactgtctatcaggttcattcatctaaagacatagttacagagcgtctgttctgtgctagacactgttccaggtatggtgggaatacagcagagaacaaagatcccagcccttgaggagctggtgcgagagacaggttcacacactcaatttcagaatggagtctgaagatgctatgagaagaatgtagtagaaagtgattgatggtgggggtgggagggatgagctaatgatggagtgatcagggaagacctctctgatgtctgagctaaggcccgaaggaggtgaggaagtgagttatgcagatatctaggggaagggtgtccaggcaggggaacagccagtgtagaggccctgtggctggggcagcgagcagggagggcagtgtgtttgtagcacagtctctgaggaggggagaggggagagcagcttggagaggcaggcagggtccagggctggatcacacagggccatatggatagggggaggacttggggattgtatccaggtgttggagagtttgaagcagggggtggcatgcgctgatttgcagagcagctgtgcaggtccagtaaattaataccagaaaccgcttggcgcatagtaggtgcttaataaacgtcaggcataatgattaatgccatcactagcatctcctattctacacacacctcctgatcccacagtgctggaccatgtgtgtaaggattaactgtaactcctgggactctctctgagacccagctttgtggggattcagggtgttggcaccatccccgtccactgcctcagagaccccacgccgccccccgcagagacaccttgcactccaggatgctgggcgccaccaccaggccgacaggagacccctgttccctgcgagactctgagcatctcccatgtcccagccaccgcccgggcagctcagggcacccagccctgagtctttcctgagcctctgtctgccaaaaatagattcgggaagcagggggagccctcggccgcagccgcagaacccacatgccaccactttctcaggccgccacaggctcgaactctcctgggagaggctcaggattcggggcagggctgggactgggcccaggacgtgtgcggggttgcagagctgggcatccctgtgggccctgtgggcactggcaggggcagggctgtggccctctggccgactgttggtgtcggaaactgtgactaacggacgagcagtcgtttcccttttcctccctgcgttccaaggggctgtgctcagaggaaccctgtttgctcaggaagaaggcaggacaggaagtgatcccactccctgcctgtggctggggcttggagcccgagaccccctctcctcccctccatgaggcccagctccagcctggccacggtgaagggctggggtgggcggggcccacctggcatttgcccgagagcaggctgtgtggtctggacgtcagcagctttttcttggaatccgggtgcaccagcgcagagggatgtgtgattccccctggctgccgcaaggaagtaccacagaccggtggcttcaaacaacagagatgtattctcttccaattctggaggctagacgtctggaaccaaagcgtccacagggctgtgctcacattcaaggctgcaggggagcctcttccgtcttccagcgactgctggcagttcgtgacattctttggcttgtagctgcatctctccacatgtgcctccactgccacagggccttcgtgtccctgaatccgtgtttcccttttcttccaaggctgtcagtcctgttggatttagggcccaccccactccagtgtggcatcatcttaactaatgacatatgcaggatcccgtttctaaataaggtctgaggttccgggttgatgtgaactttgagggacaccattcaacccagtacagggctcttggctgagagctgcgggcacctccaggtgtggcggagggcccacctctttctcagcaaccccagagggatcaggctgccgcccccccgtcacaccaggctgtggtgggcaccccccagtgtctttccagtccccctgggagtccccagtcacttcgagatgctgcctccacgatgcccctgctctctgctgtctatgcgttcaagcccacgaaggctggcctttcacagttgctcagcaagtcagtcaacaaacgctttctgagcctctgcctggctcagcgtggggacaaagagacacccaccccagtgagctaccaagacgagtggtttgatgatggtgcctaagctgggggaagaagagtgggctctgtgtgtgaggagctggggttcccaggagcagggtgcggtgcggggaaagtggaggcccgacgatgagggcttctttccattcctggacacacccggcatgttccccacactggggcctttgcacctgtgactccccgcacctgccactctcgtccagagcctggcctggcccattccctccgccgtcaaatcttggctcaaatgtcacttccttgcagaagctcttccagactgttctgtccagaggagcccctgccttgtgctccttgtcccatcctgtttcacccacgcgaccctctgatcctctgagtgctgcttctgtgtgaggagcacgttgccagtctccccagcggcagggcagcctccaagggcaggaccttgtctaccccgtgccttgtgtccccacagccctggtatgcagagctgggcacacagtaggtgttctgtaaaggttcagggaatgaaacgcgagcttcccaggctggcctgttcccccagggacaggtgagacttgcatagcaaggaaaagcttcctgtgttcattcactccacgtgtgccgatgaagctgacagggtgtccccaggaggcgtggtcactcgctctgactaggagactcctgggcaatgtcaggcaggttctctcgtgctcaggaaggatgtcagggtggctgaggggccagcctgtacccagagtgtatctggggctcaatggaagaataaagcccccggtaaaaataaaccctggcacgcttggctgccgaggtggggtgtgagggggacggtcaccctcattgctacatggccgggatcactgccctttgcacctgcggcgaggccccaggcatggggagtccccgagctgacagcccaggccccagtcctgatctgctgcttccctgtgccccaggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaaggtgagggctggcgcggcttggaggtggctggcagctgtgggtccgagctctgagggagggcatagcgggaactgatcccggcagcctcctctcccctgagtcatctgggtcctccttagaaggggcctcgactccctggaaggtgcgggcctgacttgccagaaactcaccagtaatgggcacaaggatgaaggccataacaatactgagaataatcagcttctctgggagccccaagcctcgctcagctcttctgatgcccatgagtccagtcttatgcttgggtgaccagacgtccaggccagccctgtgggtgcctgctgtctttcaccccatccgatgtcacagtttagaaaaaaatttactttggaaaagtttttttttgtttttttttttttcagacggagtcttgctctgtcgcccaggctggagtgcagtgacgtgatcacggcccagtgtaacctctgcctctcgggttcaagcaattctcctgcctcagcctcctgagtagctgggattagaggtgcccgccgccacacccggctaatttttgtatttttagcagagatggggtttcgccatgttggtcaggctggtctcaaactcctgacctcaggtgatctgcccaccttggcctcccaaagtgctggaattacaggtgtgagtcaccgcgtcaggcccgaaaattgttttttgaccagaactcttttacaaggtaaccagcataaatagaacctatctgtcagtcggtaaatattgtacaagttatatagttattttcagtgtctccttttattcccaagtgtccctatttgagtgataaataattcagtccccttctttggtgtccccgttttctctatggggaaaccgaggctcaggcacttaaaggcctgggcccaggcgccccaggtaccacggagtgtgttgtttgcaccagctgtagactagacaaatgccccaccaggtgagtgctgctgaagagagggcgtaaagccatcgtgtgcatggtgctggtgggtccccccgagtcccctcaaatgcaggactgtgaccacatgagctgtgtgttgtccagggctccggataacacacggctcaactttgttatcagtgtgtatagacccgggaactgaacacgggctgccgacacctggccccgcactctcggtcacgagtgcatccaccttcgacccccaccctgtgcctctttttccctgtcaaaggggaagctgggggtctagactgctccccctgtggcgtgaccgaaggcccctggaggacctcagcccttctctgctgagtgtccctgactctcctttctgactctctgaaggagaaacaagcagcccggcggagcccaagtccttggtgaattcaaccctccttcctcctgccccgtctggggtccttcttgttgttcctgttgtccctccctctctgcctttgaacgccctggcttctccctggcagaaggtgcaagtcacctcctggttccataagcccagcctgcagataaatccaggctcctccagcccgcagggtttcaccagcccgaatccccgcttcccgctggaaatgggcaactgggcccttgggtgactcatctcaagttgggggcgggtcagggacactgagtctggcctccccaccagctttgggtctctctgacccaagttgaccagaagcctggctagtgtctgatggaaggaaggcctgggccacgagtcccttgggtcgtcccattttgggtcctgggtctgtagccaggagaagaccccgggagcagaaacccagtcccctctgtaaatatccctccagtgtctgaatgggcgggatgcaggcttggtgggagcatttcaggaagccaagccatggccacacattaaaaccggagcagacgccgcccaggactgtgtggcaacgacccccgcatcgcttgcagagcttacatagccccgtagggacggggaggggcatgctctgctgggtgggggaggagggagggctgaggtggctggagctgaggcttctgtgacagtggtggtcttccgtggctgctctgagagatcagggacggcaggtgagaggccctgattaagcctcctggtgcccagggtgttagcccatcttaaggacgaggagcccaggggagaggagaacccctcccatggggtgtcccagcacatagccggtaggctcggggtctgccggcccagccagcgcacgctgcgtgacctgtctcttgtgctcaggatggggaggtgaggcaggtgctgggttggagcctgaggttgccctgcctgaatctccccggagacccagccagccccagcggcactgcaggcccctccccgggggcagtggaaagcgtcttgttgcatctgggctggaaatacaccagcgcggggctgggagtgataccctggcccagtggtttctccagtaataataatagtatcctcatagtgaatgaagccatgctgttctccgcatttgacagatggggagactgaggcatagcggggttatccaaggcgcatttggtgaccggggttcaaacccaggcagcccggtactggggacctccaggcagaaaggaaaggaggccatctggtggtgtgtttctattttttatttttggtggttttttggtcactcttgttaagcacctactgtgtgtcagatgctgcacaaagcacttcacctggattctagggcagcggtggcagagtgttccctgggatttgttagaagtgctgattcttgggccccagtccacacgtactgaatcagaaacctcggggcatagtgcagccacctgcactgtcacaagcccttggagtgcttctcatgcaggctcctgccccagacccccttgataactgtgagaccgagaagttaactgcccattttgtagatgaacaaactgagacccagaagtttcatccctggtcctggggccctcagcgttggcctcccaacgtcctgtactctgactgtggaaggaagggaatgacattgctgaagtcaccaggcagaggaaggccaggggttaaggacacaggaagctgggctcagtgctctcccctccacagcgtggccttgggcaagctgattaacctgtctgcctccatttcctcatctgcacatgagagttggtggtcccagtcttagaggtcttaaaggagtcgtgtgtgaagaactcggcacggagcctggcctgtatgcagccagcgttgctgctgttgctattgtttctaaaaagggtggcctctgctctggggcctgaagggaggtgagaagcaggagagactggagggttggtgggggggcaatgaaggctgaagaggccccagcagccccaaaagcctctccctgcaaccttgcccatccctgaggtcaacacctcccactccaggcatcctgggagcctggttccaccaggaggctgatgacttagggcaaggacacccagagtggctgaagctcacttttcaccctgaacaaccccattattggctggccttgaacaggccattggaccagcctgctcagggctattgcaggtcacctgtggccgctggccagagcccagagggagagggctcatcggtccatggagaagggcagtcggggcaggagagtgagcagcagcgaggcctcactgctgtgcactgggcttcaggcccctcttggccacgttgcctcctccctcccctcccactacttggtgccgcctcacttctaactcttctctgacttccttccagccttacatgcctctgggaatgaggtgcccagaggggaatgcagtggcccaggtacgaatgtggccggctggcctggggggtagggccgggccggggcgggcatcccaaggtccccggtcctccacaaggaaccccgcttctgagcacatgcctctttctgtgagcgccaccgtttgtgctccgcggcctctgggcttccttcccagcacagtggctgttccccatgctggtcccgggctcactccagcagaccagtttcccgtctccactgctttgctgattttcactggtacgcttgggtctccgaccgggtttgatttccctgatagcaaatgcaggggttttcaagtatccccattttacagaaaatgggagacattgagactcaaagaagagccgggtgtgggtttgggggctagagagccaggaatgcggctgggctctccttgccatccttgggtgcgtgctttcatcctgccactccgccagcacagatcgcgctcctgctgtgtaaaacccatgctgaggccgttggtgtgggctgtgcccggggcccctgcacacgcactggcctcgttgctcatcgtgcccggggcccctctgcacgcactggcctcatgattgtccaccgtgcccagggcccctgcacacgcactggcctcatgattgtccaccgtgcccagggcccctgcacacgcactggcctcatgattgtccactgtgcccggggccctctgcgcacgcactggcctcatgattgtccactgtggcccggggcccctgcgcacgcactggcctcatgattgtccactgtgcccggggcccctgcgcacgcactggcctcactgcccactgtgcccggggcccctgcgcacgcactggcctcactgcccactgtgcccggggcccctgcgcacgcactggcctcactgtccactgtgcccggggcccctgcgcacgcactggcctcactgtccactgtgcccggggcccctgcgcacgcactggcctcactgcccactgtgcccggggcccctgcgcacgcactggcctcattgtccactgtgcccggggcccctgcacacgcactggcctcatgattgtccactgtgcccggggcccctgcacacgcactggcctcatgattgtccactgtgcccgggcccctgcacacgcactggcctcatgattgtccactgtgcccgggtcccctgcacacgcactggcctcattgtccactgtgcccgggtcccctgtactcacactgagcgcattctacactgtcatgtgacgatgatggtggcgatggtggtgcagcagcaggcagtcaccaggcagttgcccttgccctcacaattgccagcttctccgccctgtgagatgggaactattgttctcccgttctgcagatgggaaaactgaggcccaagaggtaacctgagtttcccgtggcacgcagccagtgcggggcagagccggggttagagctcagatgagaacatggagacccccaggacgaaggcctttgcccacggccaccctcaggctggctccatctgtcgggggtgctgaccaccaggaggtcctggggttgggaattaaccaggttatgccagcagggtcagtctgggagaaaggcggccaggcgagggcagcagctgtgggtaggggcctggtcaggggctttgtctcaggggtggggctctaggcagcagcccaggtgtgtaggagcctcggggctgttttggcatcaggcgacagagcggcctcatcccgagggtcagggccatgcatctcttctggaggccccgccagaccctgctcatcccctcttccttctcgccctgcacagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggtgagtgggcgccaggcagccctaaccttggcttttgtctgcagacactgagcagcgactacctacttagacagccgcacccagtctggctctgcctgctttgggggagcccgaggtgtggttagggaggcagacttggagtagagtccaggaatgagagatgcaggccaggaaggggcggaggtgtggccgggaggacctccccaggaggtgacatccaagctgagacccggacagaggaggcagccctgggcagcgctagggagagagtgtgccaggcagcctgctcgcttcctagggccgccctcacaaggtagttcgagccaggtggcttttaacaaatacagtcctggaggccaggagcctgggggcaccatgcaggccgagacgcagcctccgagcctctgggcagatccatcccgcctcttccagctcctggccgctgctggcggtcgtgattgctggcatgccactccgtctttggctctgctgtcacatgaccttcgccctgtgcatctctgtgtccacactttcttcttctgaggacaccaggcattggatgggcagctgtcctaatctagtgcagcttcatcttaacttgattatatcagcaaacagcctatttccaaataaggtcacattcacagagaccctgggttaggacttgaacgtaccttctctggggggacacagttctaccctcagcgtggtgggaacagcaagtgcgaaggcccgaggtgggaatgagcttggtggattcaggtgccaaagggtggctcagggagggggcagcctggcaggacggggggcagctctcacgggggtgggggcactgagtcacgccctggcaggtgggggctgcattttgttctcagggcagtgagaaggcctttacgagcctctcccaagagagccagatgtgatttacccatgaaaccatgtgggggatttgctgggagtgagaggcacagtcaggaggcagctgcaagtgccctggggctggtgatggagatgcgagcgtggtggccgtggggttggggaaaagccacaggttcaacatgtttttggtggctcatctcccatcagccaagggtccagggctcaggatcacaggtgatcaccttggatcacaggtgcagaggttccccttgcaaattcctctccagctggggtggcctggaggaccccagtgccgtcctgtttgggtgttgatgtctctgaggtgtgttctttcctttctggcctctgtctttgctcctggcctgggtgaccccacatccctgagaatgccgccttttacccattttcagcacagatgctttgggcctcaaggcctccagcccagaaccaaagatggctacccaagttagggccaatctcggttggcagagggcagacccgcggagactgcgtcctgctcacatctggatggctggaggaattgttttctggtggggcaggcaggccattttatttcaactacagtgtggtctgttttctcccctcccaagtcccttggaatggtcctgggcagagcaagcgagggaggaaaatcagacccgcagggtcatgcggggcccttgtctctgccctggggttcaccctgggccatgttaaagggggaagtcctaggacattccctaggaactgaggttcacccggatctctataggttccacaaaacaaaatctcagggtccccaggaaccactgccaacaggaaccgcgcccatgcgtgtgagaagtggacggcctgaccctgaccctgtgatgagcaaaggcctggcctgcgggtttctgagggcaccaaacccctgagcttcttgcccgacagtcccagcttggaaaacagtgttcatggtgtggctgggtctgccctggaggcaggcagccagggccattgtgcctggatagcggggtcagggcagacggctccccgccccgctcctgctggctgtggggacagagtcatagaaacacatgtttctgccttcgccgggggaccgctgaggtcatggggcagccccattgataagctgcctcccagagtctgtattttgggtccatgtggctggccccgggctggggagccgggggatcagcttgcatcctgtccgtccccagaacactcaggctaggcctgaggccccgcagggcacttgcagcctcccgtcctctcccctgcagccccgcccagggccgtgtcctccctccccgagctgggcctggcgtacgtccaccccttgcccagtgtccagcacacagcccccgggtgcaggagtcctcggctgggagtcaggacacctggtttgtcccgccctgtgcgactaggcccaggcccccgcccttggggcctgctttgccctctcagtgaacgaggctggactctggccagcctgctgacctcgtcctggccggcagcccgccacccctccctctgccggccacgactgcgcagggccgggcggacgctggaggacgcggacgagatgcgtcagagtaggccctggcagccagggcctcccgggaagggctggtgggacgggcgggccccccaggcgacccctgctcctggctgcccgcccagtatcatccctcctgcctggcagccccagtgggggagctctgtgttcctggatggacgcaagatgactctcatctggccccccgccccggtgactttgggagagagaaaatcacattctccttcggcccgctggcactttcttcgaggtggctctgcctgggtgttttcttggcagacgaccagagatagtggcttcaattgcaaaaccccgagcctgcctgccttcccctctcttactcttcagagaaggtgcctgggtgcttttttggcagggcctggccttgggagtcccctcccccaagcctcagttttctcatctgtaaggtgggcgtggatggcttattgcaagaataactcagttaatgacgggccacagtgggcgctcagagattagctgccctcctttggatctgctttgggacaccccctagaggtcaccccaagagggggctggagtgcagctccttcagctgtccctctggcattttggaagatcataacagcaatttcacctttgttactttattctgcaagtgactgatggcaccagcatgcgccaggcgccgggggcgctggaaactgcacagacgaggccctgactccaggcacttacattctagtgagggcatggagaaggaaaccattgtttacgggatgagtgggtgatgggcagatggggcatggggagcaggggagagtgggctggtcaggcagggagggcctctggggaggtgacattggagggcaatgagagccttagtgtgagggaaagccagaccccctgggaaccaccagtgcaaaggccctgtggccgcatgagcgtatgtccagtggacagcagagaggcctatagcagggtgtagagtggagtgagcagcccagggcagagagggcggagaggtcagagaggtgggcaggccccacgggtgggagtgacgggtcagggttttatcttggggccttggagaggcaagggatgcctgttcacaaaccagccctccctctccctcctagccctaggatggtggcaaggattgtcccagcttgatgaccatggggaaactgaggcaagggctgggtggagaggggatgtactgttgcaggcccagcatgttccgatgaatgtccccaggcccttgttccccctctcgtgccccgccccccaaccggccttcatgagtgggaaggaaaatgacagtgaggagaaggtggcccgacccactcggccccacgtgctggtcaccagcatccccacgcccacccacggacagcccttgaagctttcgtctccactctccagattgagaaaccgaggcacagttggctaagtcacatggtcagagaggggatccgagcctttgctcgcaactgcagggctgggtaggcagggtggggcccctcccagacacatgctctgtgccaggccctgagagtccccgccccacccaggccgccagaaaggaaaatagaagtggctgccttccaagaaaacaaaggagagaggccggtcgcggtggctcatgcctgtaatcccagcactttgggaagccaaggtgggtggatcatttgaggtcaagagtttgagaccagcctgaccaacatagtgaaagcctgtctccgctaaaataccaaaaaattagccaggtatggtggcgtgtgcctgcaatcccagctactagggagactgaggcaggaggatcacttgagcccaggaagcagagcttgcagtgagccaagattgtgccactgcactccagcctgggcaacagagcaagactctgtctccaaaaaaataaataaataaataaaataaaacaaagaagggagagtggagggtggggagagccagccaggagggcttctggaggtggcgctcctccagcatggctacgggacaaggggcggtcagatgggccctgagctctgagcgttttccaccttcctcctccactattggtggccgctccctctgggggcttaggactctcgttcccctcgagaacttgaacccagcccttgtgctggctgctgccttctttacccatgagagagctctggctgggatcagaagacctcttgtaaactataaagtggtacctccatgaccacagtccccacttgctctgggggctcaagaagggtttgggcctctgtgtgtgccccccagagggtacctgctgagagcttctgggcagcagcccctgcccccgctcaccccctgccaatctgactgcccacaccctactaggtgaggggccacagggaaaccaaggcacagggagcactcaggccccacatagaaaacgcgagctctcgggcagactgcatgggacagtggcacctcatgttttgtgtgtgttataaagtcatatttttatctctatagaattatctttacacatatacaaacgtttgcatttcaaccttaaaatttatattttatttttctatttgtacacacatataaaaatattatttttactgttcatagagaaaatacagctgatacgtcgaaccctttatggctagcatatagtatggtcctcatttcattttgtaacagttattaagatatcattcatataccatacatttcaccattgaaagcgtatcatttaggctaggcacagtggcacacacctgcaatcctagctctttgagtggctaaagcaggaggatagcttgagcccaggagttcaagaccagcttgggcaacatagagaaaccttggctctaccaaaaaaaagaaaaaaatgcaaaaatcagtcaggtacggtgatgtgtgcctttagcttcagcaattccggaggctgaggtgggaggattgcgtgagcccagggggtcaaggctgccgtgagattacagcactgcactccagcctgagtgacatagcaagaccctgtctcaaaaaaaacgtgtatcattcagttcttcttagtatattcagtgttatactaagaaagaaaccctatgcccatcactagtcacccctatcctccctcctcccagccctggcacccactcatctcctttctgtccccgatggattggcccgttctggacttttcacagaaacggaatctacactagaggccttctgcgactagcttgtttcacgcgcatcgtgtcttcagggtccacccacgtcatagcccgtgtcagagcctcatgccttttgatggccacgtgttccatcgtgcggacagggcacgctttgtctcctcattcgtctcttggtggatgtcgggttgtctctgccttctggctgttgtgcgctgggcggtgctgcagtggtgggcacgtgcaggtttctgcatagacatttgctctcatttgcctggtgtgtgcctaggagtggcagtgctgggtttagggcaatgagggctcaccgactgctttccaaagtggctgcagcattctcttttaaatttcagcttgcaagtgcgagctggttgaaacggatggtggtaggtaaacctgtggggagggacataggggtggcggcagttgaagccgcaggtggagaatgttgggacaggtgataccatctgtgtttggacctgggtcagggtaccttgtctgtaccttgaggatggcggggagagcacagctgggcccaggtccagggagtgaggcatggcagtggccaaaggagaggctttaggtggtcctgggagatcaagcagggtctggacaggtggagggaggggagggaggagagtgggctggcggtgggggcggtggaggtgcatgcagaagtcagggtgaccttcctcgtctggcccccgtctgtgcgccatgggcagcctaagcaggcatcaccgagtctgtgtctgctctccccgctcagctgagcgtgtggcagatgcagacagcaggctggtacctgcagaacaggccggtcacatgccggtggccccatggtcctgctatggcagagattgaaggaggggactgccggcaggggcctcagcaccctgggcatcggccctgctcatctgcaggaaggagatgggtgcctctgggcgccaggcatccagcactggcagctggggactggggtggtgtgagttgtgtccctgttgtcacagctctcacctcgaggccagtaggctgtgacttatagtctgcataggacgtcgtcactgtggtcacagcacagagtaggggctgtgccgacaggacctgccagcttctggcacccagaagttttgccctctggctgaattccaggcccgtggctgctgccctcacgcctgccatgtggtcatttcactagcttggaagacctaggacagagactgggttctgcgtcgcctccaaatacacccaaatgcaggccgggctgcttccatacccccaaacgtaggccgggccatctccatacctgcaaacgcaggccaggccacctccatacccccaaacataggctgggccacctccatacccgcagacgcaggccgggccacctccatacccgcaaacacggtccaggctgcctccaaatacccccaaactcaggccgggctgcctccatacccccaaatgcaggccgggctgcctccatacatccaaatgcaggctaggctgctttgtgcctagcaaatgcaggttgcaggagggagtcaagaactgggcagccccgggcagccacactgggcaggtgaagggttctcaggctggagcagatccagttcctgcccttggagacctcatgccaagtggggagccagatggggattatggcaggtgctatacccggtgctggggacttagaaatcctggaaggcttcctgaaggaaacggcacccaccgaacagcttgggagccacaccccaatgcacgctctgccaggcaccgtgtaccctgtgtcggcctctggtcgcgcatctcagtagcagacagaggaagggactgcgactgtggctaatgagtagacagtgggcaggccctacctgcccctccacacaaagtctgtggcctgggcccttgttatcatgtcctcgtccttcgtggatagtgtgtgggagagagtctaggaagtgggtgcagctcccccactcctgcctctggtaaccggagctcattcggctccatgcccactgtcttgccctggcacccgagcctctcagattcgagtgatgaggaatctcttggtgaatctcttcatttctctgtccctgaatcgggctgattctttggctttctggcagcttcggaagggccacgtgtggtgtgggccccaggtctgggcttctctgggattttccttgcctggagatgtctttggggatgtttgatcccagcctgggcctctagcactgcccggctggcctctaggctggggtgggaggctggcttggcccctgatggggcctgcaagaaccaggggagtgagtgaggaggcacctgcccgcccactcgtgcctcccctcccctggccccaaatcttggtctgttttcccaagagaaaccgttgacattatctgggtgagctgcacagtcgcctcgtgtctcagggccttagcctcgtccccagggcttgagacaggagaggccatcaaaaccgggcagcccccccaccctgggagagtccggctgtgggcccccagctgatggtgctcgtgtgcccgcaggctgctgtccccaaggcccagcctcctcaccccgactggcgacccccgggccaatgcctcaccccagaagccactggacctgaagcagctgaagcagcgagcggctgccatcccccccatcgtgagtgcccacccccagagccccacagagtccaccctgaccttgactttcccattcattgagacagagaatcccacgggcgggagcgtgcacctgcagcctagctcatccgcttctgtttcctggagaaatccccgtggagctgaggtgggaacagctggggaagctggcaggcgtaccgggtggggctcccagtgaaggcgggaactggcggcctaaggcctccccccttccaccccgcagcacccttgaacccccagattagatactgggtcatggggaggcaggagcttcccccacccactcagctatagcaacagcttggccagggaagggtggcctaccagttctgatcctggggccctctgggaacaccctcctggaaggttctctcagctgggtgcgtgggcccttggaggtgccttctccagggaggtgagtctggccttcccagttgcaactgggggctccgggctaaaagaccctgagctgaccaggctggtggtcccttgggactttgagtgatgggctcagggcgtgtcaggctacacggcccagtccccgaggcccacagaatcctgttgctcagtcctggcttccctgagacccagaggatttgggtccacagaaggagctggaggagagagtcacagcaggctctagcctcctgtccaccaccaggctgctaggccaggctttttgggaggtgggctccccctgtccatcaccaggcagctgggctaggctttctggggaggtgggttccccctgttcactaccaggcagctggaccaggctttttaggaggtgaactccccctgtccatcaccaggcagctgggccaggttctgggaggtgggtccccctgttcaccaccaggcagctgggccagactttttaggaggtgagctccccctgtgcaccaccaggcagctgggccaggctttttgggaggtgggctccccctgtccatcaccaggcagctgggccaggttctgggaggtgggtccccctgttcaccaccaggcagctgggccaggctttttgggaggtgggctccccctgtgcaccaccaggcagctgggccaggctttttgggaggtgggctccccctgtccatcaccaggcagctgggccaggttctgggaggtgggtccccctgttcaccaccaggcagctgggccaggctttttgggaggtgggctccccctgtccatcaccaggcagctgggctaggctgtctggggaggtgggttccccctgttcaccaccgggcagctgggccaggctttctggggaggtgagctccccctgttcaccaccgggcagctgggccaggctttctgggaggtgggcttccccatgtgctctgtgctaagacctccctttcttgccgcacctgggaccttgagcatgtcgctggctttcccgggccttggtttccaggctggtcgcgtgcatgtctctccctgaccctgtcactttcagacaccctctgtgaatgctcacttctgcctgcttccctcagcaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggagggtgagtgcacaccagtggctgagtggggctggggcagcaggggactgacgggcaagggatgtttgtgtgtctagagcagctgctgcaaaccccatggccacagtggcagggaaagcaaagtaaacgaatggaacagttgagcagggggaggcagttgggaatggtagggactgcggcaaattggagaactcttgttttctctaaagtgggcacgtattggccttggccaagagtcaccccgtggcaaatcaggcctggggtggttcttccagcaaagccagaaatccatcttcttatgtgaaatccccctggtccctggtttctcaacactggcaacttctcaaaattttcaaaagcattgtgaacacgcaaaaacatgtctacagcccagcctctgattcggtgtgaatcagtccacgcaggagcttctggaatcacagatggggcccagcacccggctggcagcagctctggggcctgggcaggaagggctgccctccccagctggcatcctgaccttgctccaggcccaggtctctgggttcaccaggagccagggttgggggtgactcccgagccgctgtgtcacagggactgccccgggcacacctcactgtcatcacgtgaagctcaaggtcaggagacaggcgggcgtgattgcttgttctctggatcttcaatctctgccccacttcccactaggcccaagaaattctgaacctgtgtccccaaagaggcatcttctccaggtcagcctggcacgcagcaggtgctgttgtgccttgcaggtgttgggggctgcttccccagaggttccccaccctgggctagccccggcgcttgctggcaggctgctccaaaggtctgagggcagcaggacaccaggccgacctcctgaccagcacagcccagggacaaatccgggtgactggagctaccatcagctgtcccctccccgctgccttgggtgtgacatgccccttctctttttttttttttttttttgtttgagacggagtgtcactctcgccaggttggagtgcagtggcacaatctccgctcactgcaacctctgcctccgggttccaccgaggctgctgggtcaggacatttgttgaaaacccaaggccccaggcaccatgctggcagagcggggattaggtagggagaagaggaagtctctgctctggggagctgctgttgttttgagtgaggaggatgttaaaccagggaacacataacgaagcaagatggttttagagtcgttcatccaccatgagaaacaaaacgggttgagtgaagaggcggctccgggaaggaccctgtggagtgggaagcagccccgcagtgggagctctctgggtgggcattgcgggcagagggaacagcacaggcaaaggccctggtgtggaaacacgctcggggtgtgtgaggagtcgccgggggtggttgtggccagggaagggtgggcgggtggacagtgagggaagtggggaccggattgtgtggggcctctcaggccacagcgggcagtggattttgtctcaggtgtggcaggggctgctggagggatttgaagtgagcgtgtgttgcggaaggggaaggaggtgcttgttatctgatttgtatcttggaaagctctgtctggccgttgttgagtcaagggcagcagcgggaggtcacagcgcagctcttggcaggcgacagaggctgcctgaaccgcacaggtggccgtggaggtggaaggaagggcgcatcgggagtttgttttggaggcaaagccagtggggcgttgaacccggtgtggggatgacgccagggatgtctcgctggaactgggatgccccatgaccagggctgggctacctggggccagggtacagtgtgcggcccagggtgtggctctgggagacgttgcaggtttggggcgccagcccgggaaggagctgtgtatccatgtcaggggccccagcagctttggccagcgtcagatctgatcagggctggaactgcacggtgccagccaggtcctgctgagccaggtcgcaggcccctgtcctgggagaaagggagccaccggccagcagttcccgcggctggcactcagcccgttggtgtggccagggcctgtgccgtttcctggcctcattccccgtggggacggtgcacctggcgttaggccctgcatgcctttcttgcacagcctggcttgcagctcagctcccgcagggacacacatgaacttgacacccagcgctacctctctggtctctcaggaagccagcctattctgcccctggctcccacacagagcggctcagccaagcaggtccctcggggccccctgggcccaactggaggaacaggttgtctctccaggctctcggccgcccgcccagcctggcctagccccagtttgccttccagcatcgaacagctcccctcctctctctcccaactctctggaactgggctggaggaagcaccagaggcttacagggctgggtagccagaggggccaggtccagggcgtttgcaggatctccagatgtgaggcaggccctgtacaggtgcctccactggggactggttaagaatgagaattcccctgcatctgtgccccctgcctcctgtgggctgcccacctcgccagggcacaagtccaggggaaacagtcttcaaggagagaattgggggcaatttggtacataggcctccttgcccacctgctctgctcacagcaggcatcattaattgatcttagcactctcctccgctgccacaccctgatgggccctcagaacctcctttgttcatctggaggcggcgtgatagatgacacctgcctgccattcctgtcccagaacccagagggctccgtcattcccaagttgtgtctctgctcaacttcttggccggttatctctccataggattggtcctcagggagaggttcagagctgaggacagatttcagcaaagggcgagaggccagcaggaagatgccatgaagccaggcctgagccccggggccccgctgagtttacaggatctccccaggcctgaaatctaggacccatcattgcttctctgccgcaggccatgtggcatagcagtctggattaaggccatggtctgcagccccagtgcctgggttcgaagccgctatctgccacttgctagctggggcctttgaccaggtggcttaacctctcggcttccattttcccgtctgtgaaatggggacagtcagtcagttccttgtagggtgctgtgagaataaatgagtgaacacgcttacattgctgtcagccgtggagccctgagagagcatgacctctcggtaatgccctttgcacactccgcctggtaagtaaccctgcctgagcttggcttctcagccagccagcgcacaaccgctgcttgcactggctcagtgggcttctgatcctgactcggctaagtatttgctggtgaactcagatgagcccattggtgtgtctgtacctcagtttcccctctgtaaaatgtgtctggcagcagtctctgtgtgagcttaaccggaggctcatggaggccgtgggatgctgagcacagtgcctgtgctgagtaccactcagcaaactgaggctgacgctgtggttgttacctggagggtctgggcttataaccccccactgcccgccacaacacacacacacaggcgcacacacatccatgcactcgcgcacacatgcacgtgcacgtgcacacacatcacaggttacctccttcaacattgtgtacatgcacacacacatccatgcactcacacacacgcacatacacgtgcacgtgcacatacacacatcacaggttacgtccttcaacattgtgtacaggcacatacacacatccatgcactcacacacacatgcacatgcacgcgcacacacatcacaggttatctccttcaacattgtgtacaggcacacacacacatccatgcacacacacacatccatgcactcacacgcacgcacgtgcgcgcgtgcacacacacacatcacaggttacctccttcaacattgtgtacaggcacacacacatccatgcactcacacacacatgcacgcacgtgtgcacacacacacaccacaggttacctccttcaacattgtgtacaggtgcacacacacatccatgcactcacacacacatgcacgcacgtgcgcgcgcacacacacacatatcacaggttacctccttcaacattgtgtacaggcgcacacacacatccatgcactcacacacacacatgcacatacacgtgcacgcgcgtgcgcgcacacacacacacacatcacaggttacctccttcaacattgtgtagagcacaggccagcaagcttttcctgcaaagagccggagagtgaacattttaggctttgtgggccagacaatctctgttgcaaggattcagctctgccatagacaatacataaatgcacagatgtggccacgctccagtaaaagcgtattcacaaagtcagacggcggggccaggcgtgggggctcacgcctgtaattccagcactctggaggccaaggtgggaggatctcttgagcccagtagttcaagaccagcctgggcacacataacaagacctcatctctacaaaaacaaaatataaactagccaagcatggtgtggtgacacgtgcttgtagtcccagctacttgggagcctgaagtgggaagatcccttgaacccaagagttcaagacaagcctggggcaacatagcaagaccccatctctacaaaagtaaaacaaattagccaggcatggtgcggtggtgggcgcctgtattcccagctacttgagaggctgaggtgggagaatcacttgagcccagaggtgaaggctgctgtaagccgtgacagcaccactgcaccccagcctgagtgacagaaggagaccctgtctcaaaaaaattagggggcagacagaccctctgagataccgtttgccacctcctggcttagaggcctgtccagggaccttggcttgctgggcttggttgagtgcttgtggggttgcaaagccagagggtcccgttctcgtcctcagcggcagctgagagcccccagctcagaccttgagatcccctcccctgctgagcagaataccatggggttacagagcagcgcccaggcaggcagacttggggggcttcccggaggagcccaggccgtcacaggccaccactactgtgggtgcaggaaggccatttgtgtagggtcagccagggctcccgaggtctgactgccccacctcctgccctcagcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtaagtagctccgcccgagcttgggcttcttcagccagtgcacaatcgctgtttgcactgtttgcactggctcagagctgcacacagaagcatcttaaagccttatgggacctggctggaggaacagcctggtcagtggagggaaagggggagatcttttaagaaagctgccccagggttgagatggaagccactggcaagagggagccacagcaggtgcttgagctggtgaggggcaggcttagagtgggagctatgttttccgttgacggcttagagctagagaatgggcagatggtagaagagcctggggagggagcagaggcgctaccttggttcacagactctgtgaggctgcatttcggccctgttctaggtcctgcagtcctgctgggcctcaccagctgtaaagcagcacagccgggggctggtacagactgctgttggtaaaggctggtcccgagggatgcgtgggccaagggagccagaagaacagggaaagtcatgccaggcagacggaacagcaagtgcaaaagcccagaggcaggagagagcaggcaaagcttgagaaactgaatctggccaccactgccgaagctcggtgcccagtgagctggggagacccaggggccaggtcaggcgagcctgaaggccaagtcgggggctaagactttctcctgaggacagtgggagccatcgagggcacacagcacagggagggtgtgcaccagtagacttttccaaaaaggtccttttggttcctataaggggaaggggctactgggggctacagtggaaatggggagacaggggatccagatgagagttgagggcgcttggatcagggcctgggcagtgggtgaggtgggaggcttccccaggatagtggtgtctgcacctaggactcgggtcactaatgaggacagagccaggcagggcaatagaggagtgcgcatggatgggcacttcctggccaggacagggaagaggtggagtgcagcctggagtgtgtgtccggcagggacgtgaccgctcctgggccccacaatggacagacatgtgctccacaggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaagtgagtggtagcccttcctttcttgggggcttagtcttcttatctgtaaagtgggggcaatgggaccaatgaagtctgagtgggggccaggctctcgggggcctgggtcacctccactcaggcatctggggtctgagctggctgggtcctgccccaggcactcagggcctcgtccctggggggtcactctgtattgcagtcaagggcatggctcaggaaccaggctgtgtggcctcaggcaagttacttaacctcctgtttcccccactgcgaaatggaagggcaaatgcaaggggctcagagggcatggccccttcacaggggagggggccgaggcttgggagtagcagtgacttgtctgccgtcacacagctggacagcagccccagcctctgacccacacgtgggctttttgaacaggagcgtcaggcactctggactgtgggggagggaccagggtgcccctgtgaccccacaactccgcccctacagggaatgtcggtccagctccacgtcccgtactcagagcatgccaaggccccggtgggccctgtcaccatggggctgcccctgcccatggaccccaaaaagctgggtaaggctcctggcccatccgtctgggtggctcaggctgggctctggctgtcctgtgggtggggcgggggaggaaggggtatcttggcccacggtactccaggtagcagctgggaggtcccccctcagcagccctggctggaacatggtggggaggggcagcgcttcccagcccctggctcaggttgggtggggacaagcctcccgggaccctgctccggcagcacgtgactcgctcctcttactggtcctcagcacccttcagcggagtgaagcaggagcagctgtccccacggggccaggctgggccaccggagagcctgggggtgcccacagcccaggaggcgtccgtgctgagaggtgagggcccttctgccctgggcccccagcatctgcccctgttcctcgggtgcccaaagggccctttattcaaaacctgctgggaagtgtcatctcccagagggtctgggggcccctcttcacagccgtctccctcaccatttaggggtagggggactccctctgcgttgaaacaactagcacaacttgtgggtctctcagtcagggtggctctcaggactggggcctggggaaggaagggccacagacaccccctcagccccacatcttgtgtcttccagggacagctctgggctcagttccgggcggaagcatcaccaaaggcattcccagcacacgggtgccctcggacagcgccatcacataccgcggctccatcacccacgtaggtgtcctggggtgcggcaggaaggacggttgggaccagcacggggccagcccatcttataacccctcattgtcaccaaaccattagcctcagccgatggggtgatgactgggggacagcagttcactccatgaactttcatctagtctgcatggaatcaggcactgggattgccaagcacagctcaaaactctgccttcagggagctgccatgtagtggaaggaaacagaccagggtaaataagtaggctggtgaaaaccgagcaggcaggcagaatgtgagcgtaccgcggctgagaatgcctggccacggacattgcttagacaggtgaggaaggtgacatgtcagctgtggccagaagaaattgagggtgcaagccatgcgggaatctcagggaacagcattctaggctcagggaacagcatgtgcaaagacagagcatgagagggttcctgaatcgtgccaggactggtgccccagccttgcagctggtgagctgtggacccaaggttttgtgccacgtgtgtctggctctagaacacagtgacagagcgtgggtccacacacttgcacacgtgcatgcatgttctaacagtggagcttcgggcaacaagatggtccacagggaggtgtttttcactcaggcagcgtcaaatcccaccacagaggagccatttacactttgcccttctctgaaatctgcaggttttaaaaatctgagctttcaaaggcagctgtgctgagtgggaagggcaagtgctttggacaaaagtcaggctgagggccctcgggtgccagctccaccacctactcagacaggcagcggcctgccctgactccgtttcccctttgctaacagtattcctgggagagtcattctcctgaagtcgtagggacctttgaagttcccaggcatccacctgctctgggttcctgagtggccatgacccgcgcccttcctcgaacctcccagttacacacatctctttgattgcttttggcagacagccagctgccaaaacatgtgagataggcaagggtcaaacttccgtgcagtctcactaccagatagtgaggaagtcagcgtgtggcctgcacgcacagagccgtttattaactgagtaggtgccacaggcagggaccacgtggttcccagctggcaagggaggtcaaggaagtcccagctccctgatcctccagggacttcctgcccatcttgggagtagagttcattggggccaagagcaagaggctacaggctcatctcctggaagcagacgttatgcaaacagaagcttccctgttaatgggagtttgtccagtgtattctcccaagagcaggggccaccggctggatttctgttctctgtccatgtccctgaagatggcacctctaaaatactatagctcaaaaacatcaagctggacacggtggctcttgcctgtcaacccagcattttgggaggccaaggtgggaggatagcttgagcccaggagtttgagaccagcctggacaaaaagaggcctgtctctacagaaaatttaaaaattggctgggcatggtggcacatacctgtagtctcagctacttgggactgggaggcaggaagatcacttgagcccaggagtttgaggctgcagtgaactatgacagtgttctgcactccagcctgggcaatacagcaagaccccttctcaaaaaaaaaaaatcagatgcctcagtttcaccatggagagcccccctttttaaatcatttattgtggtgttcagtaagccactgatttctgcagtacaaacccagttctgacatggaccatctgatgttagggctggatacagaaaggggtgcacttgtgttagctgcctcttggggggcttttcccgccaggatgctgcaggaatcctgtgctttcctgatgggagaggtggctgccccgagctgtcacctgactcagcacctattgtgccacactgttagtgtacaggtgtcttaaagcacagcagggagatgctgctcagagtatttgctttgggaagtttggggggagctcatcagaattcagggcgtcttgctgttgccctccgcaaagaccaggatctgcggtgaactccccggggtaccaggtgctgccctctgccaggggatgtccccagccaagcaagtccagccagagactcagagctcactggtccaggtcttgggatatagtaggacctttaccgttgaatctgctcctggaaccctagaaagagaagagggatattgagatttggggacccgtcgtctgtgccagatgcctttgagaatcatcaatgcagaaggtctccattttgtggatgtgcaaactgaggctcagaaaggaggtcccacggcagcttggtagtaaagttgctgtttgacacccaacattctgcttccaaagtcatattctaactctgatgcttgtgttcttgaaagtcacccaaggcaggatgctgccccacgtggccatctcctctctgcttgaacacatcctccaacgggaagctcattccctatatggcagtggttctcaattgggggaaattttgcctccaactctctagggacattttcgattgtcctaacttggtgggggacacactggggaggcgtgtactcctggcttctagtgctttgaagccagggatgctgttaacagcccacagtgcacaggacagccccacagcaaagaagggtccagctccagctgtcaggagggccgaggtggaaaacctgggttagaactaaaatttccggtgtgctgccctgacgtgagtccttgtcctggttttaggaaaccaaagtgcatgacgtggtcacgggtacagcacaggagcagaaaccccagcgtccccgccagttaccgttttcggtaactgaatgtcaaggctctgagtagaccccacgcagtggtggggacacagactccaggaccagaatgcctgggttcaagtccccgcctgccccttattagccaggtgaccccgggtaaagtcactgtgcctccctgtgcctcggtttccccatctgaaacaggcataatcaatagggttgtcttagggttgtttcgaggattaaatgagcaaatccatagagagcacccagaacagcgtccactcatgggaagcacttgacaagggatcttcattcttcaggttcctcatagggttttgttccatgcaaactcttacctatttgagacagtgtgtgtgtggacacgcgtgtgcatcggtgggcacatgggcttttaagcacgtctttgcctgcatttgagttgagaggggtcctgggctgcagcctcctgggcgctcacccctctgcacctgcagggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtgagtcgcaggaggagaggaggcccaggaccaggggaggagtgtgcttggcccactgaggtagcttcacagggaggcagggctggattgacatcagaaagcacaatctgataggtggtgacctccttatccctgcaggtatgcaagccagcagcagggaagcgttggccttagctgcctcccacctctgcccagttctttacagtttaggaaacaaactcatggccaacctttttagaagcataggagggaaactgaggcccggaacagaagcccgagctcacgccgccaggcctccagcaccgtactgacaaaccacgcactctctcattggccacgaaagaggccatggccagagtgcccctcgccccactgtgtcccaggctcttgctgcggagcccccatcctctccctctctaggctctgggttccagaacgaggagaccctgccaggaaggagttaagggaatcgagtgccgggaaagagaatttcctggcagcctagggcacccaggggtgtggagatgaaagctgctaatgggcgcctctctcagcactgcagctgcgaggcccggaattgcctctcctccatccacttccgcctgtgcccgcagccccctccccaggcctgggaggtggaggtggcaccgtgtggcttaggaacataatgcactccctgctgccacagagatagccttggagacaggcctgcagctgtgtcttgggtgccagctcatgccctggtgcccctggaccgagtgccctgggggtggcgggaagcctgggaagggctggtggtggggttagtcaagagcttgtcttgagaggtcactgggtagagtcccaccttgggaccccagaccagtgcctgagcctttataggccttcagcgtatcgtcttcatcatgggtttcagtcggggcctttaaactctcgtctgctccctgggccaggtaggcagtgcaggcagcggcaggtgtgagactgtagggagtggggaggactgtagggaatggggaggactgtggtgcctgctcacgccgtccactcccctgcggccaccggtcagccaggtttctcatctccgtttctatctgaaatctcccgatgtttaaacatcggcgattaatttggaacgttttctgaacagcaacctagtaccctcctgttggcaacccctggagtagctcacgggccgtgggccacacgaagcaatggttgaaaagcccgagagcctgtcagttgctcattccctctgaggggtggggcgggggctcccggggctcatttctgatagctctggactcggctgccctggaaggagagccctggctagatgggcaaagcccagcctttaccttcgggggccacctccgtctgttcacctctctgcctgtccggggagcagtgagccgggcccatgtaggctcctttggcctggcgaggccacccctgccacccctcaccactgcctgcaacacacacctctccgtgcacacgcagacttgtggtcggacactcacatgcacatcggcacaggtttctgggtgtgacacgtgtatacatacaaagccgtgtactgcctgcaccctggtacatgtgtgtacatggacccacttagttctcagcagccaggctcacgtgcatgtgcccacatccactcctgcacacacaagacccgtgccagtgcacatgcgtgctcctgcctgccacacgtccacacactgctgatgtatcggtgcacacgcgtgctcctgcctgcccgcacctccactctgctgtatcggtgcacgcgtgctgctgcctgccacacatccacactctgctgctgatgtatcggtgcacgtgtgctcctgcctgccacacatccacacactgctgatgcgtctttgctcacgtgcatgtgtgtgcacttgttcacgccccatgtcggcacccgtgggtgtggacacagactcacgtgctcatgtggtcacaggcacacccttgcttgcagacagagcaccctggagggctagggtacagggtgcaggcagcgtgccctgcatctcccaccgtgcaaccccctggaaaagctcctgggtcctgctggcaggcccccagggcctgcaggctgccagctccctctggaggcctcggctgtgaggctttgtgacggggccagcatggaagcactgctggctcctgcctaccggctctgcctgtcctgcctgcccaccgtggtcctgggcccgtgcccagctcctcaccgagtgctttgtgtggtttccaggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtgatagcagggaggagacttcatctctcggtgccccctggtgggcggtggggggatggctgaccccgttttacagatggggaaaccgaggctgggctttctgaggctccatctggaggtagcgcagggaccttcccgtgctgggtcctactccaccatcatcgtggggatgaccactggcggctgtaaacactgacccctgtcactgcccagtgtcggctcagggacccacggaatgatggcctcaccctctcctacccaggtctcatgggccgtgccatcccgccggagcgacacagcccccaccacctcaaagagcagcaccacatccgcgggtccatcacacaaggtactgccctgttccctgctccctcgttgcccccaacgggtgtacagtcacgcagggcgcgggagggagagacacagccagagtgtggtgggaactcaggacaagtatgcagaaaggcctgcagcacacatgtacatgatcagtacgtgagctacggagcaagggtgtctcttacttatttcaaaacaaaaacaaaaagcaaaataccaccgatcacccctgtgcttttaggtgtcacatagcaactgtcctgtgcttggcactaacccaggtgccacctgcgtatcgttttacagaacatcctggtgaggcacatgcgattgggagaggcttggagagctccgagaactctttcaggttctcgcggctggtccatggcacagccagctactgtgaacttggcagctttgtgggttttattttttatttttttattttgttgttgttgttgctgtttgagacagggtctcattctgttgcccaggctggagtgcagtggcacgatctcagctcactgcagcctccgcctttcaggcttaaacaatcctcccacttcagcctcccaagtagctgggaccacagatgcacaccaccacatctagctaatttttgtatttttgtagaggtggggtttcaccatgttgcccaggctggtctcgaactcctgagctcaagctgtctgcctgccgcagccccccagagtgttgggattacaggcgtgagctactgcacccagcctgtggttttagcttcatgatttcatagtgttcccgatttgctgaggtggttcagttaatattcttgttttatgtgtgaagaagctgaggcccagagaggtcagatttcctggtcaaggtcacacagcaagtggggatttgaactcaggcagactagctccagaacccactggtgtggaggctcttgatgggtctgggtggggcggggcgtgagggtcagtgctgtcggcccggcagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcaggtatggcccagggccaggcacacgggcccagttctaggaggggtggcggtggctgtggggcactgccctgggcctctccacatggggaaaccgaggctgagagccctcgcgtaccttacagtcacccagctgctcatcaccgggcctcagctgtgcgtgttccagggctgcgcagggggcaccaggctcctgacctgattctactgaactcacattgttcccattcttcagggagggaaactgagtcccagagaggccaggcaggcttccaaggccacaggactaaacatagtgacgagtaactgcctccgttgaatctttgtgagggtccaggtgcggcctgaggatgttgcatgcgttcattgtttcaccccctagcaatgctctgaggtcgttttcttaatgaccttattttattgctgagtaaattgaggttcagagaggttcaacgactcacccagagtcacgcagcaaatgcagttgtgaaacccaaattcagatgttcctacagccgcagcatccactgcacccaccagcaggttgcaccacaagaggccccagtccccccaggcggccccagctcagtaggggaagttccgtgccgatggtacgaggacgaggagctgttcggtggaaagcccctgaaggccactgtccttccacatgggcagaggtggcctcttgtgaaggggaaggagaatgggagccaccacggggctgtggggctgtgaggcggaaggactggggtgggtgtcccgggaggggttccagcttgtaggaaggttttgaagccagggagaaggcagaagcagtaagatccctgattgccaggggaagggtttggctctcagcccctaggcaattatggagtccttggaagcatccaccgcatgaccaagacagggtccagattctagaatattcttttgaaaaacaagggcagttccccttcttacgacagtaatgaagacatccctaaatagagttttgttgcttgcaaagccctaaagtcccaccatatcaagtgtctccgaagcctgctgaaaagaggcaggggacctggtggcctggctacgaaggtcccagtctggactgtgacccccccatttcctcaccatcctttctgtctggagggcaaacacctcagccctgacctcagtgtccctggggctgaaagcctcagggcgggtagtattgggtctgggtgctgactttttctgcttggcattgggtgggccatggagggtcccaggctgaacagaggaatgttttttacccacatgagggtgttgggcttctttctcgcaaactccagggaccatcagagagcccaccactcgcggcagggagagttgactgttgaactttttacccctttctgcagtccccccagggagcgtggggaccagggtcaggcccagggtgcgcagggcagtaagtaacaagtgtgccatctcagggttagcaaagccctctgtctccctgcctctggaggcatcagatgtcacttccatcttatagatgacaaactttttgaggctcagaagggggatgcagctggtctgggctatggctgtggccagggctagagcttacatcccctctgccccagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggcaagccgcggcagagccccctaacctatgaggaccacggggcaccctttgccggccacctcccacgaggttcgcccgtgaccacgcgggagcccacgccgcgcctgcaggagggtgagtggggtgtgcatgggcgtgagtggggtgggcgcctgtctggagaagctgtgcctccccatccaccattagcttagtttgcacctgggatatcctcgccacccgctttccaccacatccaaaccacctgcaggcccgtgggctctgcctccgattccaaaccctgtccaactccttgccacctcccagaccaccgtggtgtctcacctagcttcccccacgcccctccctcttcctgctgtaatccactctgcaaacagctacccggatactttctaaaaatgcaaatcatattattccacttccctgctttcatccttctagcaacttcacacattttgctatggccttggggcgcctgcctgttggggccctgcctgcctctcattcagccggattccttcgtcctccccagccccagcccctgggccctctttctctttgttccctggccatgcttagctcggtcaattcagtctttgctgggggcctttgcgtggctcctcctctctgcctgccatgtccccgccttccagatctttacttagtgggtttctttccatccctcaggtctttgtttacatattacatccttggggaggcttctaaccagaccccctatctccagttcatatcacatgctgtgacattttaaaattgtcttccggccaggcatggtggctcacacctgtaatcccagcagtttgggaggtcaaggcaggcagatcacctgaggtcaggagttcaagaccagcctggtcaacatggtgaaaccctgtctctactaaaaatacaaaaaaataaccgggtgtggtggtacgcacctgtattcccagctactcgggaggctgaggcaggagaatcacttgagcctgggaggcagaggttacagtgaacggagatcgtgccattgcactccagcctgggcaacaagagtgaaactcttatctcaaaaaaaaaaaaatgaaagaaaattttcttctgagcgtgtttcactctgtaattctcatttgtttgctagtttatcacctgtctctcgcattgaatgtcagcttgtgagggctgggatttctgtttcattcactggggtgaccccagttctcacaacaatgcttgccacgtagtagaggctgcatcaatattttttaattgattgagtgagtgaatggatgaaagaatgaattttttaaaaactataacacaaaagcaaatgagtcagtgagcaaaaagtgaactaaggcaatgaagaaatgaaggagtgaatgaagagacctggtccttgggatcccgaggtccctatcctcaaacaactccccgtaaatgccagccccagaggcccgatgcatccaccttgcccgtccacaggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcaggtgattgccctggggctcccagaaccctgcagtggtgctgaacagggccacggacctcatcagtgttcgctcagggactccttaggcatcaactgtcaggttcccctggatggcgaaactgaggcctcgggattggaagacccaacagtgtaatcatgagcttaggttggagcagaatttctcttagtagtttgcaggacatgtggggttaaacatttcagtggttttcttttccggcaggacttatcagtgcctttagcaatgcaaaggtatagaatgaggacttgagtatatgcatttttcaaatagacatgatctgaaagtcttttttaaaagttgccgggcacggtggctcacacctgtaatcccagcactttgggaggccgaggcaggcggatcacaaggtcaggagatagagaccatcctggctaacacggtgaaaccccgtccctactaaaaatacaaaaactagccgggtgtggtggcgggcgcctgtagtcccagctactcgggaggctgaggcaggagaatggcgtgaacccgggaggcggagcttgcagtgagccaagatcgcgccactgcactccagcctgggcgacagagcgagactccttctctaaaaataaaagaaattaaaaaaaaagaaataaaaaaagttgcatccctttggagtgttaatctgcattgggatgtcctatgtttgggacaactttgatgcaaaaagcatccttcgtagaagtcaccctcttgtgtcctggcgtgatgttttcctgctgtccgacgctcagttctggtttgtgctttgggcagccacacatgtaggtgggagaagctgtccgggtgcagaagtagggggcatccagacaggtggagcgacaccatcaggcctaggtatggctggcctcacatgagctcccctctgccccgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggtgagtgggtgggcagaccacctccgctgggtttggccttattcccaaaggacatgggcgtgcccctgtggcctcgcggaggcagctagacctggtcaccttgtgggtcaccttgtgtgaacggacctgagtgggtggcctggggttgtgcgtgctgtgggtgctggttggcatctggtaggtgagtgcacagcgtgtggctcctggctgcatcctcagtgggtgtgcgtgcatctgtgtatactcttaggatacaggggcctcaggagtttaaagatcaaaatgtggccgggcacagtggctcatgcctgtaatcccagcacttggggagggcgaggcaggtggataacaaggtcagaagttcgagaccagtctgaccaacatggtgaaacccgtctctcctaaaaatacaaaaattagccaggcatggtgatgcgcacctgtggtcccagctactcactaggctgaggcaagagaatcacttgaacccaggaggtggaggttacagtgagtggagattttaccattgcactccagcctgggcaacagggcaagactgtgtctcgaaaaaaaaaaaaagatgaaaatgtgaggctgtttggagtttgttcctttgccttgtaaacagcccacagctgctttgcgtgcacacgttccagggccatcctcagaaatgcttctggaataaccaagttctagctggggctcagctggaaaagctgaagtcacacttaagtattttgaacagtgaggattgaatacagggaatggattgtataggcgtcagaggctgaaggggcacagagggcctgagatgggaaccagtgagggcagctgcaggagatgccccggctcgggcttgggagcagaagaggaggtggtaccgagagaacctgagcattcagaaaagggttccatggccggtgctgggagccgaggagggagtgcctgccaccagctctgctggctccaggagtgtgtgccgtgctctccaggagggtgatctggccggtgggcagcctggcctctctcctccctgtggctacagccctggcccaacacctcccgcaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggtagcgccactgcccagtctggggtggggaccccggcatccatgggaggcggctgggggatgggcgggcagaagccctgctctctttcccaccccagaagacaaagccaggctcttcttcggccctggggctgagtctctggcctttgggtttcctaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtagggcatcagagcccccaccccccgctccgggactccttgtgggccgcaagaggcctccccctgctgatgccactgactgtcaccaggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtgggccaggttggcatgggggagggggcgggcaggtggatgggtggtcagtaggaggatgagcagataagaggatgcttggtgggaggtatatgggaggtgggtgggtgggcagatgtgtcggggtagaagaatagactatgtgtgagtagtggatgggtgggtggtcgggttaggtgggtgtgtgggtcagtgggaagttaggttagctgcgtgggtggatggatggatggatgggggggtggtcgggttaggtgggtgggtgggtcagtgggaggatagatggttaggttagctgggtgggtggatggatggatgggtgggtgatagggttaggtaggtaggtgggtgggtgagaggatagatagctgggttagctgggtggatggatgggtgggtggtcacgttaggtaggtaagtagatgggcaaaaggatagatggccaagttagctgtgtgggtgggtgggtggtaggtaggtaggtaggtaggtaggtaggtaggtaggtggctaagaggataaatgactgagttagccggatggatgcatggatggatggatggatggatggatgggcaggtggttgggttaggtaggtaggtgggtgggtgagaggatagatgactggcttagctgggtgggtgggtgggtggcgtggtaggtagatcgggttaggtaggtagatgggtgggtaagaggatagatggctgggttaactgggtggatggatggatgggtgggtggttgggttaagtaggtaggtaggtgggaggaaggatagatggccagattagccatgtggatggatggatgggtgggtggctgagttaggtaggtaggtgggtgggtgagagtatagacgctggcttagcctgggtgggtggatgggtgggtggtagggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtgggtggtagggttaggtaggtaggtgggtgggtgagagtatagatggctgggttagctgggtgggtgggtggatgggtgggtggtagggttaggtggatgatggaatggatggttggatgagtaattgtggggatgagtggatggaggccccagtggatggacgatgagttgggcggtgggatgagtagatggggaggttgtttggtttgagaatagaatctgtggagagggagagactgaatggggactgtgaggaaagactttcccggtcccccacatttagcaaggccagcaaggaaaagaggtgtccctcttgcctggacaaagtcccaagtttctctgagatgggagaggcccctgagtgccctctggtgacacacactccagagactgtgggcagagctgcttcaccaggggggtggggtcacacctcaacacccttccctgcccggaacctttttttttttttttttttgatggagttgtactctgtcgcccaggctggagtgcagtggtacgatctctgcttactgcaacctccacctcctgggttcaagtgattctcctgcctcagcctcccaagtagctgcagttacaggcacgtgcaaccacacccggctaatttttatatttttagtagaaatgcggtttcaccacgttggccaggctggtctcaaacttctgacctcaagtgatctgcctgcctcagcctcccaaagtgccgggattacaggcgtgcgccaccgcactcagcctccaggacctatttagaggcaacttactcctccaaaatgaattttcattcaaaaaagtacttgtgccccaacttgccgcttggatgcctgaagtcatacctcccctaatcattatttcaattatgaaaaatggcatcgtttcccaaaagcagtggcgactttgtcacccctgactcagacccagcaggtgcatgaagcactaatccctggctgtggggagcagggttccgcacacaggctctgtgggatatgcccgtgacagccgattcaaaaatataatggagaaaacgagtgcctgcccactgcccgctcatgaatgaggctctgggaggtagagttagcgagagatgggggtgcccccatggaaacgcagggctccgggaaggccacgtgggtggagcagccggctcctgttccagccccagccctgtgcaggggcagctgtgccccagcttctcactcacagagctgggaacagcagctttctctgttctcaacgcccaccctggccgccccctggcatccttccccttgctctctcactcctcacgtggcttttttagctcttcgggtatcctgagcaggcccagctccctcatgtgccccctccctgaagacctcctagccctgcctcagcttccttgccgttctctcctggtacctcattgactacctccacacagttaccaggctctgtagagcttgggatatctgttaatgtgatcgtagtctgttttctgaattagatggtaagatgcttgcatccgttttatgaccgctgtattcacagtgtctagaacagtgcctggcacctagtagctgcttaatcagaagttttggaatgatgcaaggaatgaatgaacgaatgagtgggatgggtcaaaccatgacgcacagagtctggcaggttacagtcaggagggcagtttcactctgggagcagcaggggatgtggatttatcccagggcaatggggactcatcgagggtggtggaggaagagggcagctcccatgactgcctgaccgccttctctcctcccccaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggtaagaccaccctgacagcggccaccttcatagacgcgattatcatgcgtcaaattgctcacgataaaggggcgcgagaaggaggtgcgctggccaacggctcccctcgcgatggtaagacttccggcccgcacccaccccgtctcgtggtccaaagatattttcagatctctgctttttactttggcccccgttttttttgttgttggttttggtattttgttttgaagcccatccgtcctcgccggtttgcacgcgctgacgactactccggccgcgcctgcccctctggtttgggggcgctcatcatttgcacatcattttaccatggttttttttttttggatttttgcttttttttctttaatgaatggatctgtgattctgacttcgactgcgcccccatctccctctttgcgcctgtgtccagggagcagggatggggctgcgggagggctcgggcctacgcccccacctgccggctgcctggatgctgtcggactgggggaagtggaggcaggcggtgcaaggagaagctgaggcggggcagggacctgcgctgtcgaggaggagctgggtctggctcttgcatcttgccctgtccccagcccctgtaccccagaaaaaggggagccctctgcctctggacccctgccttggccctagttcatggctcctctctgttggactgggatggccgaggctatagcccaggcggggccccggggacccagggtcactcccagccacacccccacttctcactccgccccacacactccttccccagagacccatgctgcccccatctcacgctggcctcgcccggcctccaccacctgaacccatctctgtcccttcttgcctaatctctctctgtgtctccctctctgtctgtctctgtcccgggctctgcatctctctccacctctcccttggcctccctgtctctccccaacacccctctctgccttactgtctttgggagcccaaaccctacccctagcttgggttccccttgacccccccggggtcccagccagctgggagggcagccctgcccctcgggctccgaaaccctgggcccggtgcctgactctgcaccccccgcctgccctaggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggtacgccccacccagtacccaggcccccgaagccctgcacagtgaggaccctcaaggccccatcatgcagataggaaaacagaggtgcctaaaggccaaggaattggctggatcatgaggctcaaaggcatggggctgggatttgggcccagcagccctggggccagcagacaccccctgaccagctctgctctgcctgcaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgtaactacgcgttctctgctgctgcttgtcacctttgcacctgggggcaccaggcctggagaggggatggggaaccccacagcccttctgtcctggcggggtggctgggggatccagggcatggcgctggggggatccagggcgtgggtgagggtgagatcccaaagccccgagcaccggcaccatcaccgccccctaatccatgggaggagcctgtgatgcgagccgatggcatcttcacgggcaatgaggccttcctggtggcccaggtttctcagtgtcatgggctggtctcatcagccatctgccaactaccagcttgggaccgctgaccacagccccactcccatgcacactgggacacggaggcccagagggtggcgggcaggtccacagtcacccaggaagctggccccacccaggattctgccccgagctccgtctagcccctccccacccccagaaggttctgtcaggagagtgctgcctgactctgggcccccccacttgcctgcaggaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtgagcgagggatgggggtgcctcttgctggtcagccggcgggaggccttcgtcagctgcctgcctcagagctgggtctgagctcagctgcatatgaggcccgcctggtgccattgcacaggcaagaaatggaggctccaggagatgggggagtcacagagcggatacataacgaataatagctgataaaagtacatgctgtgctcagtgggttccaggcactcacgtgtaccctttacacacagccccccaggagacataggcagcattctccccatttcacagatgaagaaactaaggcctggagaagtgaattcacttgcccacaggggcacagtcagtaggtgacagagggggatttgttccagggctgtatgattagagagcagcctttccacacatgcacacccacacacatgcgcacacacacacatgcacacccgcacacatgcgcacccgcacacacacacgtgcacacccacacacatgcgcgcgcacacacatgcacacccgcacacatgcgcgcacacacacatgcgcgcacacacacacatgcacacccgcacacatgcgcacacacacacatgcacacccgcacacaggcgcacccgcacacccctgtagacacaggcacatgcacatgctcacgcacactcccactcccacccccgcccccacccccaccctggtgaaccgtggggcctctgggggtcaaaagagaaagagaggggagggccctgagctccagggtgaaggaggcgttttggtgggggcggggggggtaatgtgtgtgcgaggacagacatggcaagacagcaggacatctttggggggcagtggtgtagctggcactggggtacaaccagaattcagagcaggggtcaataaactgtggcccatgggccagatctagcccgggccctctgtttgtacaattcatgaactaaaaaaatgattttacatttttaaagggttgtttaaaaaaaaaataaaaatgataacgatacatgccagagattacttgtggtcgaaaatgcctaaaacgtttatgatttggccacgtacaggaaaagcgtgtggggccctggtttagagtggagggagggtgcgccccctcagtagggagacctctgaccacatctggggccctttctccatccaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccaggtacttctgtgggcacatgcgctgcccccgggatgctctggtatcccttgcccatccttggccccagtccaccgtggtgccatgtggagagtgacaagggcacagggctcagctgggtgacctcaagcctgccaagcaggtttcaccaacttgggggtgtgatacatgcccaccctccctggggagacctcagtggtagctttccatgctttgggctgggatctcagctggaccaggcccccgttgacagcccctgttgaacctctaagaaataatgagctaggtgtgctgggccagaccgggggcgatgggtgaggtgggacctgagaaggaagctgggcccgctgcccctggggaagggcatgatcggaacccaatttcagtccttggggctctcttgagagggtcaggctggagcaagtggtcagaggcagcccaccacgcagccaggcgtctcccaagacacccctagccccaggacgggtgaaccgcagaggagatttcaggagccgtgatcttctaccaggcaggggatgcaggcgtgggggcgggtgaagcttgcttccaaatgtctaaggcatctcaggtggtgagttccccatcatcaaaggcatgcaagctcggcaccaagtgagctgatgtgaggtgtttgatcctcacagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacagtaaggggcctgcaggctcccggggaagcatggggccacaggtgggcgggtggcctgcctgggcagctggagccgcccagtggcagaaacccacggtgcaccttcgaaagctaagtggccctgctgaccacctccccccaggccctttgcctcacatttggggagccccagggcagtttcttgatttgctgggctttccataggagcttactggcacagaagaatagcacccagcacatagtaggtgcccagtgaatacctgcatgaatactgggaccaggggttggatccctcccacacaagggccgggcgcctcccacactcagcacctgtgtggctttgcacccattgacgtggttgctgggtatgaacgccccactctgcttcccagtccctagcacagcgcctggcagttagcagatccaccagggaatacgtgagtgggtgggcaaataaagaatctgtcacagtccccgaccccaagaagcctcatctgccagggaagtttggacaaatcacagatgcttttcccttcctggggctggagtagaaaccttgcagatagtcactggcttgccgggcacggtggctcatgcctataggcccagcactttgggaggatgaggcaggaggattgcttgaagccaggagttcgagaccagtctgtgcaacatagcaagaccccatctctacaaaaaaactttaaaaacaggcacacacctatagtccaagctcctggggaggctgagataggaggatttcttgagcctcggaggtcaaggctgcagtgagctatgatcacaccactgcactccagcctggacaacagagcaagacactgtcttaaaaaaaaaaaaaatctctgacccaggctggtaactccagggccctgtaagtgcagtccagggaaccgtagcatcagcatccccagggtactggttagaaatgcaggcccttggccaggcgcggtggcttacgcctgtaatcccagcactttgggaggtcaaggcgggtggatcatatgaggtcaggagtttgagaccagcctgaccaacatggtgaaaccccgtctctactaaaaatacaaaaattagccaggcgtggtggcggatgtctgtaaccccagctactcgggaggctgaggcaggagaatcacttgaacctgggaggcggaggttgcagggagccgagattgcacaactgcactccagcctgggcaacagagcgagactctatctcaaaaaaaaaaaaaaaaagaaatgcagacgcttggccctgtcccaggcctgctgcatgagaacctgcaatgcacaagtttccccaggtgatgccagcacacctggcctggaccacacgggactggtagggcaggtaattcccagagacctgggggcctcacccactctgtcacccgcttccagatatcagccagcctgggacggagatcttcaatatgcccgccatcaccggaacaggtaacccatccagcccttgctatatggctgccctggtcccctccgctccctccccacccctgctccagctgtcatgaagggacgaggagccttcgctagtctgggtgtaccccctcattctgggatgaactaaccgcacagtaggattcagagtcacacaacaggcaggcgaggcttgttccctgtgtagacaggatcctcgctgtgcagggaatctctggagttaagatcccctcgggtggttagtaagtatcagatgcaccctcaccagctggaaactcaccttgcttcttcgccagcctcagctggagatgcacatgtctggacgaggggtgggcctgagctcagagcacaagcctccgagttcactcgggcgtttgttatagctagagcttcattccttaaatccagccagggaactgggaagccttactttttctttcaagatcaaatacaggtgtgtggcagagataggtgtaaaattgacacgcacttttaagctgaaacttaagacttctatgatcttttggacttaggggtcccttgaggttggagccccatcctctaggagggccccattgtgtatttccttggtgagtctggggtgtggcctctgggggtcactctgcatgggcaggcctggcccagtggggctgaggcagttttggggtcggctgcctctgtgtgggtgcctggttatcctctggtcctttggtggaagctgaggccaggatggaggtcggagaggtttgctgatcttccctggggaacattcctgggccttgagccctgggaatggtgagcgaaggatagtcgttcagatattatcagggggtcagcgaggcctccaaatgggagtcccaactaggacacctccacctgcccagtgactagacaccgggggcattgccaagcctcaggcaacgggaagaagacaatttggtcgaaacaacaagagggttagaaatgaatgttcctgggatgttctaaatcttgaagtaggtgctagacacacaggtgtatctgtgtgtaaaaactcatggcatggtacagtgaagatttatgctaacacttatatataaatattttgtatttatctttttaagacacggtctttctgtcacctaggccagagtgcagtggtgcaatcacagctcactgcagcctccgcctcccaggcttagatgatcctcctacctctcagcctcctgagcagctgggactacaggcatgcgccactgcacccgagtaattttttatcttttttgtagagacaggctctcaatatgttacccaggctagtcttgaactcctgtcctcaagctgaggatcctcccacctcgactgatttttgttttttgtgtttgtttgtttgtctgtttgtttgacagagtcttgctctgtcgcccaggctggagtgcagtggtgcaatcttggctcactgcagcctctgcctcccgggtttcagcagttcttccacctcagcctcccaagtagcgggattacagacacccgccactacacctggctaatttttgtatttttagtagagacggggtttcatcatattggccaggctgatctcgaactcctgacgtcagatgatccacccacattgggcctcccaaagtgctgggattacaggcgtgagcagtcacgcccagcctgattttttctttttatgcagttttagtccacaagaagaaattttccaggctccagtctttgccactcaacctgtgtcagacttcacctttataaatggagatcgttaagcctggagccagctccatcaggtcacggactcgtggccttgggtagaaggcccagtcgcgctgctgtgatttcagcactcacccttgttggaaatgttgctttttcttcatgcacatggctgttttttcaaaagtgctgcagaaatgtggccaagacagcagaaaaggtgtgagcatccctggctacaaacgtatttgaaaccaaaagggaaaagaaaacgcaggcagccagcagttgctacagaaacgtgattttcaaagcatctgcatcacccgcaacctcatggaagcctcggtttggtttacaaaggagcgagtggtcggaaagacgatttgaccactttgtattcgtatgattcattcggagcagaagtttaaaactccatgaaacacttgccccgtggtgggcacggtggaatggggcttcactgggggcttttgaaagcaaaggctggtttaacaaaagttctgaaaagacagcacctctggggggtgtgcaaaggcccccacctccacgtggttcacaagaaagaaaaaagggaaaggaaatgtggttaacagaaaaggaggtttccccgattgtcaggaggtgttctggaagcatcctcttgggaccggtttgttgattcgaccactttgtccttgggactgggcagctgggccagctggggccggaccagggctggtcccgtgattgtgtctacttctgccctgtcccctgcacgcaccgtaactgcatggctatgaccccgccctcagcgtccgtctctgcacctctttctcctcatggctcctgggtggggagaggcagagggaggagagcaggcccagcttggtggggaggtacggggctgcacgtcccaggtcacacaggtggaggtggggcagcgggaggaccatctggtcaccttctctctctcagtcccttccccagcccccagccagcccccagctctggcttgagccaattttctagcagcctgttccccaaacagggtagccctcccatctcccaccctctccattaaggccacttgagatttaaaaaaaaaacaaacaaaacagccccagctaggattggaggtgcagacggggcttgtgatttcccagaggacagaataggaatgagaataggggctggtgggggcatctgacctcccctaccccacctccctggcagtgcccaagagcttccggggccccaggtagaaggaaccagcctctccccttttatcaccacccagcaggaaaaaaagggtggggagggatagggaaataaatatgttgctttgccgaaatgtgctcactgtgtatttctctctcctcctcctcctcctcctccttccctctctctctcccttctctctctctgtcgcccctctggctccccctccccggcccccatgtgtctgtctgtctgtctgtctctctctcccaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtctgcaggccacccccgccccgcccccgtctgtccccacccccggtgtgattaatcctcgctcctccgcgctcctctgacaaccccctcctcgagctttggagcttgtgactttatttttgtgcgtgtttgacctcgttctggagtttgctaatctgaagctgggctgacaccccccaagtgtctgtaccctctgccccccagccccggccctcctgcccactaggcccgaagcgctgccgcctccctcggacactcacactgctgtccgccccccagtcctcccgccttcctccctgcggggacccggcttcttggcccatctgtctccttgggggagagcaggctggagtgaagccccacccacactgtgtggacaggggaatggcagccaggcctgtgctcagcatctgccaggcccactatgtgtcctcagctgccccttagcctggtggggaggagcccagggtctgtctcagccctgggagtcagggagccttaggggtcagcctggttccccatcaataccctctgtatcggggcagggagctgaggagagagttgcagttgtccaacctggacactgaggccccaagaagcttctggagcctctgtgggggtcaggcctggcctcaggggtcctgacttctctgcacggggcctggatcctgcctagccttagcatggtcctggggccacgctcaaactggaagcccagcttcatgcttagggttccagcccctggggctggggtcgctgcaggacagcccagggggctattgcaaacagcagacagtttagccacctccccctgcccagcagaaactatctccaccctccaggctcatggctggccatctggtcaaccctggcttcccagctggggcgggcagcagggaggaggggttcacgttactgctctccctccctctttggagggcccatggcaggacctcaccctgcccctgtggccccaccgtagcgtcggtgctgtcttcactgcccaacgcagccccttcccatcttgtccccctgcaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggtgggcaccaggtggggacagggctgggctcgctgagcccccaacactgggctgtgaatgctgccggggcactgaatgctgagcgcctgctgcatgcagagctcagactcgggcctgttctgtggaaacgctgtccaggggcctgggcagctgagcctggctcacgaaccatcaggatgcttctgccaggggcacaggcagaggaaaagggtgtggttggggccggccagatcacatgggcctggtggaccatccaggggagcctggacttcctttgatgggtagtgaggaggcgtggagggctttcggaagggaaatgctcatctaacatagggtcagaaggcccctgggagaatagaccagagggacggtgaataggctactgctatagtccaggcaaaagacagcggcagggtgtgaacagggacggaagtagaacaggtgaagagaggcagacggttctgagacctgttcgcaattagaaaggtctgggaggactgttggacagaaacgctgaggcctctgttcccggtgtggtgggcaggcggccagcaggggctgccgggctcacagaggcctcctgggcatctttcgcttcttcccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactccagttacaaaggtttcttctctacctcagactgggcagccaatagggcaggcgtttaggggacagtgggagtatacccctggagggccaaggccacatccgcctgagtcaccagggagtggatccttttgcaagttgaatatttatacccttggtaaggacatcaccatgaggacatcaaatagtcacatctgtggtgaaggtctcaagtgttcacacccatggtaagagtgtgtcagatgttcacatgggttcacacccatgtgtcaggtattcacatgatggtcagggtgtcatgttcacactcatggtgagagggtgtcaggtattcacacccatgtatcaggtattcacaccatgctgagggtgtcaagtagtcacacccatggtgagagtgtcagatgttcatactcatggtgttaggtattcacaccatggcgagggtgtcagatgttcacacatggtgtcaggtgttcacaccatggtgagggtgtcatgttcacactcatggtgtcaggtattcacaccatagtgagggtgtcagatgttcacacatggtgagagggtgccaggtattcattcccatgtgtcaggtgttcacaccgtggtgagggtgtcaagtggtcacaccatggtgagagggtgtcagatgttcacacccatgtgtcaggtattcacaccatggcgagggtgtcaagtcacacccatggtgaaggtgtcagatgttcacacatattgagagggtgtcaggtattcacactcatggtgaggatgttaggtgttcacactcatggcaagagtatcaaatatacacagggtgagggtgttgggtattcacacccatgtgtcaggtgttcacactcatggtgaggatgttaggggttcacactcatggcaagagtatcatatacacagggtgagggtgttgggtattcacacccatgtgtcaggtgttcacactcatggtgaggatgttaggtgttcacactcatggcaagagtatcacatatacacagggtgagggtgttgggtattcacacccatgtgtcaggtgttcacactcatggtgaggatgttaggtgttcacactcatggcaagagtatcacatatacacagggtgagggtgttgggtattcacacccatgtgtcaggtattcacactcgtgaggatgttaggtgttcacactcatggcaagagtgtcacatatacacagggtgagggtgttgggtattaacacccatgtgtcaggtgttcacactcatggtgaggatgttaggtgttcacactcatggcaagagtatcacatatacacagggtgagggtgttgggtattcacacccatagtgaaggtgtctagtattcacacccgtggagtccagaatggccatcacttcctaattgtagtattctaatgtcatccctgcccatagagatcatgaccggggatgtcctggtgtgttttgaatacaggcaggagagagagcaactcctgccagcttgttcaggtgcctcttgggttcaagtctaccacatcttgggtgtgccctgtcttgtgtccgcagcatcccttctggagcagagtggaacctgggaatggccacagttcttcactattgacccagtcaccctcggccttgtcccttggtgccagtggcctggccctccccctcatttacctgccctttccgtatgctgccacagcagcacggctgcccctccacactcccccaaagcctgacaccccacctggtgcccggtcccgtgtgcagtgtcagtccccagagccagattgggtggctgagctggaagagcgtgagagagacttcatatgcccactggcccccaggtatagctacaggcgccctggcatggggagtgcactggggccccctgtggtgccactgcctgcttccctagagagaggaagcccacccttgccctggagcttcccctgctggtccagagtgtcttgaagcctcctggtagggtttccatctggacagccccatcacaacctcttagccatcctatgtccccaagcccatggggacagcgctggcctgagtgtggccgctgaggcctgcccccatcctagagcagaggtcagagaacctttcctcttggcagagccatgaggtcagctctgccccaatagcattcctggagccactgtggagtgaagacccccagtctgtgtcccactccacccaagacccaccagacatgtagacagttggcagccaggaaacgcctgccctgcaaaagctgagtcttgctgggtgggttcccagggtggccccagcttcccaggcccctaaaagctttcggagtacaaagggggtgggaggtgggtcctctgcccctcatgggcgcaagataatctgcaaagcagggcatgctctttttgttcttccttcagaagtgcgtctgagtcatgctaagcgtggggatacccagggtcctggaattctgcctgtccccatctctcagccttcatgcccaggcagtctgggatgctgacctcagttcacccagaaagaggcagtcccaaatccccaaagagggcccaccctggcccagctactggtaagcagggacaaaggggtggtgccaacacagatggaattcatccttgggggctctgatggggatttgccagcaaggatagccaaggctgggggtccctggccctgtgctggtgtctgaccagcctcacatccagcactgcagaaaccagccccacaggactggggggcaatgaaagggagaaccatggtctgctggaagcagaaattgccaccttctgccctgaccttcccaggggacccaaagcctccagggcccaggcttgcccagggtcctgcctcccctggagtggggaccagggaggaggggcatcctcaggggctctgcccagcctcactggctctcggtgtcccaccctgattactgtgcccaggttaaaaataagcagaagccttgggcccatgcaggacctggattccagcttggtgactgtgatctgtgtgaacttggggatgctttgggtgccctctgggccttggtttctcatctgtgcgctgggctttcatgcgtcccaacagggctgagcctggtgctgggctgtagttctgaggccggcaggcagatggcagtgtggggccggcaaagggcactgtcccaggcaggcctgccctccacccagggcacagagtggcccctacccagaatccaggatgggttggggtgttggtcatgccagccgccaggggttacccactcacatcggtgaggcccaagatcccacagcaccttgttgagccaccagttagaccagagagatgggagtggatcacagggctcagccctcacggtcatcaccatcagcccctgtctctgtgcctctgaattggtaccactcagcaccatggcgtatcttctctgaggaccagggacttagacccaacccaggcggttgtttgcaggtgcatggaaagctcgcagcctcctgccctcagagggtccactctgtctcccagctacagccagttggtcctcagccttcaaagaggtcatcctacctacccccaaagaggtcatcccacctacccccaaagaggtcatcccacctacccccaaagaaagaggtcatcccacctacccccaaagaaagaggtcatcccaccaacccccaaagaaagaggtcatctcacctacccgcaaacaaagaggtcatcccacttacccccaaagaaagaggtcatcccaccaacccccaaagaaagaggtcatctcacctacccccaaagaggtcatcccacctacccccaaagaaagaggtcatcccacctacccccaaagaaagaggtcatcccacctacccccaaagaaagaggtcatcccacctacccccaaagaaagaggtcatcccacctacccccaaagaaagaggtcatcccacctacccctaaagaaagaggccatcccacctacccctaaagaaagagatcatcccacctacccccaaagaaagaggtcatcccacctacccctaaagaaagaggtcatcccacctgcccccaaagaggtcatcccacctacccctaaagaggtcatcccacttacccctaaagaaagaggtcatcccacctacccctaaagaaagaggtcatcccacctacccctaaagaaagaggtcatcccacctacccctaaagaaagaggtcatcccacctacccctaaagaaagaggtcatcccacctacccttaaagaaagaggtcatcccacccgcccccaaagaaagaggtcatcccacctgcccccaaagatgtcatcccacctacccccaaagaaagaggtcatcccacctgcccctaaagaaagaggtcatcccacccacccccaaagaaagaggtcatcccacctccccccaaagaaagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggagaaaacctgtgtgggcaaaggctaggaggtgaggcccaaccaaggaccctcgggagcccacgaccatgggctggacgtgagtccctgtgggggcccaggagtgtctggggtggtgagccgttgcttaataaggtaacttgccggttttctgaaatcagggcagttttgtctcgcaagggtgctgatggattgtgagggagaattagacctgggaggccagtgtgggaccaggataaggggctggcacagtggagaggccaggacacagcccccttgccctggggaggggatcggggacagacaccatggcgtgagggggcagggggctcggggatcagcacgatgcaaaggcatgtcacggccagctgcctggtcctggccccgtcattcgaccccaccacggctcagtttccgtgtctgtcgaatggggtggtggtattgctatagggagtgactgcttcctaaaagctattgggtttttttggtttggtttgtttgtttgtttttttacatagccgctgtttgctcacctgtatgggaatcagatagtggccagaggcaaaggacaaaggcagaggtggggagggaggagaagctgcaggaggtcggcagcagtggctcatttgcaaatctggggagctggcgctggtggaagggttctctggccattccgtccttgagaggctaaggagggccatcaaagaaaattcagtcgtttacagattctttagaaagccgagagggctcagcggtctgcaagccaccagctgtcctcacagggacacttcctctggagggaggccgggggcacacgcttcgttcgcaggattctcctcacctcttgcagggccgtcgtgaagatgaaacagattaaatacacgacatgctcctagcagggccaggcacagtgtgggtgctacgcaggccctggttttcattcccattctggcaggaagagatgggaccagtgtcaagttcagtggacttgcagggaaagagcaccgtgtacagggcaaggaagggggctgccgaatctgattttaggtctgggaggtagagaccttccgctcattttgcagatgcttagggaagtgaagtgacctgttccttttccagcgacgaggcccatcctttgtcagtttcccctccccagggcctggtgggtgacagttgcccctctgagggcatcaccggggtcttgcatggcacattgaatcttgcacatctggtgtgcctgggctggggggagatggggaaaggcgctatagccagcagcacgtgaaggctgggcagttgaggacagcagccagtctctgtttcagggatggaagtccccaagggctaggatcagacagaaccgatgcctctttctgcctgtctccaggtcttttgggttcccctaggacagacgagctgctttaagggaaaagcaggtgcacttgggggccttagattggttgcccttgccctctccttccgccttgtgcctggctgggcttccctgggcccctgcatgaccagcaggcaggctgggcctccagcatcatcagcaaaggcgacaaccatttgtgtggtagagccactgcaggaggtccacaaattgcaggctctcagaggcgggcgtgttctccgggttctccaggaaacgggctgagatggagttaggagggtaagaggttttgcagggtaatgcctgtgaaaggggagtgaggaacgggacgggacaggaagagtctggcaggccacgcagagctgacgatttcaacggactccacctgagctccagcgcaagaccgatcccaggggaacctccatgtttgttgaattcattggcactataattgcaagtgtcggaaagccttatccattttcccttcgagatggtgagagatcaaggttgtgattgaaaatcaggcttgtggagttgaatttgcatggattaaggaaggtgcaaagaatgccacccccagcaggcatctgtagggaatcccatgagtaaagcagggctcgggtcttgaggcgcgcttctgtccgtgtagaccagtggaggcctcaagattcgtcctcgagttgatgtgaacctgtgttggactcagcctctctggcttccatccccccttccctgttaggggccgtcctccatcaaagcaggcagccggtggtttagagtgtcccggatcttgggttcagatcctgtctctgcctcctaccagctgcatcctaccagtgtgggcaaatgacttaacctctctgtgccttactttctcctctgtgaagtggagatgcggttgcatccatgtcagcgggtagggatggcatgcaagttttcatatgcaatgtttcctacagagcctgaaatccaatgagtgctctgaattagcacgcatagcattcccactagtgttagcttaaccactgccagaccagggtgtggacctcaagaggctaccaccagtcctgaccatggcactcttgtgacacatcccctcggaagacctgtccccagcagcctctggggacactcccttatcccctgcccccaccaactccagagcctgggagcaaattctagtctgattttccagtctgactcactgtcccctggctgccgagtgttccctttaacacactcacgatctccatggagccccatgggcctctccaagggcgagatggagagaaacagattgtaaggtgcgtcccagccgcctgctccgcagtggcagccagggcccttctccagggatgctgtgggttgaggggcttgccagagctgacgaccaggatatggagctgcagatatgcacgccatccaaagtgcagatgcccgggcccatccaaggagctgccccccagatctgagtccccaggtaggtcccaggcctctgcatttattaattagctcttgggtggagctggcgtgtggaggtggcgtacgcttaggctgtctacaggggtgggggctgagtccttctttgttcctttgatcagggccaaggccagctccttagggcacaagctccgagtggaaaaaaagtgatggccacacaggaaaaggggcctggagacccatcttccccttccccaaccccagcgggagctgaaggtctcacagacagaaaaggaagtcccgttgggtttgcacagtttattaagataatcaatcaatttcttaagttattcctttgttaaccagacagcatctctggagagaaaatgcactctctgtgtagatacataaaaatacatcagtcattttgcccctcctggatgtgaacggaatctcccctcctcacctccacagagggagctcaagccccagggaaccttcccctccccttttatgcattaccaggggagtggcaggggcagcccccaactgtggagtgcattcaggtctgaggggggaggaaggctcagaggggcatctccccagcaccctgccacagtgctggcttctggggtgtttgttcagcggcctgctgggctgccccaggctgggggctcccccagctccccgtgcatcctggcttgttccacggagccctgagccaagtctttgtctggctcatgttcctctcacaacatcccacaggcaggggtgagcctgccgcaggaaggagtaaggtgctgtcattgcggaatcgattgcgcacaggaatgcaggctgagggcggcagcccggtcccctcagtgtctctttaaaccgacagctgagctccgactccctcgagttcagacccggcctcacacaggtggcagcatttccgagagcttcaccgcctccactgggcacttggttttgacatcaagggttctcgtcctggaggtggtgcgtggatgggtgttagctggggacgccctgcaggtgaggctccagaggctgagcaccaacctttccatttcgacgggcagtgccccaaatctttgacactggagggcacgggacactggcaaggccatggctcaaagtatttctaggccttccccgcccccagtatcaccacctccagcgctggcatcagcatccggcctttgcccaacctcctggctcaacatccaccagaggtggctcagccacagctccagacctctcggtgcaacctgcatgtgtgcgaaaaggctgttttggaaataccccaggccagcagcagggaagagaggtacccctcttccctcacacatggccttggccaccagcctaggacacatggggtggcagggctctgggggagtggcagccgtccccaccggctgaggctgggatgcctctgtcctcacactgctcggggctgttctctgcttcaagggcactccatggacccattcttttcccctgaccctgggggtggccaccacctaacagtgcatgcccctaccgccttgccagcttaagtgctaaaaaaatagatgcttttactgagtccttgacaccaaaacaaggagaccaccacctagcctgtaggtcagggcaggcagcggggag

SEQ ID NO: 653 - DNA, 8667 bp, Homo sapiens
tctgcaggtctccctgagtctttgaggacacagcctcgctggaggcagtttctggtgccagtgacggggtggcccgtgagctgatgacgaggactggcttttaatccttggtggcatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcaacaacagcagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggcaagccgcggcagagccccctaacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactccagttacaaag

SEQ ID NO: 654 - protein, 2517 aa, Homo sapiens [sequence omitted]

SEQ ID NO: 655 - DNA, 71678 bp, Mus musculus
  misc_feature (1)...(71678): n = A,T,C or G
aacgctttgtcagaattcaggtggctgatggtgccactatctcatctgactatattagagttaagtgtgaatgcacatgtatttcctggtggtaaaaatagcttagtggtttccacatctgaataggatgtttccccatatgaacaggagtggatggaggaagtggcaccgagtagactagttttatggtctgcagtctagaccagtgcaatgatcaaactcaatgccctctcaatgtggacaaagtctgagtagaaacaaaaagagcaaagaactgtagctgagaataaaggatggactaaatgggttatgtatcagaggaaatccaacattctataaatagcttggaagaagctcagaggaaaaggatagtattatctcttaggacagttctaccaggatcccagaagggtgactctacactgtgaaccatggccttgctctaggagcccaaccaatgaatgcgagcatgcagatgtgagtgttctcgccttggagacacattctttacagtgtaattacagagtgggttcgttaatgattgagtgggattctagtactggggcaatgcctttcgagctgcatatcgttttgccataagctatcgatgtacaaaaatagtgaaagggtgggtccttttagttaatttttgattggttattgttctctctctctctctctctctctctctctctctctctctgtgtgtgtgtgtgtgtgtgtgtgtgtgtgtgtgtgtttgtgtgtgtatgtgtgtgattgggaagggacatgtgtcacagtgcatttggcgtagattctctctgtccactgtggcttctgtggatagaactcgggtcttcaggttttttccaacaaaagctttacctgtgaagccatttcattgcctgctgcttgccctgtcttctgcctgcttgtctgcttgtctgcctgcctgcctgtctgtctgtctgtctacctgtctgtctgcctgcctctctgcctatctgtctgcctctctgcctgtctgtctgcctctctgcctgtctgtctgcctctctgcctgtctgcctgcctctctgcctgtctgcctgtctgcctgcctatttacctgcctccctgcccccctccttgttgcatgcttccctcccttcatcctgtccttctcttccttgggagcttattatcaaaagagtagtttcctggtcttctccagatgtgggttgcttacaacctttggtattcgctctttttctatctgcaaaggtctttgatcatcttctggttgatttttgttctgactttcaacttgtattagtcagggttctctagagtcacagaacttatggatagtctctagatagtaaaggaatttattgatgacttacagtcggcagcccaattcccaacaattgttcagtcgcagctgtgaatggaagtccaaggatctagcagttactcagtctcacgcagcaagcaggcgaaggagcaagagcaagagctagactcccttcttccaatgtccttatattgtctccagcagaaggtgtagctcagattaaaggtgtgttccaccacacctttaatcccagatgaaaggtgtagcccagattaaaggtgtgttccttaaactcggagattcaatcttctggaatccatagccactatggctcaagatctccatatcaagatccagataaggatctccaagcctccagataagggtcactggtgagccttccaattctggattgtagttcattccaaatatagtcaagttgacaaccaggaatagccactacacaactcttaattctttcactttttagttattgtattttttatcatttaatatacagtagtggtacatgcttgcatgttgtatgtaacatgatcaaattgggatagttattttatccaccaatatttattatttctttgtggtacacgtattcagaccttctaaccactttgtagtatatgtgttactgttaccatagttaccgtactgtgctatgggaacactgggacatatgtctcccatctgactataatattgtagccattgcccaacctctctattaccccctctgcttagtactctcaacctctgccagccattattctgctctgtatttcgatgatgccagcatctttagctctcctgggagaccagctctctccagtagtatttgggtctggagagctgtgggacagctctgggggcagatggaaaacagaaggatcactttaaattattttagtttaagttttctgactcaaacctctgcaaagacaatgggtcaatgtgggaagaagaaacattatcaggttctcttctatgttgggggataaagcattttctcttttgatattagtgttacaaataggggtttcatacaccactctagccaggttttaggaatttcttccagatttaagtttgtaacagcttgtttttaaggatttgtttattttatgcatatgactacaccgtagttttcttcagacacaccagaagaggccatcacatcccatttcagatggttgtgagccaccatgtggttgctgggaactgaactcaggacctctggcagagcagtcagtgctctcaaccactgagccatctctccagtccctgtaacagtgttttattgatgagaggcttttttcttctgtctttctatagttttgtgctgtcatgtgattatcttttattgtattaacacattacatgagtttatttttaagaaattgttacctttgatgttgtgaatgtgatgatgcgtgagtgtgggcacatgtatgctgtggcaagcctgtggtggtcagaggacaacttatgggagttggtttgctccatcttccatgtgggtctcagggatcacactgaggtcttctggctgggtggcaagcacccttatcgactgagcaattttgctgatccacaaattaattttcagatgttaaataatgcttgctttggggaggataaattccatttgctctggaagagtgattgttctataaacatttgctagaactcatcagtgaagccgtctgggcttggttttcgcttttggaatggagtttattttattcggttctgggttcatgtgatgtgtgctctacagctaagctatacccccagctatagagctaaaatttaggttttgtttttatacatttggctttttactgaacatgtctacaaaagaggtttagtcaaaaagaccaaagcccatatcatcatcagatccccccagattccccttattttgcttctactttcttttcctctcctaggtggcagcagcagtggtggagggggctggattgcctgctggcacagcttcagcatttgaactggacaaccagctcgtgaatcgcagattcccaatgttgatgatggccagggtcttgaccaatctttcaggccataaaagttgaacattaagctgagcagcttcagagagggcattgattctatcctccgtgactgctccctcactgttgtagagggtgaggtggagtagaggcaggcaaactcagagacctaggctgagtgctcatccccagatgtagggagagcctccctgcaatgtgaccttagctctctgcgaaggacagagcactttggctgcatccgagaaaagaaatttactgttatcaattctatctgcttattgctatttactttattttgattatttatttctttttgagacaggttcaacaatttgtgtacctctaggaatttacccacttgcttacatagaggtgatggtaatttaccctggcttgtttctgatttttataatcttttccgaatgaacttgttttgagatagtggatttgcttgaatttcctgctgttttctgttctactttaacgtcaattctgtcaaattcttccctctgcctacacaagatctggtccatgctactttctccagcttgaacatgggagcagagatggtagttttcttcttctttagtgtggctgtttaaacctacaaacctgctttcatatcatgctttacttgatccatccatagcacattcttttctaattgtaattctcttaccgaaaatgcaatattttgctcacattattgaacaatgaatgttaaatttgtccactgagaagctttatctgaaaaaagaacagttttttttttaaaaagaagctttatctgaataagattaagcatgaatctctctttttttaaaacttttcattaagtttcatgtcatgcaccccagtctcattcatctcactgtcctctctaatctaccctctgctcttgcaacctgccccccaacacacacacacacacacacacacacacacacacacacacacgcacacatgcacgcgcgcacacacacacacacacgcacacacgcacgcgcgcgcacacacacacacacacacgcacgcacacacgcacgcacgcacgcacacacgcacacacatgcatgcacacacacacacacacacacagcatagaaaacatcttgttgtagctgtagtgtgtcacagtatgtcccataccagagtatatccttctgtcttgcaaatgttcattgtaataggtcactggtttggttagaggtctctggcttctgtagcaccatcaatatttgggtcctgacctggactcctttggattatgttgttgttgccctgtgtcatggaggttttgcagtttttgattggcaggactggccctttcatgcattccagcagttcacggatgatagaggttttggggacgggcaaactcaaagccctgaacctgggtctgggtggtagctgagccagtcagccctctggctctccctcatccctcccaccaggccagctttccagcactatggcatgcatgcttctttcccccagtgtgtgggtagtgttatatgtctttgcaagttgcttaaattgtttcttttcctacggaattctgtcatatgtaccctaatatgataatatgtacttgacctataaaacttacacagctataacttattatttcattgttgaatacttgggctttctaattaagggctaacataaataatgtggttgcacatccctgtacacttgttttgaagaacagatgcacacccttgtctagtttggagactaggataacattgggaggcatggcccacgtgtactttctggtcctccagacacagccacagtgtttttcagtgtgacagaaaaacactgcatgcctgtagcaaattaccagagtttctattgtcaccccacctcccactccttgcaacaacatttgatattttcgattatttcaatttttgtttgttttgttttgttttgttttgttttgtttttttcttagacagggtttctctgtgtagccctggctgtcctggaacttactctgtagtccaggctggcctcgaattcagaaatccacctgcctctgcctcccaagtgctagggttaaaggtgtgcgccaccactgcccagccggttatttaaatttagttaatctagtggctgcaggcatatcttgttatggttttatttttcatttccacaatcactagagatacttgactccctttaaaaaatttattgataattttaatattctcttgtgtgaaatgcctgtctaaacctttttagcctatttcccttttaaccatgaatttgcagaaattcttatatactctgcaaaaaattactttgtaatttgcccaagcaaatgggtccttactttttattcttttatggtgttttggaatgaatatgttatcatcttaatacaacttagatattgataattttcttttggggtactttagtggttgttgttggtggtggtggtggtggtggtggtggtggtagtggtggtggtggtgtgtgtgtgtgtgtgtgtgttatagtctgtcttatctaatttaccaaatctttgagaagggctttttttttctttttacataatatttttattgattctttggagtttcacatcatgtaccatcacactccccagtccttccatgtctgcccaccaaccctagtgacctccccctgctaaaaaattaaaaataaaaaaacagaaaaagaaacaaaacgactccactttgtgttctatatgtactcactggagcatggtcaaacgttcagtggctgccccttaagaagagctgagttcgtccccttccacagccccagcagaagccatcaattatggagagctacactttatcatccttaccgtgcttgataagagttttctttaatcgcttcctgtttaggctgttgctttgtgggggcagtggggtaggaattgtcacagaagccttccatgtccctccttctcaactgtgtgtttgcagttatcaatatcactgcaaaagtatcttctttgctctttacagccagtgggaacacagccgtgtggtttctggtgacagcatagaccacaaacacagcttccccacttccagctgaagttaggccacagtgacaatgcagaccactcacatcaatatggcccctggtggcagcactgcctgggaacatcaacatgacttcaggctgtagcatagaccacaggtatcagcatagccacagacgggaacacagaccctggctgcagaaagactctagacacagacacagcccttagcagcatgcactcagacattaccgcggcaagcaggatatttcatagcatacttttattgtctccttaatggctgtgaggtctaatgttgtccttttcattgctgatgttggtgcaaatggtttatgattttttttctttttagtagtgcagaaatagtatatattctatagaaatctactttaaatttttatattttcctaggatagcagcccactgtatgatactcttccatggctgtacagtggccacagctcctaatcagccatataatcaccagggtgaacaactgatattctaacaggaatgtctaatctcgtgtgtgtgtgtgtgtgtgtgtgtgtgtgtgtgtgtgtgtgtatgctgtagcagatctatatatactatgccgaaacaaattaagattaactatgtatagacttttttttaaccattagccttttgctacaagttttaagctagcttttgttacaggttttatatatttttaaccatacccaatgaacttgaaaatccttagataaagagtttacataatcaataatcttgagaggtttttctgagagctgagagcaaagaaaccctagaaataaaagagttttcaagagtgagaagaagaaaaagcttatcaataaaagacttttgagagtgtggagcagaagaagctcagatatgaaggatttgggtgaagggtttgggaagtcatttgattgtacagtggcaggagttgttacagtctgcaagaatttgaaaatagagtgtgtcatgttttggccatcgagctgcagtgaagccaagccatttgcagaaagacagcgaagctttgatgaaatctctgagttagaggaggaaaagagattagagaaggagggaaagggtcaaagactgagaactccacccaagggaggattctaatcttgtagagactcataagggagctgtggaaggttacaaggctccagtgaaccaataggagagaccaaggcagggcaggcagctcctaggtgcaggtaagaaagctccaggagggagctgagaactgtggggatggagaaaaagaggggaggaagaaggaaagcgtcctggtgacaagaattacaatgtgggccatccctaaatgaattgagagacctgtcagagaaaaatgtcccaaatagtaaagatgaattgtcttaccatgtgatgggaacccgggaggcaggaggagcttcccagctcactggtgtgcttttattaagctccagggagccaacagagaggaagcaggcagtgctgggttagtatttccccatcagacaaagagagagcaggcagagggaggagcagagcctttccttgtgatgggtgcccaggatagcacagcaggctccaggagccacagatactgagatgcccagaatcacagggaagaagcagataaacaggcatactctagaacgtggcgtctactatagtgggtggcagaaatcagcagacacaatcaaaccaatagnnnnnnnnnnnnnnnnnnnnatgccaggcccccttggatagaaacccatttacatatccagctggtggtttcagtactagacaaataaactgagaacatgaccatctcaaggtacgattgaggggaaggggtttttgtttgtttcattggttagttggtttgttggtttgttgggtgggttttttgtcttttttgttttgtttttagtgttgatatgagggaaagtacagccagaggcacctggaagagtccagggcagagaaagaaagtggtatactgaacatggcctgtggattggaccagtccatgagaggaagggatgacagagagcaagagaagaagacaaagagagtgcaggcaagagataggagcaaaagagaggggaccaagagagagcacaagagaaatagtaagattccaagacagtgagaagctggggagggatgcccgtgagtctgagaagtttaggggatgtatctgtaggtgttggtacacttaggatagagaagcacgagagtcagaagttcaaggctgtcaccacttacgtaatgattttgagaccagaatgggccccgtgggaccctatcccggaaacaagcttgtgcactgcaatgcccatattttattttacttcctggtgctcgaatgggactgcagttgatggcacttgctttcctcactgggtgacacagctgcactccaatacagaatgtgggggtttgtgattcattcaccgcaagatctgtgcgtctgaaggtgtttttcctgtgcacctttaaccactgtatagacctggtgcctgtgcttgcttttaactcggtgcttttaactctttacactacaagaaatcagtaaaaggattcacaaggttgaggctggattcctttccatcgtatttacttaaaccaagtctctgaaaaaatgccacgtctgctgagaacagagttgggaggagtttaggacagatgtgacagtgggactctactatgggacttaccctagagctctgctctcctctgtttagaacggaaagtggcttcttcaccctgccaccccacccctaccctggaccccacccccgattcgattctttttatcttctggtttaagacatttacacactgaaagtgaaatcattccagtatacttgagctcatttttaaaggcaacatgagaagaagagataagttggggccacgttaagtctggaataaaagatacaaagaagccccccccacacacctaggtttttgcatcccagatatgcaaaacatagaaaggttcattttgaaaagtctctgagtgcaactttgttgttggaattcagagagagcctgctgagacactgggtagaagctggatggtattcagatgctacctcatcgaagctgaggttttctgtaaatcactcaaacttggagagagttctgttgctaactgatgagctaactgatgagctaactgatgagcacagcttgggaaggcagccagctaagtggttggagggaaaaaaaaaaaaaactaactaaagatggcagggctctgaaagtgaacccatgtaggccagcaggtggcgtaccaggtgctggttttggtactctgagtggtggaggtcagaccaagtagtaagggatggatccagaaggcttggccaaccaggggcgagttctagctgaccctgcaggttgatggtgatcctgcaggacttgaactccctctggggctgagggatgtccacgtgtaaaagggaagccagagaaagctgaactgaagacccgggcttttaaaagaggtcggggagggggcgcaggggaggaaactaccaacggaaatagtgaatttgggtaaacattcactcttcaggcagtctaaagtcatcctcgccatcctcgccttcctggtgtgattcgcagaagtagaaagaacaccagcagctgctttgaaataccctggagctggcagatgatggacaggcaagtgagaaagggctcggctctgtatgaaagcagagcgcacatttgcatggattttaaaaggtggggagaaagggtagtcactattgggggcctctgagcccgggttgtgggagatgcttcagacattttcagctgtcttttcagaatgtgtattctttcaaacccaaccgggtgcatgctcctctggtaatgcctgtctcttcctagcaggaaacagacagctgagaccctgctgaccctgtctcctgctgaagttgccaacctcaaggaagggatcaatttttttcgaaataagactactgggaaagagtacattttatacaaggagaaggaccatctaaaggcatgcaagaacctctgcaagcaccagggaggcctgttcatgaaagacatcgaggatttagatggaaggtaccgtggctcctttgctctcttgccagtgaccctgtttgcagttagagttgacaggaaggcttctcacccgggacattttaaatgacccagtcagcaaattgcttctaagttttcctcttgtttcattggaacagtttcctgacttcaaaattatgttttgcttatatttgctttctcttctctctttctaagaactctaagttagcttgatggtcctagctattggggtgtttgggttgcaggggtaggagcacacatatgaggtattgcattcatcaaagattcaattcttctagaagtccttcttccaggacatgcaagcacattagcacacacacactcacaaacacacacacacactctctcacacatacacacacagacactcacatacattcacactcacacacacattctcacatccacatccacacactctcacatccacacactcacacatacacacacacacacacacacacacacacacacacacacacacacacacacaccagtgagagacaaacagacagagaatgctttccaaacgttgctaaaaagctggtagattttttttgtttttctgtcagcctagctacacttagaaaagagacagagtcccagctgtctcccctacacaatggtggggttctgattggttttttctaagagcctatgcctttgccagccttcatccccatagagaacgtctgtcctctggacagcagcaatgttaggacagagttgtttggctttggagaactatctggcacatctcaagagaattcttgggcatctgctgtgtcagcactatttacctcataaatgctggaccctaccctttaaaagcctgccctggtctacttgagttgaatccttaggtgttgggccttgtcattactttgtgtgatcaatcttacctgtggccttgtgtggatagctcagtaacagagagagctgaggagttctccaagaataccccactatcattatgcagaggacaatcccaaagtctagaatattctcacaactacccatagacttgtttgattacagatacagttcctcatcctagtcgactttccactgtgactctctgttacacctatagccaaaactgcagataatactcaatttgggttgttggcgtcttcctagggaatagggcagggggcctcacctccttcatctctgacacatccttgcaggactcgggggagatagaggttttgttctcctgctgattatctttgggagatattgaatttcctgtcttgccatatgtagctaaccactgagggagatgttaaagcgaagtgggctctctcctccttgcctgcctgcctgcctgccttcctactctcagctctggagtaatctggaacaagctcgtcatctttctcagcctcagtctgctcacttggaaagtgaatagattgccaggattccgagagagtaaaacatttgctgttgaagcatgggagccatgttcagatccagagcattaatgtaaaaggccaggcactgtggtgtgcgcctacaatgctaacctctggagaggcagacacagcaggatccctgggctgcctggccagccagtctagcttaatatcagtgagcttcaggttcagagagagatactgtctctcagagcaaatgaaagaaatgaagaaggagtaactgccgatgacagacatgttgggataaaggagattgtgctacttgctcttctagttctagttgtgtcatggatgttttggcttgggtagtggataactgcatatagtatattcagtactgaaagtgtcaaatttaaagggatgtttcatgttccattctgaatgtcagttctaactatatatacgtttattaagttgaacaaactttgggtctagataattttggtgtatggtgttttctatttatttgcaagctgcttttttaaaaaaatataataataaggattattgaaaataaatttcaaaaagagaaaaaagtaaatggaaaagaaattgagaaaaactcccagtagtgacttttcactcacacacatgcatatacacattctcacacacacaaagaagacccactcactcaaaacctacaaaaagcgtttgaaagaatatcaccatagtatatgataagcatccaactgatgttcactgctgttattatttatgtggggccatcaactgcctgtggtctgtacacagattatttgaagaagtgatgatttttatgttgtttgctcacctaaatatggtaagttccacaccacagattaaccattcttgtcttccgcaaagccttagtgtggttaatcttagtttttgtttgccagcagcttagctctggtgtcggggattgggggtggggtgagaggtggaggctggatgttgacagaagataactttctgaataccactccaccctccgccttatgctttcagagtctctcactgaagctggacctcactaattaggatagataggtaggaaccctccggatccttctgtctcaacatccccagtgccgattctaggtacatgctgccacttcgagcgagcgttttacaggaattccggggttcagacactgattctcatgcctgcatgacaagccactgagccatcccccagcctacaaacctcttctctttgctgccctcacagggaagctgggtactctcggctttattctctgtggagcgcaccacacagtagttaacctgcatgcctgtggaggctcccatttgcctctctacctgccgttcttttctggagcctctgtacccttgccaatcgaagagcatctttctcagggtacagttaagcatagtccattccttcctgccatccagtgtccttcctgacacataaccaggatcttagaaactgtccatctcatgtccttaagtctaatgctctcatagcttctgtgtgaggagctgaggtccttcttgtgcccaccccttccacctctctcttatctcctattcttttcccataccctcctgtctcctgcccctctctcttctcctgtcctactcctgtccctttccagtgccctccgatcaagctggcacacaaccatacttggttctttcttgggttctagaatattctatagttccatctggaatgcctcatcctgatttttagaggttgtttcccactagttcctgagaaaggaggcactacaaagtaattcttcatgaatcaaaccgtggactatgttttcttgccgccctagaaaggacgtttaaaaattctggatacaacaaagccgggatatggcagcatgatatgttttctaagttttcttccttccttccttccttccttccttccatccttccttccttccttccttccttccttccttccttccttccttcattccttccttccgttttttaaattttaaatgatgcttctggtaagagccatttcttggtttaaaaaaattccttccctcttgaaacaaaaccaacaacaaacaaatttataaagataagaacagaaatggtttgtaccctacttctgaatgagcaacctaaggtgtaccctattttcaactaaccccccctccccagatctggtaagcttcattttctggggaagtgaaagggagcctgacgtagtagctcacgcccataagcccagggcttaggaaaccgaggcagggcttctctttgtctgggaccagtttgggctacaaaataaaattctgactgaaaaacagaacagggcctggagcagtgagtcgtgaatggtggtgcatacctagaaatgaagagctgagaaacagcagggagacgaggaggccatggtcagcctcagctacatataaggtcagggctagcctgagctacatgagatccttcttcgaaaaagctgaagagagcaagaaggaatgaaaataggaaggaaggaaggaaggaaggaaggaaggaaggaaggaaggaaggaaggaaggaaagaaggaagttagttcaagcaaatatcaaaaattatacagtacctcctttaaagtctcctgttggacatagtctgagtcttattctgaaatggagttacgttaataaacagaaatgtagaacatacacctaaatacttactgataaaaagagaattttagtgcatgttgtatataacgtgggagatgtgcatttgaaaatatactcactcttagcggggtatgatggcacatgcctttgatcccagtattcagggggcagagttctgtgagttcaaagccaacctggtctacgaagagagttcctggacagccagtgctacacagagaaatcttgtcttgaaaaaagtcagaaggaaggaaggaaggaaggaaggaaggaaggaaggaaggaagaaaagaaagaaagaaagaaagaaagaaagaaagaaagaaagaaagaaagaaagaaagaaaggaagaaaagaaggaaggaaggaaggaagaaagaaaggaaggaaggaaggaaggaaggaaggaaggaaggaagaaagaaagaaagaaagaaagaagaaagaaagaaagaaagaaagagaaagaaaatattctccatacccacttagtctgaaattcatatttatctgagtatattgcatgtgacctggtaatcatactcttaacccttaaactttgggggatcagaaacgttgaacagtagaagtgaaggctgaggagagataagtcatacataaacatgacaacattctctctgaaccctacttagctgttgtgagaacatcactcttgtgtctttgtggataagagctgtcttcaagaccagcagcttgcttatcacgtgtgtagaagcattgttttaccactagctacccttctcctcttcccctgaagctggtgtgtgaatagccccttttcaagctgactccaccctcgctcccagaccaggaggagttaccctgaagtctattctctaacacacatcattgtgtgatacaggcttgatcttcacaggaaaagactttgcttggtgattagctagcatctctttggctgccccctgtatcacttcttcataggttttctttcatgtattttgagttccatcgattgctttgacttctgagtcatgggatgccatcacacttcatcagcactaatttttttcactgtgtagtacaactgactctcatttccccccaggtccgttaaatgcacaaagcacaactggaagttagacgtgagcaccatgaaatatatcaaccctccagggagcttctgtcaagacgagctcggtaaacactcatccatgctttctgtcacagcggagaggggcagggaggggactttggaagctttatcctaatgtcttccactccgagtttcagatcagttcagattttaagctgttagacccatgcaattgattgattgtttgagacaaggtcttccttctcacgcttattgatcatttgcatttcatctttgaagaattacctgttcctctcactagttcatttatagattgggtaggttgatttctcattgttcagtctttttagttctttgcatagtctagatactacagctctgccagatgtaccgtgaacaaatatattcacctagtctctgggctgtcctcgccaaattgcttcatttgctgtgcaaatgcttgttaatgccatgagtacttaccagttgttggtgctgtttcctgacagactgcaggcctgtgcagacacttcttagctgtgtctatctgtattttgaactgtttccctactccttcccctaagtgttttcactgtttcagatcctgcattaaggtatttgatccttttgggttaattttcattaaagagttaggaatctggttttattcttgtatgtgtagttatccagttctaccagcactgtttgctggagaggttttcttttccctaatgtctgcttttggtatcttcatcaaaacctgaaatgcctctagctaagtgtgtttatatgagctcttcactctgatccaggtatctaggtgtttgtttttgtatcatcctgttctttcttacctagctttgtgaaagatttgtactacttttgttaaattaattcataagtaattttgctgggagctttgcctgagcaccgggtcctctctgaggcagccgattgggtggagcattggtggggggtgggggaggggggcaagacttggtcttgtgagtgtaaaagttgcttagtattaataatatttattccccttgattcttagttattctggggctagaaaccaatggcttcaagaagattgacacctgttgctgattattaaacaacatttacctgtcttgactctaagttactctgaggccaaaagccgatggcttcaggctggccaggcaagaaggaggcttgaagcaattaacttttattgaaccaggagaagagagttgcacttacaaaaggaaaaatttttacacaagaaaatatgcataaacacaatacattcatacacacattaatacatacacatacattatcacatactttttggggggcaatcaatttacatacttgcatatacacaactatacttatatatgatatatatcacatataactctatatgataaaatatatggtatgtatatgatacacacacacatctatatagaattgtggatggggtaaaagcaaaagcgccagtgcagcaagaactcactcattctggatgaacaaaagcttcaacctttattgcatagagagagaaaaagcttctaacccttcattgctaaatgaattttcctgtctcattataagaaaagcctgcctgctgctttctgctctctctatagctccttctctccttggtcttttctcttccctctttagccctgttacattctgctattttctgctgtctcttctgcttctattttgcttttcctctgttctccttctacatccttaaatctgctctcttcttctttgtctctccttatctgcccagcccctcacctccgtaacacttctatactcttttccttctgcttacttaattcatccttcctagttttttgtacttttccaagagaatagatcacatggtattccaagcatccttttttttcaagagttcagacaagttcaaacataaattcaaatcacatattgaacaagaagttataacaaagatgtttacatgtgtttctattaagactagttatataactaaacattcactatatgttgccagctccacaggttcattgagagtttaaaactataattcttaggtctgagttcacattgaagttttgtatagataaacccaaccaatattttatcttctatccttgcacttacaataaaatgttcattcccagtttatggccttttgttaatggttttacaatttaaagggatatatccctaagttataaatgtcatgacacctgaagactagcagagtcctaattgcagttttcatattgcagagggttttcatatcgtttgcataagtttagaaattctggagaattgttattaggaattaagaaatcatctatttctcttcatagcattgctataaaagagaacatcttcactgacttgcagaaaatctgcccaatagggagggctaatcccaaggattgttatgtcaatttaatgatgacaagaaaggcatatcaatggcaagaatcaatagacaagattccttgggtcttgcctctgagctcattcaccagagttcatggtgaaccatctcaggaaaattacctgcagcctttaccctctcctagatggctccggacagattttattctttttgatcatcttataaatttaactttaagattgcacattgctaacatgtagaaatgttaactttcatattgatcatgtatcaacaaccttcctgaattataaaattgtcgaattattttattaacctataaaaggatagaattattaattctatagtttggttaaatattttacatttttttatacttaggaccatgttctctatgaatatagatagcttaacttcttgctaatttgtgtgtcttatatttcattttcttgcgtagtagttgctttatctaagacctccaggtagaagtggcgagagaaagcctcctcgctctgtctctgctctcatagtggtggcagctgggtgttctcagccagccttgaaggcctgctttgccattctttgtttcctaacagcatcttctaattcataaaaggagactgtcttctgtcaactgtccttcacgtacccattgagatgctcatatatttctcacatttcttccatgaatgtgatgttagtccattgctcttttgaatactgaaacatcattgtgtttttcaaatgctgaaccaggctaatatgaagctcacttggtcatgtgtgattctgtttcagaccaactaggtcttgataccaaaaccatacaaacacacttcaagaaaagaaaaccagtgaccaatatttttatgaatgtaggtataaaaaatcatctacaaaatggtatcaaatacaacttatgaatgagagtgaaaagagaattaaataaaatgagaaaaatgtttgcatggataaaatatgataaactgggaactaggaaggacacaagaaccctttcacttctgagaccatcattcattcattcatccattcatcctcagtgtgaatgacattgacatctgctccctggaatgtgtgggcttttccccccagaaacaatatgtggacgttattataatctccgcactgcataggacgtgattaggctcttacgaccatctccttttgggtactaattacacctcctcattgtttctgtttacatctgctggtcaaatgtgatgctaatgtgttgataattaacatttagcacactgtgtttgataacttgtttctgatattagaattttttttcagttttttttctatctgtttcagttttctgtgggaattgcttctatagctgttcaattcccaagtcttttttttttaaaagctattttatcatttgttgtcatgatttggtggctttcttttggatcatcaatcaaccaggaaactcaggaaaccaattgcacctacagccatcgcaccattacaatccaccttcctgtcctaatgccaatcatgctgggaactgtgactttctgacatgctttcactccatgtctttcctattctttttacatagggattttagggagggttaggttggtagtgcatgcttataatggtagcacttgggagactgaggcaggagtgccatggattccaaacctgcttggataacatctgtctagccaggactacacagcaaggtcttggttcaaaatggggcaggggaaggcttcaggggactgtcatttgatcgcttttcctgaggtcagaatagggatgacagtttctctgtactttatttatagaaacagagttggcaaacatcacattcaactttactaagtgtgtggattatgcttgtgtaaggagtacaaaggcctttgtggaaatgccttccaagcaattgctgagacttacaacctccactttttctagcttctcttaagagaggaaaaataggaagaaggaaacttctttagtggttgtcagagtacaagttttctcagggtctcccctggctttcctatcagcctctcctcattggcttgcctgtgcagtaattaacacgctgaagttgattcattcctgtaaggatgcataattaccacagtaaagctcctatttttcagtacctgcttagttgattctgagggccatgttttcctggtgttctcaaccctctggctcccacgagaggatgacttcaactcctgatccccaggcttcaagctcccgagtgctaggactgcaggcatgtgccactagcctggctgagccacgaagcaaaccctgatgtggaacatatgctgttttctgagattgcaagatctgtctcaggtctcacaaggctcacagtctggaaagactataggtgtcttagagaaaaaaaaatacgtaatatatctagtgatgatcagagcttcaggggaaaatgagggctagagagggttgggaagatgttggaccactgtggctgaggagcactgtttgacctggcgtgttgactatgctctttggatggtcgatgggcacaagggtggagctggagatgagcagtgcttgatgacagctaaatgtgcatttttctagtgagtagagaatgttttgaatgtttgcaatgcaaagcggaatagaattggctcagccagcaaaatgcttgccaaatgttcagagctcatgtaatagaagctgggcatggtagtgcatccctgtgattctagcaaagtggaggaagagaccagaggatccttggagctcactggtcagtctggctagccttcttggtgagttttaggtcaaataaaagacctcatcttaatgagatgggagaacagctaaggttaacctctggcctccacaggcacacgccccatgtgcttatgtatgttcatctgcacctacacacacacacatacacacacacgtgctcagagaaacatgtatacatacacccaaaagaaataatggtaaacaagtctcttttttagcatcactgagacaaattctaaattggatttttaaaaaaatttgtttccaacaattccttttatagaagttatcacaaagtagtgtgagtactgctcattttgaaatggaggtaggggtttttgtttgtttgttttttgtttgtttgtgaaatttgtggaagggggtggcattgggcagaggcccatctcaacagactttgagacaactgttgttgggaattgtttaattacttttcttattgttgtgaccaaattcctgacaaggagcaactcaggcgaggagaggtttattttgactcatggttgggttgaacatgtagcagatatttgtcaattctaagctttcctatgccagcctacctcagcatgacgtcacacaccgtgctgaccacctgcatcctatttcatttgtgtctgccagacatctcctgattcccatctagcttgaatggcttgaaactgcttcctagttatacttcttttggctttagttgtcaggctaggagttccttcccgcacagcctctctgcaccctgactttctctctctcactggtttcatcacagtgcatgtgttaaacatgccagagatctcttgagatgcttaagtgtatcatgaacaaatgagcagcagtggctgttgccttggtagctgctgtgcgctcagtgagtattctcttctgctgtgtatagttttgaccttctgtgttttgactatgtgtttgtattttggtaccatattttcaaaaatgttgttttctcacatgctcagaattatttccctttggttctagttattgaaatggatgaaaacaatgggctttccctggtagaactgaaccctcctaacccctgggactctgatcccaggtctcctgaagaattagcttttggggaagtacaggtaaggaaacatcaacgttataatactcttaataacaaaatgaaactaagatgtcactcatacatatatttgcatatctttacaactatatatatgtgtgtgtgtatatatatacatatatatatatgcatgtatatacacatatataacctaaagattatatataacaaaatacagcatgtatatacatatatatacacatatgtatatataaaatagagatagatacataaagaagttcagaaagtatttttattgcctgaatatttgtggataagatggtatgtcagtcagtgctttgatgataaaatacttgaagctgagaaccttatgaagatttcactcatagttggagaacttcaagagcatggtgtttgtatatgcccagctctggtgagtgcttcagggtagatggactcacagtagcaggagtgtgcatgaaagtatcctgccatacatgcagaataatgactggagggaggtgccagtcctctcatgaaaactcactcttgagggaacgggcggatcctgagattctgtgaccctggaagaactattttgatttcttccaaaggctctgccagtaatgaatcaattaccttctattaggttccacctctcaaagacccaagcactctcaacatgcccacactggcaccaagtttcaagcacacgaaccttggagggggtgtggagggggttgtgagctgcattcccactgtagcagataacaagttggatatttttgcccctcatcctgagatcttcccgaatcttttatacagtttctatcttcagagcactttctgagaagaacacctcagaagtttggggaagacaaaaaagcaaaattaaatattttttttctgtatgtttagaaagttctgtgcatttgggcaggggtttattttttttcttttgaaactccactcagaacaggaatactaataactcatttgtttcctggctgttcctggctcttcacactagattcctgttgctgtatctctgctcctctgtgtattctttatctgtggatgtgacaggcaggagggtggggggtgaggaataggtctggaattcccctacctgcgcctgtctgaaaatcattgttgatgcccattctcagaagctcttggcaacctatagaatgagtaaatgggtaatgtagagcccagctagcctgacttcagtccagtctgcccagctgtgccaacccaccaaactgattaggaatcgtgtagtcaatattcctcaaagccacactagcatgctaagtcccccagtgcttgcactaacatcgctcactggtaaacacgttggagctggtttgaagaaagtaaaatctagtgcattgttgatttgacatgaagcagcaggcactagagtccaagtctgacagtctgtggagggtgtcgtgttctgtcagtgtgtgtctgtagttgtagttgagccagagctggcttgaccttgtcagagaaacagccctagccttgctctccattgctggttaccaagccataacaggaatttcactctcttctaacagataacatatctcactcatgcctgcatggacctcaagttgggagacaagcgaatggtatttgacccttggttaattggccctgcttttgcccgaggatggtggttgctacatgagcctccatctgactggttggagaggctgtgcaaagcagacctcatttatatcagccacatgcactcagaccacctgaggtaaagaagtcacatacccaactcctaagataacaatggcaacagtgggatctttgggttgttgctttgtttcttagacaggatcttatgatgttcaggctggccttgaactcactatgtagttgaggatgagaattcctgcctgctggttatactgccacttccaaatactgggattatagacatgtgccactacgctctgtttataaaacatttttgggtgcttctgcactctgacttgtaccataggactatgaaaaagaagagaaataaaagtaaaattttgtatatggaccacaattctaattttaaaagtgctcccacagtgtatatccacaagagtgaggagggagccattatggaaagcagggtgcttgtaacttctcagagacttctgctctctgttcatgaacaggcacaggcataaagcctatcagagtggccttgtttttgttcaaaatttatagcacaaaccaacacacacacacacacacacacgtaaaaggccagtgatagcagcatttgaaaagctgaggcaggaggatcaagaattcgatgccagtgtgtgctacataacaacactgtttcaaaaatgacagacaggtacttttaaaataaaggaccaacggaatattatgggttttacacacacgttgaaccccaattaccactgtcctttgaacacaggagtgccacaggtagtcacaagtgaaagtaggaactaatatcccaataaaactttagtgatggatataattcccatggatcatccattattacattcatcttataaggctgtatacagaagcagggagtgtgccaagcctagttcatgcactgtttgccaaaccccgcattttattgtttattgagatggtgcctgctatgcaaccaggcttatctgggtcttcctgccttagtctcccatgtgctagcattaccacccctcacaaccatgtcctgctttaccttctcccctttcataaatgtattcttctctcatacaacacatcctgactacagcctcccttccttccactcctcctagtccccaccacctgccacttcctctgaccctgcagaaaagagcaggcttcctagggacatcaactgaacaaggcataacaggatgaaataagattaggcacaagtcctcatatcaaatctggacaaggcaaccggtaggagaaagggctcccaaggacagccaaacgaggcagagacaactccagtcccactgttaggaatcctacaagaacacaatgctacgtgaccattatatatatatatatatattatatatatatatatatatatatataatatatatatatatatatatataatatatatatatatatatatatatatgtgtgtgtgtgtgtgtgtgtgtgtatacatatatatatatatatatatatatatatatatatatatatgcagagaacctaacttcatgactgctgtttcagtctctgtgagcccctatgaaccctgcttagttgatattgtaagccatactctccctgtggcctcgaccccactagctcctacaatccttcctccctcttctgcagggttcctctagccttgcctaatgtttggctttgggtctctgcatctgctcccatcagctactagaggaagcctctctaatgatgatttgggtaggcaccaatcaatgagtatagcagaatcaatctctctctctctgcccccctctctctgccccgtctctttatcttaccttttcccagttgtttttggttccaccctgagtctctggaccatcctgtttcaggtttctaaccaatatgggactcaagttagaccagtcatttggttgacgactcccacaagctctgagccaccattgccacagcacatcttacaggaaggacaggttgtaagtctaagcttttgtggctaggtttgtatcccggtcccataaatggaagcctttcctatttacaggggatgacaggtccgggctctatatccttgctagggtcacccttataggttccagaaagtttctactgcactaggtttctatactacctcccaccaccatcccccattctagtcgccttttcctgtattctcttcttccatccctacctcacccaatccacctgtaaaatctattctatttacccttcccagggagaccatgtgtccccattgaaaggccagtcgaggaccagtgcttttcagtggcaaacacctcacttttataactcggggaagtttaacctaaagtaaaggttaaacagtgtggcagagtgactagggttcaaaggaatgttatttcataacatcagtatagtattgttatattatattagcagataataagaatgatcagttagatgatacaattagttactctctggttgtgataaaacactgtgaccaaggcaacttacaagagaaagattttatttgggcttatggttccagagcattagagttcatcatggagtggagtggaggggggatgactgtcaaggctcttgaagtcacagcggatggtgcacatattgaactaggagcatgaacagagaggatgccccgacatacttcctaagcctccccaaactgctgccaaccatggaccaagtactcgaatgcccaagactagctggctgcaatgtgcctttaatcccagcactcgggaagcagaggcaggcagatgaatctctgtaagttcaaggccagcctggtctatggagtgagttccaggacatccagaactgttacacagaggaaccctgtctcaaataagcgatcaagcaaacaaacagacaaaaaacaataacaaaaaaaacccagtaaatacctttggggggatcattttttttcctaattctctttatgatacaagttgtgttttctgaactcagagattaaaggcaggtcaaagaatcctggaatttttacatcttttgcttagaggatgacacctgcttcctccctatttcctctccctgcctcacaagttctgcttatttatgtagcttttcatagcacggatgttaaattagcacagctaatgcatgctagcatgcagcttttgtttgtgcttacagcaacatatttcatttcgtatgatagtctgattcttttacgtgtttgtctgtaggagattacagatatgcaggaccacagccagactctagtctgattctaaaactagtaagcaactctgttaaaattagaaactaccttctaatgggagcagtgctggattttgtcaaaaaaaaaaaagtcagaacactttttatttatttattatttattgtttctattatttgtgcatttatgaatatgctttctcatctatgaaaacagaaatcttcagagtatattgtaagacccaaaccacagggcatggtgccttatgtctgtaatcctaatagccaaaaggctgagttaggaggaattttaagaactccaggtcagcttggctacataaggagaccctatctaaaaaaaaaacaaacaaaacaaaacaaaacaaaaacaacacaaaaataacaacaattaaacctacaacaggaaaagtataaacaaatgagggaactcgcggcagtatacttttgtgatagaatgggtacctaaccacttgctcatctttctaccatacccttacagtgatacagcaaaaccattttaggtaattaatgctcagtagaaatggcaatggccttaatgtatataagcagccgaaaagacctgggtgcttctttacaaacagttgagattactagaatgctgaatgtttttcatcttcattaaattttattgtatgacccctctggtaacttgagtcctcctcaggataagttatgtcagtgtaactatcagcctttagaaaacatgggggtgactcacagttctataaaaaagcaggcagagccaggtggtggtggcacatgccttaaatctcagcactcaagaggcagaggcagaggcagaggcaggtggatctctgagttcaaggccaacctggtttacagagtgggttccaggtcaactagggccacacagagaaacgatatctgtgctgtgtcctctgttttattgagagcagctacttaggaagatcatgaagatgttcattctacagcaacatctgcatggctctctctgtgacttctgctattccccaccccatctagcctcaccactcaaatcaacactggtgtgaaacatgagcctaacacacttggctgatgtccactctctggtttgttagtacgacctagccatgatgtaagattctctgggatgcagtcatgtgtgtaagcaggagcaggaaggctggcttccacctctttccctttcagtcagaaagccatttctcttgctagtgaatcccagtttattatctttcaccatttccacccttctgatctagctaccctaccctgaagcagctttcccagagacgaccagacattcccatttatgttggcgacacagaaaggcctgtgttttggaacctggatcagagtggcgtcgggttaactaacatcaacgtggttccatttggaatatggcaacaggtcagagatctgtttgttttcttactatactttctgaggtgacattcaaatatacagaatgtggcccatgttgttggtacacaagatacagtgaatacaacctgtatcgaaacttcagttttggacataactgtctttgctcaaagctttcatttccacttagcaaatgtataaccttaaaataaacctagtttattataagttaataagtttattataggctaatcaacctagttccagataaagtttttcatttcctttaacttttgatctgatttgctaatttttctcaaaatgacaatcttctcaaattttaaggccaagctgacctacataattgttcaattgctggattgcaggtagacaaaagtctgcggttcatgatcttgatggacggcgttcatcctgagatggacacatgcattatcgtggagtacaaaggtaccatcctatctccggaagacagtggaaggggaagtgcgccataggtgggaaagaggatgtccgaaacctcatcctatgctcatcatctgtccccacttcagagagcacagtacatggtgctcttgtctttggaaaaggaaccttttagatttttgcaggtgaaaaacttgccaataattaggagtctatggtggcaggtacattgcttttagcacaagggaactgatatttacattgtttcaagactatcattaatttattgttgaataaacatcataagtccctttcatcatgtttgctggatatagtgatagacacctgggatcccagcagtcaggaggcagatgcaggatgaccaggagttcagaatcatgctctgacaaacagttcaggccagcctgggctctataagaccccgtcttaaagagcaaagcagataagagcaaaacaaaacaaagaaaatggaaaacaaaaaattatcactagaaaatttcatcatgggtgaagcaaggccttagttatccggtaatcatttggaacacaattgtacatagatttttgccagagataaggatgggttgagctgaccccttagtgtcagcatctggagacagtttaggaaagtagtgtgatctacagtgaaattagactgatggtcatcatgaggtactcagaacccagccagccagaaggatgacctactttacttagaaatcagaatattctaagactttagattctgacagtgtcctctttgttggattgtttctttgattgttggtgtgtgtgtgtgtgtgtgtgtgtgttgagggcacacaccaattcttctgtaatcaactggattagattacatagactgcactggacaaacttgttggcttggtcattcaaaccagagcatttgaggttacatgttatttccccacaggtcataaaatactcaacacagtggactgcaccagacccaatgggggaaggcttcctgagaaagttgctctaatgatgagtgatttcgcaggaggtgcatcaggctttccaatgactttcagtggtggaaaatttactggtaataatttatatcccagtgattctgagcattaggcatgtgcttggatggatgctttgagaataagtaaggagccaaccttgtgaactacagacacaacaaactgaggtttcagaatccgagggtagaatgcacgggactgctgaggtgaacgagcgtctctgggaatatgtaggaggagctaagaaagacagggcattctacagggcagattcccaccccaggagctcttcttctctagattcaagggtcatgctggggtgtgtgagaaaagtatacatatatatgaaacagttgattcagttttgtatctttgtgacacctctctgatcctatatgctgcaactctagatcctgtttaagtctagacttctctgaccaattgcctcccaacatgtcagtcagccctctttgctgcctgctgtgtcctcaggctagcacttctggtctactcctggcctggcttgttacactgactattttcattccccggagtcctcttgttgctaaactctccacaaccatcaattcccaatggctcgcaattcaactactgtctgttccctggctgccctgtgtacccgaccctacctcagcacagacactccctaactgctctgttgaagggtgaccatccaccccatctccttctaccctgctgtgctgttcatatcactttatatcattatttgtgcattttatttctccttttaaaacttgcttctctcactaagaaagcattttcttgggaggacttccctttttttgttcacaagatttacagtctaattcagtattgtatgcttagtgccccagagaacattgaaggtatgtaataaacactgggctgggggagaaaacaaaagagagggaaactttatgaggtgtctataatgatttcatttacagaggaagaggcagaagtcggtcctctattcaattccgtaagtggtgggcagggcttggctcctaagtgtgactaacatttgtgcctgtgaatttagtcactgaattgtcaggttataaaattatatatttcagttacatagtggaccaggcaatagtacacactagtaaatggttaataactgtctgagttacagagcatagagaatgagcttgcctataaaggaaggctatccacactgagccctgaattcagctagagtccccaaaagtataataagcatgaagcgagcttggaacctgtgtctgatctcttggtaaataatcaaaatttgctaactaaagctgaggacacatctccatcaacataatcagattagtccactctgtcttacttgtttctccatttcattttcatctgaataagtccctttcaagtagagcaagatttataaaacttttctgtttgtgatccattggcatcagagaaacttttatgcaaccctgggcatataaattcataaaattggtatgaaaatcaagtttttactgatgataaaatataagcaaattgattttaaaataattcttcaatacattatatatatatatatatatatatatatataatttagtatttattaaagacaaaggcaaatgtgtatcctacaaaatggatatacttatttatctatacaaagaattaaatcttggatgagcatttgatacagtaggatgtagggtatctcaagcagttttcaaagctgatagatattttgattttatgatcaattctgagaattccatttacataaatatgtattactatacagcagaattatgtttagggtcatttcataagcttttagaaattatgtcctgacccctagttaaaattcattgaaatttagtgaaactcaagtcaagaactcaagcagcaattttaaaaataaaagatatattaatttgatatagtctaagggaggatgataagaaaatctgaagatttttttcccataattaaaccattctgtttctgtaagagcagaaggggtcacctgtgtggtaagtctgtagtttgtagcatatagcagttttgaatgtgtgccaagggcacacataattgattgctgttgcgttgcatgacgacatgtacagtgtaaagcactcctgtgggatactcagagccagggctgcagagatagatagtgcatgatgcccagggatggtacaaggttcaactcatgtgagcgggaccattcattatgtgttttattttgaattaacttttgttagctggattctcagaaaaccgactgctgttgattttcttatgccctgtgcatttacacattccccatgtggagttacaacccagcttaagaaggtgggaaccagggcgttcactttccaatgacttgtgaacagaggatgctaaccccaaatctgtcgttgcagaggaatggaaagcccagttcattaaggctgaaagaagaaagcttctgaattacaaagctcagctggtgaaggacctgcagccccgaatctactgtccgtttgctgggtactttgtggagtctcacccatctgacaagtagggctcagcatttcattcaatatttttacatctgagtgagtgtctgtcagatggatggctttgctatatgtacaattgcacaatgagaaaaagattgtgagaatccaaaatctctctgtttctgtctctctctccccgtctcctcacctgtacacacacctttctgctatataatgacctgagtctcagatgatgagagtatacctctatggcctcaatttagtctgactacctctgtaaagatgttctttccaagcaaaagtcacaccctggggaacttgggtgtatatctgatatgtcttttctaagagggacacaactcaacctgtaccaagtacttacgttaaaaatcaaaacttttcatgacttgtcaataacttccattttatttagtttctaaaataattgatgtgcaaaagattttttatttaattttttttgcaatgatgtgtgtgtgtgtgtgtatgtgtgtacatgtgtgtaagtatgtgagcccaaatacatgtagaggccacagaacaacattaaggagtcagttctctatgtttacagcatgagtcctggggcttaaactcaggtcatcaggctcagaagcaattgcccttgtactccttgtttccaaccagcaggactgaaagcgagtgagggctgatgcacactgttagtgtgggtactgtagagtagtcagttacgtgtgtgggattcctttgacatcgatgttcatgtcacaagttgagacagagtgagccagcttacttccaggcaaacagctttagaaacccatatacttttgtttcaaaaatcaaatgaattctgaagaaatgagacaatgttgttgatgggtatatgaatattacacaaagataacttttcttgtacttgattttggtattggaaaacctttacatatagctggatcaagaagcatataaatctagttttgaactgaaagttttatgtcatctggatataaaccaagtatttctgatagaaattactgtctgaattgatataaccaaaatatacaaaatatgtgaaatctgagaaaacaggatatatgaatcaactaatacacacacacacacatatatatgtatattttatttaaaaatattaactgagtgagtggggagtaggctcacctgataaagcacttgcaatatatcattaaggacccgagtttggatttctagcactcatgcaaaaaacaggtatggcagtacatgctgtgatgccagtactagagaagtggaggcaggaggattcccgggactcagtggcccgtcagtgtagcagtgacagcatctcaaaagataagatgggaaactgttgaagaatataccaaatattaacttctggcctttacacaccctcacacatgtacgcctacatacacaggtgcatacacatgtaaatacacatagcacatgcaaaactgacagaaaagtatatgcacgtatcatgtaacactatatattttagtagagactgtagcaaactaccccagctatacagtacttggtcattcttgataatcaagctatgataggtagcagagaactttagatatctgtgatttattgttataaacatgaaaaatttgattttagtagacttgcattcacttctgttttagttacttttcattttttgttttttgttttggtttggtttttttgtttttttttcgagacaggttttctctgtgtagctctggctgtcctggaactcactctgtagaccaggctggccttgaacttagaaatccacctgcctctgcctcccaagtgttgggattaaaggcgtgtgccaccactgtccagccttagttacttttctaatgctgtgacaaaacaccatggcccaggcaatttagaaaaggaagcatttgattgagtttatagtttcagagacttggactccatggtggctgagcaaaagcttgctgcaagaaagagctgagctcacatcttgatctgcaagtaggaggcagagagcactctggaactggggcaagtcttttgaaacctcaaagccctgctcccagtaacacacctcctccaacatagccacacctcccagtccttcccaaacaggtctaccaactagggaccaagtagtcaaatatatgcgcctatgatgcctttctcatgcagaccaccatatcatcttagaacataggttcccttctctatacaccatgatttcattaatcactctacattcatcattcattacaccaaggaactgacgtacactgatggcttattgaagtctgttaacagcagtacagttgatagtcttgttagctatgagcccagcacaaagtggcctcaagccgaaagccttacactcactgctggttataagcaggcctcagcacagaggacacctgcaacgagagagagctagacctttagtttacgggttatacactaaattcgtgattgtaagcttaatggattatatctctagggattgcaacaagaccttttgtttttagtatctttaattgtattttacgtaaccaagatccagacagaatcctgctatgtagccctggcaggcctagaactctccatagacatcaagctaacctcaaacttgtgtcagtcctcctttttctacctcctcgatgctaggtttagaggaccaagccatgatgtctggcttagttgccataatttctaacaacaacaacaaaaaaacattcatatataccctatctgtagataatctcctcctttgacactgagtgagttcttatatcatttggaatttctggataaacatgaattgtattaggatctgtgctcatgtagaaatctatgtaactttaaaatacactacaagtcattttttccataggagcatccatattgacagaactaaagagccttgggccacacagaaagtaccagtccattagccttgagggatgaaaagtgggcaggaagggtggagataaaaggcaatagtaaaagtcagactctgagacccaggcagggctgggtctggtcacaatgaatggcacagtgtacgagacattggcttccccttcatgttctggttcatgactgtgagaaacatcttcagtgttctctaggtgccccaaataatgcttttactgtgacatctgtaacctcggtgcttggcaggctgaagtagaaggattgccagttccaggtcagccagggttatgaaataagagcctttctcaaatcaaacccacatgataacaactaacaaagaacaggaagagaggtcagagctcagcagctgggcgctcagccggcgtgcagccacacagtggttgggttggctagaacctgaactctgcagcacacaggagagaaatagcgactaggactcagttgtctccctggagcagagctgagctctgaaccacttttcccctcagcccagcctgagcactggtcacacttgctgttagaaagcacccaggaagatgctctagacccgtttcctcaactctaatccttgagctggaatctgggaagagccagtaattccagggaagaggcaggtgctggagtagcaaagaaagtccttggctcagagtccaaaatgcttttgatattttaacaactggtatatctaactagacaaatactaattttgtccctaaggaattgttaaagggggtggtaaagaaaagaacttgccagcattcacaactgtcacatctaacaatgtagggacacccaagaaggggatagagggcttttagtctttatccacctcaaaatagaaaaatagaagcacccccaaacactgccatggatgtaacccagtgcacagctcagaggcaggcagtgtaacatagcagggaagtggacgattcaggctttagactgcttaaagtttagaaatatgttgtaccaacaggggaacccaaggctgatatcaacctgaactctaaatgtctgtgatcaggacacaatagaagaagtagccaactatcattgttattttcttgagacaagctcttcctatgtagtttaagctagctttaagctcattatctgtctccctcaagctctccagtattaggactgcaaaactgtactaccaaacccagctttaaaagttatttcacagagtctaggtcataaacagctataaaatgcctcagacaatgtcaaatttggaaggtttcccggaaatatgtatttttttcttttctcacttcctttcttcttgtgactccttaccatatttagggggatcactgaaagcaaattttctggaaacaataattgtaggatcatggaaatgactgtatcacagctcagtagtgggattgtagacatatcctctgatagtttgtataaggaggcattaaatcatattccctgttcagcctcaaacggttaatgcaagcccactttccccataggcaaactgagctctgcacagtgaaccattgggcagtagcatacactgagcaaactgtatgacctatgacctcaggaccctgaaaagtaaacaatcgcagaaaatagaaacaaaatgacagcttgacagaataacccttcagtgatgctgaggttttaactttgtgtttacttgattatttgggaatggtatcctgtgatgaagtccaggctagcttcaaactcaagatgcttctggctcagccccaaatgctaggattatgagcacgtgccactatgccacaccctatgcttctgttttctcaaaaccatagtctctctctctctctctctctctctctctctctctctctctctctctctctctctctccctctctccctctccctctctctctctctctcctcaagacagtcaaagagtggtgttgaatgctggtgagaacaggacacattgctggggtaagggtggagcagggtagagcaggggtggggtcgaaatcgaggaagatcagaataagcaggagaaccttctgagctggaaggttttgtttcctttagttctttccttttcacttgccaagtccccaggtgactgcttcagtcacaaggctgcctccatgaaaccccaggagaggggaaagaagccttctctcaggtcagaaggactttgatttcaagagagtagagagaatcctgttgctctttctcttcttccctcaactcgctccacctaccttccctgtttgctctttgggagacagggtctgctgcagtatcccggtccagccttgaacttgcagcagttcttgccccagctttccgaagacgcagaaaggccgtgagtcttgctctgttgctgtttttctttctctaatgcttggccccaaagtaaatggaattcttagaaagaaagtactcatccagtcagggaagccaaagccctggcttctcagtagattattttctactgatggatcatttgacattgatagagagtagacacttgggaggcaagaaagtactggggaatgtttcagggagagttatggcttatgaaaatgagccagaagagcaagtaaactctggagctcggcaactggctgtactttgtgaccataagcaggagacggagactctgcaactgaagtacaagagagagcacagcttaagccccatactggtgacctgtgtgaccccatgctggtgatttggcaattgtggaacagagctaaaagaggaactgaaatgaaaaccgcagcctgaagatagcatttttgaacttgtagcataaacatgacctgcttttaatatttattaaaacgaaagtataaactgccacaaatagaaacaacacccagagtatcataaaatagttttctaaggaaaaagataagatcaaaaactaagtataaagaaaaccaggaaaacattgccatgtcacgaggggaagcacaatatatagtagatccaaaatgacacagatgctagaattattagggaaaaaaatcaaacatctataaaagttatgtttcaataagtaatggcaaaatcctttgactgtaaagacagaaagaaagctactcacacagagagaagatagaagaactaaatggaaaatttacattcaaactacacagtctacaagggcaaacacctggatgtgtttcaagggcctgctgggattgagaacagcaagaggaagtgaacttaaagatagagcaacagaagccatgaaacctataaacaggaagaaaaagactgggacaaacaagaacaggggacccgtgggacaacggcaaatgtcaggtatccatgaagaagaggtaaaggccacgcatgtaaacaagaggaagagtgggtggatggaactaaacttaataaaggtcagaaacttagatgctagaagcacagtaaggccccaaacaatataaacttgaatcaaaagaagcctggacccatcagaacaaaattaccaaaacataaagacacagcaatatcaaattaccttggttttttgtttgtttgtttgcttgcttgcttgtttttatcagaggaaacaattcaaataactgggcttctaatcagaaacagtgatggctggaagttagtggaattttaaatgtgtttacaagacaaaacaattgcatctagatccaggaaagaggtattggggcagagaggaaagcagacattctcagatgagagggctctggggatcactgccttagaaaaactcatgggatgttcttcgattaaagaggcgtggttgtgagggagaacagaaatgaaaatatcttgacatatttagtggacagctttttcattaggttttttaatttgaaagatgatgtaacaccgagacaactatcagtatggagagatgttatagattaaactgtgtctgttcaaaatttttatattaaaacactgagccctgagtagttcagaaatagagcttgcttgaaggtagggcctatacaaaaggaatctagttaaaatgatttcatgagggcagaccttgtacttaagagttggccagtgtccttaaaacaaggcacaatttgggcacagagacacatgaaggaaagatgatatgaggagacaaaggtgaggtggctcaggaatggtcatggtcagagtccgagctcagcatgcaggaggcacgggtcctgctgtacagcgaatttgaccttctagcttctgcagtgataaacaaaacagcattcctattttacttctgttctctaagcacctccagcgtggcaattagagcaaagtgattcaagattcacacatgatgtaatccaagtagattgtgagaaactagtgtagatcgtgtagaatgttataacattataatccccagagcagctagtttataagggaggtgattgaccaaaaagatttaacaggcagactaaatagaataccaaaagacttgcaagtaacttaaaagaagccaaagtgggaatcaggaaacagaggaatacagataagtgacagacataactcaagagataccgataattgtattaaatatgaatgattgagtagcccagagcagtcccttttcagcgccccactcaagcttctatgatttcatggcccacagaaagtagagatagaatagaaaaggtagcttcttttaaaaaataagaaaattaaactactagatgatagagatcgtcatggataaaggaaggcagactctgtggttacacacacacacacacacacacacacacacacacacacacacacacacatccatttcaaacataagcacagagataaatggctacaaaaagttactgctgaagaagaaaggatcggctgatgccagatgaatgtaggcttcagaacagggtgtgagaaacatagtaatgtcagttcactcaggagacagaagagtctgctgtgtgtgtgcctgacatcagatctgtaaacacactgatagaactgaagggggaaatggaaacccacagctgcagttggaggcttcgggattcttctttcaatgtttggaagaccaagaattcaaagcgtcggggaagacacagacatcccctgtgggtctgattgacattcataaggaactcagcccagggtaccagaacagacactttttcaaagtgatattaaacatccacaaagagaccgtatcctgggtcccacagcaaaccttaacagcgttgttaagtcagaagtcacactctgcatgttctgtgatcttactggaattatgctagaggtcaaaggaactgctctgtctgcaattcttagaaagcaaacagtgtcttggtgctccctgggcccaggaggaagtctcaaggagagctggtaaacattttgctgtgtgtaacaaacgaaagtgtaatttcatgatttgtgggatataagcaaggcgcagtagtacatacctatacctcagcctccagagaggccgaggcaggggaaatccttcaacccaaggtcagcctaggcagctttagtcagacagagtctgtaaaaagagaaaagtataacagagaagagagaatgtgtacaaggccctgggttcaatcgctagcagtcgaagctttttaaaatgacttgggatataatctatgctcctctgtaaaagggtctggggctgaagcctgggggtaaaacccttgcagggtagcacgcctgggctaagcaatcccctaatttcaatccccagatttaaaattttttaaagttctaaagaaacggcaagataagctcacagcaataacaaaggaaggtgtaatggacgtgaagcggctgtgtcagtaagaattaagaacaagaaagcatcctccaggtgtggtagctcatactggaaacctcagccccggggaaggggctggtcatgagttcaaactcagtctgaggtacatgagacactgttccccaaaaccaagcaaaaacaaaaatgctaataacatcataaagcttaggaaaagggtaacgaacactaaaaaccaagggagtaataagagacgagcactgccatcaggagggacaactgtccttagatgtcacaggtgatcagagactactaaagatatacaaaacaagttctgtgtgtgaaaatccaacaaccttcgtgaaatagctgattacttagaagatacagatcttcaaatctcacccaagaagaaatcctcctctatctatcagaaaaaaacgaaattcgctgtttacaaatcctacaaggaaaactctaagcccagattatttaaaggacagatgtcaattttaatattcatttccaaaaagggctgagactgtggcatcaattcacttaatgatcccagcataagagaccttattagaaaactcagaaacatagatttttaaaaaatcttcaaaattaaccaatccaataatatataaaaagagtaatataatatacctggccagctatggcttatttaaagactgcaaggtcacttcagtagattctaattgctctaaccctgagctggagaggttaactgggtggaaaaaagcacttgtgcaagcaggaggacctgagttcagacgccgaggacccacggtaaaaaaaaaaaaaaaaaaaaaaaaaaaaagtcagacgaggctacatgaagcttataaacttagtgttttagggacaagggggtgggcagaggaagagataggtgagcactggggcttgctggcttcatgtttcatcgagtgacatatgtcaaaggaataagttacagagttgacagaacagagggccttctttctctggcctctgcaggcacatcagcccacgcagtcacatacacaccacttaaacccacacaaaaccatattaacaaactaagggggaaaactcaaatgatatcagttgatgtccaaaaggtatttgacgtgactctgtattcataaagaagtaaaggaaatcaagtaaaaagggactctgggtgaagtgagaaatgcttagtgaagggccgtgaacacactgaactcacacatgctcattatatatgcatagaaataataaagacaattcatgaatggtatggtccagaaaggaaagaactgataaaatatcttttgtcaaaaaaaattttttttaaaatgttctatcaaggaaagccctaagagactacaaagattaaatgcagtttggagatgtgtgctgaaagctcacttgaaaaacagctagtgttcacaatgtgtgataaattctcgaagctcagccatcaagcaaaaacctaaaataatcattttcgccaagcatgggggcacatgcctgttatcccagcactggagaggcagaggcagcgtcctcctcctccttcctcctccccctcctcctcctactactcctactcctcagctatagaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccctagagcattcagacaattctcttgtctctgcttcccatcttgctataggagtgctgggttataagtgtgcatcattgcatctggcatttttttttaaaaaaaaatgtatgctctaggaattaaactcatgtcaccgtgcgtgtatggtgaatacttttatgtgatgaaccatctcataagccaaagcaaatgattaattttaaaatagtcatcttggagaagctcatgtgtgtgtccaatgtattttgataatgctcaccccttactctcctcacccacttttcccagaaccacccactctcatgctcaaccagttttgttttgtgggtgcttgttcgtttaacaacgccccaagttcaagctgtgctgtccatctacaaagtcctgagtgtaggaccatgcactggatagtggcagcccgattaagggccagacccttaaagaagactgattttgcctccctacaaagcaactaactgttggtacctcccactcctcctgagccccattcccattccatgctgaaacactgactggcttaggtaggtaaccacagctgctgtaagtttatgggtgccactttccagaaaatgcttttattctggtcctttcctacctctggttcttatcatttttctgtccctcttccatgatggtccctgtcttagtcactgttctattgttctgaagaggcatcatgaccaagacaacttttataaaaaataaaaaaaaaattaaaaacgcatgtaactgggggctggcttgctcacggtttcagaatttagtccattgtcattgtggcaaggagcatggcagcatgcatggcactcgaaaagcagctgagggctacatcccagtcttcaggtaagcaggcaggcagagagaatgagagacactggcataggaacatacttctccaacacgtacatcagccacatgctccacacttacgtcagtaaagtcattcttctcaaataatgccactccctggtgcctaagcatgcaaatatatgagtttatgggggccattcttagtcaagccactatattctacttcctggcccccatcaacttattgccatatcataatgcaaaatgcatttaatccatgttcaaaggccccatagacttttacggtcccaacatggtttaaaactcctaagtctcttctgcgattcataaccacctttaactgtaacccactataaaatcaaaatcaaactgcaaatcacaaacttccaacatatggtggtacagactatccatgaccatcccaaaggagaggaaagggaccatggtgaggagacagcagactaaagaatacaagacctaaaagcagctgggcttcatcctcacggcttcacacgatggcctctctggatcaccatgcgggaacacccctgatacatgcctggcctcagctgctttccctagctgcagcaggagatcccacaaccctttcttatatcctgaagctgccacgttctgctgcgaggtaggatggacctcggcccctccttcgactgtctgtacctgctttctgttgttgctctctatcacttctgaagctcccctctgattcctttagagttggaagcttacttgaatggggtcttgccctgaggtcaccactccctttattccaactagcatcagacttttctttaagctttttatcttcttgagcctaggactggatccccctcacctttccttctgattttctccttatgctgtgcattcccacagaattctctttgtcttctatagatggaaacagcctagatacccaccagctgatgaatggatagtgaactttgtggtgtagctggatcacgtggtagatctatttctagcacattgatttccacggtggctataccactataagggttccctgttgaccacatcattgccaacatctatctgtcctcttactctgagccattcttactgtggtgacaagaaatctcaatatagttgtaatttgcatttccctgacagctttttagacagtttttagaaccatctcttaatcatttgcatttcttctgagaattctctgttcagttctgtggccctctttttgattttttttttttgagttttgtctgtttgttttgttgttggtggtggtggtagtggtttttgtttgtttatttgtttgattgtttgtgggcggagagagcaggattccagggagacttttagacagcaaatgagccatggtaaggtggttagttgcaggagccacaatggcactaagagttcgcagcacagcattgctgtcagggtgaacagcatccttccgtgttgaagttaatactgcttagccaccctggaagcagtttggaagtagctttaaacttcttatatggtctagcatttccacttttggacatttgctttttaggaattcaagtctttattcacataaaactataggacaacccacatgccacaagaaaggatacacaaactgtgaaaccataagttgaagtctgtgatcctctgctctaagcttcatgagtgctgggatcacaggtctgtcgctatgcctaacttagttttatcactttaaatgctaacgacaattttaccaatatttaaatcttgcttaggttaacatacagtttatctgcttccaagcccatactgtagtaactaaatctccagatagaacatttttatgaattatgccttctgatttatagtaagagctattatgacatgccagatgaataaatcttaaagcaagtgagaaaacgcagtttcaaaaggttataaaccttatgatgtggattgtatggcaattaaaaacacaaatccataggaatgaaacacagaccagctatagttaagagatgagaggttggtaggcaataaaacctaattgaagaaagttttggggagttattctgactgagactcacacaaatctgctcgtggctatgagcccatgggactgtgtcccacagagatgaaagcagttgagtctaagtatatttaaaaacgtaaaggacaaagggcaaacttgatacgttttaagctagtatataaacattagatttcattatgacatttcatccacgtggactgctatttttggctcatgctcacccatattgtcctctgactacagttaggaaaacatgattattctttaaaaaggaaaaattaaagttatattttttttttctttagtggtggggaaggggggtcagaagacagcctgcaccagtctgttctcttttacggtgtaagtcccagggattaaactcagcttggcaccatgtttacagacataatgattctaaaaaggacttggggctaagggggacacagactgcttatcctccctcacatggcaaagttgtggctcaccttcagacaggagtcatctggtctgtgtttttatgatttcactgagtaatagagaagccagtttcagagataaattttcatggcaataatcactcaaggaaggcccttgacttcctgttgcatggcgacagctacacagaagggacagtgctgtgggatttaagctctggttctaccaccatttgtcaaacccaacacttaaggatttcatgtgtcttatgattagacacgatggactaatttgccaatacctatctttcaccatgtggtccctgaagcctcccaatgtgccttgttattgatgttttcttcttttctatatccttgtcgatattatctagatttcttgagtctcttaaatgttttttttttttagtaagagtggcccaaggttaaaatatgagttcttatggtcagtgctctttttgctttctgtgacatattgtttatggagtagcatagagctcaagtgggggtagaaaatggagggtagaggggtggggtgtgggacagaatgacacagagagtaagggacaggatggcacagatgactagaggtaaaataattgtcctcagaattctagtttgtaggaagaaaaaaataattataataccaggtagcaaatgctatggatttaagatagagacacgatgccttctggactagtgaaaactatttttaaagaccatatggtatggcagaattttccctgtccaatctatttaaatattagtgcagcaggaggcctatgattggacagaaaaacagaggcagagagtgagtcaagtagacagacaggatgattcagagacaagcgaaccagagctggcgatgccgcaagggctagctagagacagaggtggcaggaccacaacagggcagaaagttgccggcagtagcacaagaacatgctggtcattttttaaatatttcccacaacaatgtagagtctgtccagaaaaggaaaaaaggtgctgagtgtagacactgtagtttatgatgggacctagtagcatacacctggcacactacagcactcgggagcacaggcaggagaattggcaaaggttcaaggccaggtctacatggaaaattccaggcccttgtgagctatatatggagaccctatagaaaatggattttagggagagagtctacagctcagcctaagggctggggcaggggacattatgaggaaagcaggaaagaagtgagggacccagacagaactacagtgtctgcaatgataaacagtctgggggttttccagaaactttggggatcccggtgaagtctagtgaggaagacagccatcattagtcagcagtctatgagtccatattgtgggaaaggcaaaaacagaaagacattggtttggagactaatttaaagctattatagctacccaggaaataatggtgaatggtgccagaaagtgaaatagaactcgaatgaaagaaacattaagtaactggaagcacagggtcttgtagaagagctggagtgtggggtgttgtgtacaatgcaagcctttaatcccagcactcagaatgcagaggcaggccaacctctgtgagttctaggccagcctggtctacaaagtaaataccaggacagccagggctatacagggaagctctgtctcgaaaaaccaaacaaaaacaaaaacaaacaaaaaaagatctagaagagtggatatttatttaggaggtattcaaactttcagcacactgctgttggtgaaagtaagctacgattccattacgtaagcagctcgttattattgtagagaaagagacaaaaaatgtctcattaagttatggaagtttatgaactaccatttgtgctttggagagagtgatggacagacagtaccctggctcaggaggcggagcctcgcagtagggaaagccactgtgggcttgagaagggatagagctgcttgactgggaattgaagatctggggctcaggggtcgcgtgcttgccacacaagcactaggacctactttagcatctatcacccgtgtgaagcctgggcttggtcatacacacctgtaatcccagtactagggagtcagatacagatggctcattggggctggctgaccagccagcctagccaattagtgagctccagatcagaaaaaccctgtcccaaaaagttcagttgagtggtggaggaagatgcaagtgtctacctctggcttccacatgcacatgctcacaggtgcacacacacgcacacacacacacacacacacacacacacacacacagaggaactgaagcaacaagaagatgctggtgtcaggaacaaggacaaagacatgggaccttttaaggacagtgacagtgttttcaggaaagaaatacagatgtttgttcatgttctatttaactatctaactaaatatcaggtctagagaaccaacctgcaggtcaaggaagccaaattctctttagtattaatatctatccaccatcaggtgaatcacagtgacaaatctgttttttctgactcaatcattttctgtctcaacaccactgtcagtatgatgtggaaattaacaagttaggggatttttagacacaagtttggtttttgagaaaggtggtggtttggagtttgatttgggacatgcccagcgttggttactagcacatttaaattctaaatcttgagctaaggatgtaggaccatggtagagcccttacctttcatgcataagaaaagaagaaaagaaaaggaaagaaaagaagaagaaaaggaaagagaagaagaagaaaagaaaagaaaagaaaaaagagaagaagaaaagaaaagaaaaaagaaaagaagacagaagaaaagaaaagggaaggaaggaaaatggaagaaaaggaaaggaaaggaaaggaaaggaagcaggtttcaggaagggttataattgaggatacttgctcttctgtaagcagtgaaattttaaaaatgtctcgtcttgccttttgcttgccccccttctctctgtgtacacacatacacatgtatgagggtgcagcatgtacatgtatgtgaccatggatgccatggtcaaccttgagtgtcattcttcaggtgccatccacctgtgattttgagtcagtctgtcattgctgggctgggcagcaagccctaaggataacggatgctgttttaatggttttgaatgaagagacttttcagacattattctgaaagctggagagagaccctggggccttgcctgtctgtagtttgagcctatgcaggctgggtggtgtgcagtctttgcttccttctacaggaaatgaaggcagtgatagtaacagtctcatgaagcattgataagttcatatcaagcacttagtataacgactaccgactactgagtagtagccactcagtcttcattccggttgatattcagtcagactgggcaattactgcttatgtgctattcctctgcttactcatggctcctctcacttaattccagtcactacctaagtgtacttaaaaaacaaaagacatgcacttcctcaactggttagagacgatagcccagatatggtctttatttttcttaagtatgtgtgtgtgtgtggggggggggtggaataaattgggatgaaagaataaaccaaaatgttccctgttgctgccacacacactggagaatgaactgtctcatctgggaacactcctatttcttaggtacattaaggaaacaaacaccaaaaatgacccaaatcagctcaacaatcttatcaggaaaaactctgacgtggtgacatggaccccacgacctggcgctgtcctcgaccttggcaggatgctgaaggacccaacagacaggttcggcttcaatatttatgggggataaaaacaccttatgtaattttttaatattatgataaagaactctcctcctgacttgccacaggtccctactcggtactaatgttaagttttgtccagtaacatgctaagttccttacctggtaaggcctccatctcacttttaaacgtagaaatcttagaaccaggcagcctaccacacacctgtaatcccaacacttaggaggctggggcagaaggatcaggccaaagtgtactatttgagaccctgacttaagaaaaataaatatgtcttactattgaaataaaatagattaataattatcactcaagtcagacagctttctcaagcatttcatcctttataacagctcaagtgccttcatcaccccaaaaccttattagagagtaaagggtaaggggctagagaaatggctccgtagttcaaagcatccgctgctaccacagaggaccagagttcaatgccggcatccatgttgggtggctctgaaagctagttttcacctcagtgcaagtatggcctataaaattagcagcacttttcacaatatcaaacagggaaacacaatcccaaaagagctaacattgactcaagaggcctgcagctttgtaagtacacagcctgagccacacagtcataaatttctcaccacataaagaagtgcagagtttacaggacgtgaactgcgatccttctgccatttgcacctgcaatttaactttcaaatcacaattttcaatttgcaatccactgactggccgttgaaccaaggtcagtcaaaatattttcaatcaaaagtgaaattcacaattgccagtagataataaaaactaagtatatagtatatagtacatagtacatagtacatagtacatagtacatagtacatagtatatagtataaagggttttatttctggaataactttacaacctggtagaaatagttcttagctgggagtgatagttcacatctataatcccaacacttcaaaaggcaggaggattaccaaaagttcaaagccagcctggtttgtttctgggttgcagagtgagaccctgttttcccactctatccccacatgaaatagtttttacagaaattatggcaaaatattggaaatctctctctttattgctgacaagcaaatccttctaaattatgaaagttaaaattgcttaaaattctttaagaggtcccaagtgctccagtatggaagagtaaagatgtttcttgattgtttcagttaatactcatccttcaagagctgtccttcttcttcagcatcttcctaagtctcctgaattatctttgtgcaggcctctcatactgtgtcttacagcatgcggctatactgtcacccttacagacatcagagtcaccaatgaccttgataaatgcagatcctgagctcccctcagggatatgggggagacaacaggtgtgagagtcacaggagagcattctgggaaacaagaaccaatatggtggcatctcagtgctaacatacagtaaagccaccatgtactgccttgtgaaggaagaagagacaagaaatctaggactgtggtcatggaaactcaaaatagttggcatttagccagatcttagggacgagtagacaaatacaggagagacagaacaaggaagaagaggggaatagaagaagagatggggaaaggatgggagggagggcgagaatgacattttctagtcagaggccatggcctggctggggaagaaaagaacattgactaaagataaagttaggacatgaatactttgatccatagatgactcattgagaccttttggttctgggtgccagaagtacagaggacacagccaggaagaagccttggtcctcagggagccctccaggcctgaattcagagctgatgagtggaggcaggaggagacaaggataccacatggaggccagggtcagcagggcctcctagctcagggctttgaacctgtcctgtaggtaaggagagccacagaaaatgacagagcaaaggaggatcagtcttgagctgtgcttccagaaacacctcagctttgtcaggaagaatgctctagagaagcagctaaaactaggcctctgcagtcaggaggtttgggggaaagctatggcttctcacaggaagagatcccaggcaaggagctagaggagactgggtatgtatttcagaagtgacaccaaagggcctctgtaaccttggagctatgagagactcaaagtgaagctttgagacgacaggtgcctactatcgcttgcaaatatttaatagacgcgggtatgctcgcttccttagacgtttccttgtttacttcataccatgttactttctcagaacccaagagtccacactccatctcctcaggatgaacagagcttcaggactgtttgtacagctaactggattgaaggataaaaaatacacatctgtctgtgagccagagtttgattaaaaccagagcacaatatatctaaggcagaaaacactataggtgaaagtccatttgtatgctgaaatatttgttgggtaccacatggcctgacttttattgggggatgtaaacacacatttgttcaacccagaaggacatattaacagaccaaagaaccagaaccacccaagtacaacctggtgaaccagtgagttcattgggcccactttatagggacaggactggatcaaaggcagctcattacagaaaattccaaatcggatagcccccactcccagtaggaagtgtttcgattcccctccattcttttaccaaattcctctcctaatcaggatgcagaagcctctgagtgccaacatccacaaagtcggtccaagcagatcatattcaacatctccgtcacctagtaattgggagcaaaagggtcccaatataataccagtaatatcagggatcttgtgcctttcgatctccagatatatacaagactagttaacgaaatcgactcgggagccttgcctgttgcatagtgtataggaaacagtgtgccttaggctaggaaaggactctgaaaactatcccagtgtctcagtgctgttttgaccgacccgcctcatctttgtgtctttaagcaagggcattgtggagcctccagaggggacaaagatttacaaggattcctgggactttggcccgtacctggagatcttgaattctgctgtcagagatgaaatcttctgtcattcatcctggattaaagagtacttcacgtgggctggatttaagaattacaacctggtggtcagggtatgcctccgctctcttgtagtctggagatctttggaaccccctagtttctagtttgttctctaattagcacttgggaagctgtataaactgtccagcagagtgcaggcaggccatgtgataaataactcggaaatggaaggggccattaagcacagctcagtttagcttttgtagtattttctctctcctatcacaatgaattcttctttttaaatcacagtataaaacaggtgccttgtagcgttgtcatctatcctttggcttggttgggtcttccatctcctggaaccctgtcctctgtacccttctactcccggtgttccctgtccacgcgtgctttattaacctctctaccctgctcccttgtggctgccttgtacattgtctgacatgtcaggagtgcttaactgtggggctagacagtggactcacacagaggggtatcaatgaacagtgtgaggctgaagccaccaaatcctatctgcaacggtgctgaggagcaaatggcataaagcaggagcaagcatgggtgctgaacaggaattagccccagaagaacatgccaattagcatctttggcattcatgtggtgggtaagctgaggccggcagccattgagggtcagtgctagagtcgctgatgggacacctacaggggctgaagccaaaggcagctggtgactggagaagttactcagcagacttttctctaaggaaacaaagtttaatttactcagctggcactccctgtggccagcaaaaaaactatgaactcttttaatttcttggggtcagcaagaaagagaaggaaagagaaaacacacgcgcacacacaccaagtagatgaagcaaaaggcaaagtccaataactttatacacacaaatataaacaagcatgcatgcgctcgtatatacacacatacatacatgcatgcagacctacagacagacatatacacgttcacatagaatggttaaagcaaagctccagcaaagcaagcaggctccaagcatgtcacacatctacatgcatgcatatatacacacaattggtgggtggagcaagctccaacacacacccagacaagcttttcatatgtacatacatatacagagttgatgagtggaaggaacaatgtcccaacatccattcacacaaactttacacatatacatacatacatgcgtacacacatacacacacacatagttgatggatgaaagggatgatggtccagcccgcatacgttattctttcttccatagtttatataccccagctaaattttgcaagcagtataaaactacactgtgattacatttctgtttccttctagtgaatgattatgaaaaacactgtgttccccaatatctttataagaaataacattacataatacaagtaaagaaaacaaattatttctccaaacccacatacatttgtaactgagcaacttgttatagactaacaaagtataagcgccaggcgtggtggtgcacgcctttaatcccagcacttgggaggcagaggcaggtggatttctgagtacgaggtcagcctggtctacaaagtgagttccaggacagccagggctatccagagaaaccctgccttgataaaaacaaaaacaaaaacaaaaacaaaaaagcaagcaagcaagatagtttttctcagtcagtttctcttactggcaggcaacaatttgcattttcaaaaagggagagattcttttattatttatctttaaaagtaatcttgtaagaatctttaaaaatcacaactctaaacttttatataaaaatcagtcatatctaccttaaatcctcagattacatatctactcatcagaaagacttaataaatcattgcaggaagctgagggcaaaaatgaggataagaaaaccatcaccagtccagcctcagtgagagtcgtgtcagccagggctgccattgttcttgttccctgacctcgaaacgcctcttgcttaactcttaagagtgtgcttatctgaacttcaaatggtcccctaaggttttctacatcagagacagtagcaaaaacatctcaacctagctttcccaacaagtttatttttccaaatgttttctaagggtggtggtgggcatcgtcactgctgactatctatgtctctacattctttcctagggtggtaactgaatcattaatctgctctggcaacaatgcctgaaagagatcaagcattattactgtgagtgccagagatactgaggggccagaagccctctgaagttttcatataattcttagatgaaaagagacgtgagggcagcaagcagagcagaactccataacagcatgaagtcctcagggcacgtggtcctcagggtcatgccacccgaggctcactcatgtgactgtggtagccagcgggccacattccatgatttctaaagccacttgtcattccttcttgcatggccctcagcaatcacacatgtgcagagcagcaacccaggagctcaggctgtatgcttctcaaggcacgccaaaagcagagcaggctggagatgcatctctgtgtagagctcatgccttgtatgcaggaggccctggcttcagtacctaggatgccaacaatcaaacttagcagaagagggatacaagaggaagaagaggcctggggtaggcagtggttagggcaatggatcactggtgacaacttacttacacctggtgcctggggttgtacaagcagcagtcttagataacagtaggatgtgggcagcactcacaggcaccaacaggtactggctgctctcaggagaggaccaatccccagtttgctgtgcagcccctgagcatcaataccaggtcacacttgctgtattccaaagtcctggttctcgagaaacatgcttttcatgtcaggctgtcagtgttcatccctgggcaatgatgaactaaacactgtgtgagcgtgtgcgcattggtgaaagatgccagctctccccacatgccccctttgtgggatgagttatttcaagatgagatactttctatatttgaggcattcaaaccttcttttaatgacataaaagaataagagttataagaccattgttttaaataatataaaatggtggtacttagattaactctcaactatttgtaaggaaatcatctttgaaacacaaagccttgggaaactaaatgatattttcactttgggtaatcaccttgaaagtgatgtctttagactttttgatgactatatttctttaaaattttaaattacatttatgtatgttggcaggtaggtgtgtgtgtgtgtgtgtgtgtgtgtgtgtatttgtgtgtatttgtgtgtatttgtgtgtatgtgtgtttgtgctagagtgagtgtatggaggtcagagaacaactcgtgggagtcaggtccctccttccaccatgtgagttccaggcactggactcgtgtggccagccttggtggcaagcacctttacctgctgagctgtctcactggcccaatgaatgtatatctatctgtttagttgctatatgatgtgagacacatattccacattttatgttcccctatctgaaaacgtctggtgcttcttgctgtcacgtggctaataacgctctgtgctactgaagttcgagcagtgagaggaagcagttttgctgatgtggaagaatgtaacgctatcagctcaggagagagactggaatagagggagggggaaagtagtgagggagggacgaagatgacagggtatttcaattcactgctattcttttaagtgtttaagatttccatattcttagaatttcttaaagacctccaccacttgatgaatattcttccatttactgccttgcaatttgcacagatgattgaaacagatgaagatttcagcccttttcctggagggtacgactatctggtggactttctagatttatcctttccgaaagaaagacccagccgggagcatccttatgaagaagtgagtacccccccccccgtggggatcccttcctcttcctccctctccttttcttgcacactgtcctctctccttcccctcccttctcttcctgtctttattactattccttccttcctccctttccacctcacttccttctgttgactcagaaacacagctcaaaataagttaagacatgatttacccttaaaccagatatgagtgaccatgacctagggacgtgagtaaggattgctccaggttccacatgctgcattgtggagaggatttaggaagtaaagtcttaagggatttcccaaaaggaacatcaggtgggcaggtcacagcaaatcggggaatgctccattacagtcttcacaggctctctgatgatactcttagctttggggttgatggaaacttgtggtctgctaagttgatgtattccaaaggttttttttctgacaggcaagggaatgttggctcagacacagaggtggctgatgggtggctgttaaaggagctgaagacggcctaggatggttttgtctatggtttacatctctgcatcaccatgaagttctagtcagccaaccagcctttgagagttcttacaactggggtggttttcttcctgggtacttcatggactctttggtgtccaggagaacctgtgagaagacctttgctatagtcaagacatttccagagttctcctaagctaattgtcaaaagtaaaactgatccaattaaaagttctatcactccaaggtgcactgggagagcacaaaaggactaatcaacttggattctgcctctggggccttcaaaatcgtgaagaatcgtcatttcttaaacctctacaagttatagtagagatcccacaacgtgtgcttaagtcccagtgaagtcagaggcctctctgagaatcctgatctttatccctcagcaaaggcccactccagtgagtggctacttaagccttaggcaacagacataatttatcccatcacttgcacagcaatggacataaaaatgagtctaaatggtttatatacctcaaatacggagctaaggagctagccaaaatctgaaggtaaatgtcaaaccaggctacacagaaaagcaaatggatcaatcgtgtgagttttcatggcccataaccatgcaggcaatgcaaatggttcaaccaagcttccaaaagagcagttctttgaaatgtagctgtctaacacattagggacaggagcacaaaacaaaccaaggactgaaccctgagagtgccccaggaactccacataccggaaaacccaacagatagaatgttcttcacaaacaaggcctgaagctgagcacccttttcctgtgtcggctcaatatgtgttcacaggcaactgatccccacgtcagagaatgaagaaagctccctgctgggaatctacctccttccagccagtgcattagtgagccacggggttgcttcctggctggcttttccaaagccgttgtccgttgacttagattcatttaaccccagcacttaatgaggaattagaaaacaaagtcacagaaatggaggtttgtttctaagcccggccaagctggaccttatcttcacagtgttgcagttttacacagaccatgagaccaagccggtacatgcacacgttcacctaagttgtcagaaccatacagactctctttgtacaaggcaaattcctcctggacaccaggacctcaggttatccgttccctcggcaccggagaacagaggaaatcttagtagtctggcaatagcggagtctcatctccatctctaagggtgagagtctctggagagggagttagtcaatgtggacatgtttcatgtgactccagtttccggcgagtcccttggcgtgaccacgtgatgtccgggtggtgtggtggggattccctaatgactttaacctcctgatttaaggcaaccatgctttttggcaggctggacacacacacacacacacacacttgctgccatgaacacagaggcaggtggcaggtcacctgctgcttttggcaatagtatcatttattgaccacctagtgtataacctcatgtttctggtcatagaattacttgttttccctacagtcctatgaggaatatcacctttaatctccattttatagatgaagaaactgaggcagtagttataagctcgaccctggatttgagctgtggatttgcccagcttctcatctgcaccctgctttcccgccactctgtcccagtggctcttggctccctccttctgttctcagcctgtgacctgcctccaggagacttctccccttctctctttcactctgcactcctgtcagcgtggtagctactttttctaaggataggagggaatggactcccaaaccttgccagggccccctgagagctgctgtgtttccatttcagatccatagccgggtggatgtcatcaggtacgtggtgaagaacggcctgctgtgggatgatctgtatattggattccagacccgattgctgcgggaccctgatatataccatcatctgtaagcctatcctgagaatgcttgaggccacggggctgtgtgtggggaggggcatggggcacagggggttatacagggaagtgtagtcactggctgaccgtgctccccaagttagcagagatatggggctccatcttttttttttcctctgtgtttttgacaacatatcatcctgttgcccaggctaactcctgacaatctctacttcatcgtctctcataggctgggtttacatcatatctggctctcctttttaacaagaaacttgagctcagtgttctgtagactgggggtttacaggaatggcccactgtatttgtgcttgcttatactcagaaacttcacatattattaagatcatatttgggatctgagaaagatttctatctttacatgcacaaggtcagtgaaaagaatgtagtcttaccatcactactggctctctgaaaagatgaagacatttaattttgaaaagtcctattatgtaaaatgtctgggctgcagagatggttcggcaggaacgggttctgttgttaagcctgctgaccggaattcagttccagtgggacatacagtggagggaaagagatgactactgaacgttgttctctgaccactacatgcacaccaggcacacatgcatgcattctcacacacatagaaacacacacaaaataaactaattagagtagaatttttaaaaaaattagaacgtctaagtaaagccctctagcgagtgcattgaaatattcgtttacatttttttaaacttatttcttttaaaattttggtttcctttgtttggttgggttggttgagacaggccttcgttctataccccagatcagcctggaactcatttcagaacctaagctgtccccaaacctcccatgatcctccctggctcagcttccaaaatactgagataacaggtgtgagctaccacacgcagcccccaccccttagtgtcttaaaattgtattttaaaatataaagaacgtaggagtatgtgtcgtctgttatagcccttatggtttcagttgcccctcctgtgaaacctgtctgtttcctgcctctccctctgccctctctcaggatgactcttgataaagggctgtgtcttcctggcctatatctctgcatacccacacttctgtggatataacgtcttcaaaaacttgtcacctattgctgggggtgggggcagatgataccacagtgtctcagtgccacacaagtatagacaatctgcttcttaccatttgaaacagtggttggatgagtcatgtctgcatctcttggcaagtcccccatgctttcctgagttcttgtgtgtgccatttctggggctagttcagccaggccattcttcagggagcaggttcaccttcctacatctaagggggtgtggtcaccttcactaacactccaacatgatgcttttgtgcatcttgtatgagggtaactttcactaatgggaactccgtaaagtgggctcaccacaaacagacagatagctgtcctgttttaagggtctcaaaaattcagttactgaaacagcagagcaagactgtcctctggggagagctgagaccaggcaccaaagaattcctggccaagcaagaggctttgacattcaatgttcatgtctctttgctttgtttcttgcaggttttggaatcattttcagataaaactccctctaacaccacccaactggaagtcgttcctaatgcactgtgattagtctggacctggtaagtcccaggtaagcaccgtgtgggactggtagacacctagccatgtatcgtatggctttcgctctgtcacctgaattacaggaaatgtgacttccaagggatcatgaaagagagattgcatgaaaacacttaaggcataagaataaacatataaaggtatagaggtataaactagtgagctcacctgctcagagtccacaggctgcttgaaagggttgaggtgacacagtctacaaaggaaaacagatgctgttttggagagaaatcctgagtacaaaaggagagagaacaataaaaccgggaaagaaaattgctaaaagcaatggctgagacggagcctgagatcagcttttgtggcacaagtcagatttgcccttcccatagctaagcatagagtcttgttagctgtgctacaaagcttgctccaacctacatgtgatcaaaaaggccacatgctgtggaaacggtaattttcttgacccatgcatttatattcatttatcccaccagtgcccaccctctgtatttattatgtgttaatacttgcctctgcagtacagtggcaggactacagagatgacttagttgggaaagtgtttgtcatatgcgtatgggaacccaagttactcctcagcatccatacagaaaggcaggcttggtggagcatgtttgtcattccagtgctaagaagaggaagacaggcagatctctggggcttgctggccagccagcctatcctaaccagtgggttccagccaatgagatccagtctcaaaacaaggtggccatctcttaaggaagacacacctgaacggacctctgacacatgcacaagttcatgtatatacatataaagtagacagttttgtataatcgccttgatgcacagtgccacagccccactgcataattttgtacgtgatacacactcaagggagtaaagaacacatttcataactgtgagaaagtaacggacaaaatcaaccgaagaaaggaagggtttgtcttagctcacagttgggcaaacagacagtgttggggaaggcaggtcagaagcagtgactggctgccccagtcatcccaatgagaaatgaatgtttgttctttgctcacttgctctttctattcaatctaggaccccagcccagaggatggtgcctgaacattcaagatgggtctcccctgcttcgataaacctttctggaaacactttcatagacacagccataactaccattattcattggcagtgtcttttattcagagatggcaaacaatgcccccaaatcaagaatttgctcttaaatcttgaacacagcagcagtttataccaaagaagacaagtttctctcagcaatgggcaaacactacatttaagggatgttcacatatgtgcctggtgtgcattgtcgcatagacggactcagaactacttttatcggggctggtgttgtggcttggtagtatagcatgtgcttagagcatatgaggccctgggttccaacacacacacacacacacacacacacacacacacacacacacacctgtataaccctaaattcatcccatgtacactcttgtgcaaggagaaccaaggaaagccaagaatgagctctgcatgggagataaagcctaacagaaggaaaagtgagtgtcagcacagtaggaacaggaaaggaaggctaccagactccagcagcaaaaaagaagaaagctagagaagacatgtgggctgggaggaaggtggggagactagaagaaaatgggaatgagaagatgctgccggtagagagaagaatgtaaaaatggctcttgtgttctttgatagatccgtaccccaggcagctgcaggacaatgttttcagcttttcagagagctcttggcaccatctacttcccatctcactagaaccgaaatgactttgattctgttgtgaaatgtgtcaattaatgaagcccgggggtcctaagagtcttacacgcgttcgccaccggccaggaaagacgcaacaaaccggaatcttctgcggcaaaagctttattgcttacatcttcaggagcaagagagagaatggtgaaaccccgtcccttttaaggagaattatcctccgcctagaacgtgtcgctccctgattggctgcagcccattggccgagttgtcgtcatggggaaggcagagcacatggagtggagaactacccttggcacacgtgcagattatttgtttaccatttagaacacaggatgtcagcgccatcttgtaacggtgaatgtgagggcggctccccacataagagttcaatagatctttgattgatggctcatgagaattgggctgccgactgtaagtcatcaataaattcctttactatctagagactatccataagttctgtgactctagagaaccctgactaatacaactagttaataatcttagggagaaaatatttttaaaatctatagaatattgttgtgtctggccagcagatcacaacctgggttctagcctggaaaggcattttggaaacctggaagagaagaggggctaggcggtgagagaaagaaatgcagctaagacaggcattctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcaagtatatatatatttttaacatgaacggaacctgtcacttctaggcagacaaaatgacagtatttctgggacagagtggaaaggaaatgctctgagccctgagaagatcgtgcccacctctggcagctgtgtgtgcacagcacagtaccatagtatgtcctggcttcctagaagagacgctgtgagcagtagaactccccaccaagactctggaaactcgttctgtttcattgatataactgtcattttctacccaaagcacactgtgtgcatggattcatagcaggctctgaaataagacatgttcctactcttgttattctcctttatccacactttaaggcaggcattcatctaccatccacccatccacccatccacccatccattccttccttcctctgtttatgtaatgcaagctggccttgaactccagatcctcctgccccatcctctcaagtataacgatttgtgtatagactactacaccccttttcaaagctattgcacatctctatagtaacttaagatagtttgtcctactatggcttatttttgaatatcatgggctaccgggatggctcagtgagtcaaggcttgcagccaagtctaatcctcagaaccaacatggtggaaggaaagaaacaactcctgaaaattgtcgtctgacctccacatgtgcatcttggcatgagcaagcacacatgtgctcctgtacgtgtgcacacacacacacacacacacacacacacacacacacacacaccatatcaaaaatttaaaaagaaaattgtaacagaaaagttattattagcaactgtttccctgtttgcatgaacctagattgaggatctgagagtgtggtgacagaagtgaggaggcagggacttctagagagacggccctgaggaggacacccacagacatggtgtggggagttttagtcagtttagagaaacagaaccacacgcacagggacacatataaatgagcaaaacaaacaaccctagacactaagaacccaggagtcaattcctaaggctgggtagtcacagaacagaagtctctcactgggggaatgtcctgtccagtagttcagtccacatgcagggtgcttcagtgaagaccaaaaggatctggagagctgctggtcctagcccacaaggaatactgggagagctggttctactgtcagagaaggaatcagaggcagcaacagagcacataccactctgcagcaagaggggaggtcatgtgagcaaaaggtgacctgaccttcgttctgaaaatagccccttttatttagtttccttcctaaattgtggcaagttgataccagaaccaaccacaacatagggcattcctacaagcactttgtggagtctccacagttcatatgctcagccaataaagtgaatgccatgcacacatgaagaaccgagttcagatttccagcgcccatgcaaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagtaggctagtagtcatcatttttgaagtattatactttaaaaactgacatgatttcaactggtaattatctccattaaaatgtattcctcttgtacaaataaacaccatgtaaataataagtatacaaaagtaaaataacaaatgtcgccacccatgaaaacaatgtagggttttttgttgtttactgatccaaaaaggtataaagtttatttttagaaaattatgttataagaaatataacttttaggctggtacatgccttttctcccagcactctgtgggcagaaggaggcaagtctctgtgagttccaagaacgatctaatttttatattaaaataagagaatacctaatagtgtgtacacgtggttttgtgtgtatatgcaagtttatgtgagcatgctttttctgtgtgtgtgtgtctgtgtgcgcgcatgtgatacatttagattctttccattggctagaattcctgaggctgggtaactgaactgtggcttttgctgacatcggctcagtcttccaaggcatggacaggcctgtgcgtatgaccgccctggagtctgtatttacataatttgcatatgctcctatgcctttgctgattttccatggagttccacaacactgattctgcaaagactcctccctctgctatttgcaatatagactaagttctgatcacattcttgctacgataaaatatcctgacaaaggcgacttcagagcaggaggcttgtttgtctacagtcacaagctacagttctccgtgttggaacagtgaagccaggaactggcagcagcctgtcacgtccacagtgagagtagagcgggaacaaatggatgcctgcttttgctcagcaccctcttgacatttatctgctccccgccccaaaccctgggaacagtgacacccacaataggcagatctccccacctcaattaatgggatcagaatgattgccccacagatatgcccacaggccaacctcactcttctgcacagtccctctctgagactctgtttccaggtagatctaggatgtgccaagttgacaagcagacctgaccatcacagactatttctctcttaaaataccttcagaggttgggatatagttcaacagtactacatcagtctatataagccccaggccatcccccaaaaacaccaccactgtgaatacactctctcgagtgcacacacacgtacacacgtgcacacatgcacacacgaatgtacccatgatttcctaaatgccttaagggtaatcatattttatgaaaaaaaaaaacctaacaaatactttaaaatatacagtacttataccaatcacaagacattaaattacaaaaaatataagactctgtttgacatgttattttgtttttaattaataaatgtgtttctttttagatagtatatttatttgtttgtttgtttgtttgtttatgtgtttgtgtggttgtttgtatgtgtaccacacgcatgtgcctgccgaggccagaaaatggcagcagattctacaaagctagagttacgggcagttgtgagcaactggatatgggcgctgggtatcaaacctggggtgactgcaagagcaacgagactcttaaccactgaaccatctctcaagccggatttatttactgggaggaggggccacacataccctgcagggtaagctctgtggcaggcacatctctactcagccatctctccagcaacatgtattattattttagcagtagaagaccgaagacaattgagaaaataggatagctgtccagaatgtaaagatatttactttttcctttggacacgctgaactactctaatttgagctggacaacacaccaaggcctgggaaactgcaatgagccaaagttgtcagtaggtgacagaagagcactgcacagcaccaattgagctctttgaggctgttgagctgtttgaggttattgagctatttggttgagagacttacagagaagctattctcttcaggagcacctaaggggaggaaggcttccttccagcacattccgttccaggaatcacccgtttttatggggaaccacctaaggcattcaggttacatcttgtaaaagaagagctcttgtgagggcatacgacatcttcattccttctgcctttcagattgaggataatcagatcgtatatttcttttctaaaacaagatgttggtgtgtaacccgggatgctctcagactctcagctctcttcctccctccattccacagttctgagcttataagaattacagacttacctctgattggcaagtgtctattttccctgcaaactctgagaaactttgtatagctgtatccaaagaaagaagtgttttcataatgccatagagaacagtttgagttttgcttcattagacaaagccacgtttcttcttgtcttctgggtcattgccttctcctgcctgctccttttctaattgtacatctttgggagactaggcatcaaaacaagcctgactaaggcctttatttatggatgtgctgtccagtgaatacaaaaacactagagtccctggcttagtccggttttgtcaacttgacacaaacctagacattatctgagaagatgaacctcaaatgagaaaatgcctccatcagattgcctagaggaaactctaagaacattttctccattaaatattggtttgagaggatgcagcctagtggggggggggcgtctgggtgtgtaagaaagcaggctgagcaagccatggtgggcaagccaatgagcactgttcctccatggcctctgcttcagttcctgcttccaggtccctgccttcagatcctgtactgatttccatttatttccgttccttctctagttgctcttcatggtgtcttataataggactagagaccctaagacacggggttccagagatggctcagtggttaggggaactgactatccttccaggggacttgggttcaaatcccaacatccacatggcagctcacagcgtctgtaactccaagatctgacattcctacatagacatacactcaggcaaaacaccaacacacataaaataaagtaaataagattttttttaaaaaagatgaaatagaggaaaccaagacactcctctaatgctgaaaactcttttggtttttttttttctttttatcttcctcttttctcttctcttctcttctcttctcttctcttctcttctcttctcttctcttctcttttcttctcttctcttctcttctcttctcttttttctttcttctcttttctttagaaaagaggacagtggattcttagtgtgttcccagccccagcccatggatgttcaggaagtggagtttttgctcataaaccaagctaggtggtgtggccacagatatcacactgccaaagggcacagccctgagaggccttgtgtgttagtgatcctctggtattccaaaggatgggccctgcctaatcgtctaccacagtgtatttggttatttggggatggtcctctcagtacaaatctgtgaagacctttggttcattggcacatttatggagtcttcgttcagtagctgtaattgacttgtgtatccaggccccagccagcaagagaagagcttcatttctctctcctgcataaaagaaccctaaggccacagtgagctgccttcctaaaataggtcagattcttgcaaggccaggcagcaaaatgatgtttctaagaactgcaggccaatgctttcctggaaaaattaattaaaatatcagcggcttcacaagccaagaacaagcatcgtatggccctctgggtaggaagatgctataagtattaggttcaattagactttggagtcacagtgaccaggactctgggaccattacatcagtgagtctccattgtcctccccctaccagttcaagtcctgcaaaccctggtgcatctccatggcacttatggtggatatgacatgtctgttaggaatcattgtcactactttagccttggatacagcacacagagtactcatgaagacagactggctccggcaccattacccagcaagtgtggcatctgtgtgcctgtcccagaagagacctattctgagcttagaatttccttttcccatcaaaaggacaaggcttcaaacttcagtcatgtctctcaagagtgacttgggacaggaaagagacagttgggagatagttgagtgtcccgagtaagaagaaaaggctgcactgggaaactgaaaaaaaaaataataacaataaaaggagggggtccctcccagggaattcagccggggctgtaaacttcacagagcttgttagacaaagcaaaaactgcatagaaataaaaatgcaaaccccaacttcaggagaggaagaattgtggatcgaaaggagaaaggaactgggtctccagaaaaaagcacaatccctaatctgttcacaggagcccacgctcattggcacaatcagcttggggggcggggtggcgggggtctcactgacttatgctgtaatcgctgggcagttcccaccgggcactcatggcttctggagcttgtagtgcatagacgatggattccaactttaaagggtttgacttgcaatttttaaacttcacaatggtgcataagtgtactcattctatcttcccctttcataatacttttcgatatggacactttgaagcttggctttgtattagcagttcactcaattccaggctaacgtaaccattagggaaactagaccaggctgggacattccacttgttaagtttattttgtttgtacccctgattggcctgcatatcatcatacagcctaggctggccttgaacttgcagtgatcaatcctcttgattcattgcctgagtactgagctaacag

SEQ ID NO: 656 - DNA, 1858 bp, Mus musculus
ggcagtctaaagtcatcctcgccatcctcgccttcctggtgtgattcgcagaagtagaaagaacaccagcagctgctttgaaataccctggagctggcagatgatggacaggcaagaaacagacagctgagaccctgctgaccctgtctcctgctgaagttgccaacctcaaggaagggatcaatttttttcgaaataagactactgggaaagagtacattttatacaaggagaaggaccatctaaaggcatgcaagaacctctgcaagcaccagggaggcctgttcatgaaagacatcgaggatttagatggaaggtccgttaaatgcacaaagcacaactggaagttagacgtgagcaccatgaaatatatcaaccctccagggagcttctgtcaagacgagctcgttattgaaatggatgaaaacaatgggctttccctggtagaactgaaccctcctaacccctgggactctgatcccaggtctcctgaagaattagcttttggggaagtacagataacatatctcactcatgcctgcatggacctcaagttgggagacaagcgaatggtatttgacccttggttaattggccctgcttttgcccgaggatggtggttgctacatgagcctccatctgactggttggagaggctgtgcaaagcagacctcatttatatcagccacatgcactcagaccacctgagctaccctaccctgaagcagctttcccagagacgaccagacattcccatttatgttggcgacacagaaaggcctgtgttttggaacctggatcagagtggcgtcgggttaactaacatcaacgtggttccatttggaatatggcaacaggtagacaaaagtctgcggttcatgatcttgatggacggcgttcatcctgagatggacacatgcattatcgtggagtacaaaggtcataaaatactcaacacagtggactgcaccagacccaatgggggaaggcttcctgagaaagttgctctaatgatgagtgatttcgcaggaggtgcatcaggctttccaatgactttcagtggtggaaaatttactgaggaatggaaagcccagttcattaaggctgaaagaagaaagcttctgaattacaaagctcagctggtgaaggacctgcagccccgaatctactgtccgtttgctgggtactttgtggagtctcacccatctgacaagtacattaaggaaacaaacaccaaaaatgacccaaatcagctcaacaatcttatcaggaaaaactctgacgtggtgacatggaccccacgacctggcgctgtcctcgaccttggcaggatgctgaaggacccaacagacagcaagggcattgtggagcctccagaggggacaaagatttacaaggattcctgggactttggcccgtacctggagatcttgaattctgctgtcagagatgaaatcttctgtcattcatcctggattaaagagtacttcacgtgggctggatttaagaattacaacctggtggtcaggatgattgaaacagatgaagatttcagcccttttcctggagggtacgactatctggtggactttctagatttatcctttccgaaagaaagacccagccgggagcatccttatgaagaaatccatagccgggtggatgtcatcaggtacgtggtgaagaacggcctgctgtgggatgatctgtatattggattccagacccgattgctgcgggaccctgatatataccatcatctgttttggaatcattttcagataaaactccctctaacaccacccaactggaagtcgttcctaatgcactgtgattagtctggacctggtaagtccca

SEQ ID NO: 657 - protein, 577 aa, Mus musculus
WTGKKQTAETLLTLSPAEVANLKEGINFFRNKTTGKEYILYKEKDHLKACKNLCKHQGGLFMKDIEDLDGRSVKCTKHNWKLDVSTMKYINPPGSFCQDELVIEMDENNGLSLVELNPPNPWDSDPRSPEELAFGEVQITYLTHACMDLKLGDKRMVFDPWLIGPAFARGWWLLHEPPSDWLERLCKADLIYISHMHSDHLSYPTLKQLSQRRPDIPIYVGDTERPVFWNLDQSGVGLTNINVVPFGIWQQVDKSLRFMILMDGVHPEMDTCIIVEYKGHKILNTVDCTRPNGGRLPEKVALMMSDFAGGASGFPMTFSGGKFTEEWKAQFIKAERRKLLNYKAQLVKDLQPRIYCPFAGYFVESHPSDKYIKETNTKNDPNQLNNLIRKNSDVVTWTPRPGAVLDLGRMLKDPTDSKGIVEPPEGTKIYKDSWDFGPYLEILNSAVRDEIFCHSSWIKEYFTWAGFKNYNLVVRMIETDEDFSPFPGGYDYLVDFLDLSFPKERPSREHPYEEIHSRVDVIRYVVKNGLLWDDLYIGFQTRLLRDPDIYHHLFWNHFQIKLPLTPPNWKSFLMHCD

SEQ ID NO: 658 - DNA, 105219 bp, Homo sapiens
  misc_feature (1)...(105219): n = A,T,C or G
agccaagacttgctcttttttgattaatgaattcagggtatatcttttcccctttcttttactttcaatccacctgtgtaattgaagttgaagtgaatttcttatagatagcctattgttggaacatgtttttatttttatcccctctgcaaatttctgtcttttaattcgtgtatttagaccacttacatttaagggaattgttgatatgttagggcttatatctgccccactactttgttttctttttgtttcctctatttcctgtccctctgtctctcttttttgtaccttcctatgggttgattgaacatgtttcaggattcaatcttaatttatttattttatgtttttaagttgtaagagggaggatctaggaggagtggggcttaccatcatggctggagctggaagttgttgagtaattattttttattgtcataaaatgtacataacacaaactttatcaccttagccattctaaagtgtgcaatcagtggctgtgtagggagaaactctctcaaactgtgtctttactctcacactacaacaatcaacacagaaggcttctatgaccaaatatgttgggggttagggggttggttgccacacttcaggcagtggacaccagccaaatgtcctccaattcgattcttacactatctacctagagatggcgtcagatcccatgggttgggtctcagtccccaagactgtctcctctacaccagttgcaagtctgggcctctgaaacttctgaccaactagcttgaagttgagattcccaggaatcccctctttgggtttgattaattttctggagcagctcacagaattcagggaaacacttaaatttacttgtttattataaggaatattactaagaatacagatgaagaaacacatagggagagacataggggaagggatgcagagttccatgccctccctgggctccaccctccaggagcctccaggtgttcagctatctagaagctccctgaacccagtcctcttggatttttatggaaacttcgtgacatcagcattccttcccccagggtatgaggcgaggccctcatcggggagactcttaagacccacaatcagaaagacagggaacattagaatcctgccttgggtcaggtaaaaggaatgcaggaaagagattatttcctgaggcctgcccctgagacctaacacacccagcattataacgaaagactgtaacaagggatgtgggagttatgaaccaggaactaactgtgaaggagaacatcatcgactgtgccaaacgagctcagatgtccaggaaggggctgactaaaatgcattatttgaatatcatgatgcagaagatatatatatctatatatctatatagatagatgaaaacaaatatgtatattttctataatgttctataacacaagaagtttcccaaacatttatttacattgtttgtttattcccaaatatttatatttcccaaatacgacagcagggagactgagaaatcacaaaggacagatgagagcgatgttacttaatgccacagaacaggacatcatttaaaggagttactcaaagtgtttcagttactgccattaggaactcctaagcccctcggcagtgtgggtggtacggggtaggtgttgaggttagcagcacccacaggcttctcttcacgcaggatatgctatatagtgaatcggtatcaagactggaggaaggtaagggtttccagaaaaccaccttcaggccatggtttggagtagtcttattgaagtttacagaatcaaaagttacagataattaggaggcattgaaatacagacctgttttcttttttctttctttcttttttttttttttttttgagacggagtctcactctgttacccaagctggagtgcagtggtgagatctcggctcactgcaacctctgcctcctgggttcaagtgattcttctgcctcagcctcccaagtagctgggactacaggcgcaccccaccacacctgcctaatttttgtattttcagtagagatgggtttccacacattggccaggctggtctcaaactcctgacctcgtgatctgcccgccttggactcacaagtactaggattacaggcatgagccactgtgcccagctgacccagtttctacgaccagtttagccacaaagtagacatgtaaccagaggaaagtgacttaacctcctagggcctcagcttcccatattacacacccctgggatgagaatgataggaggtgtagcggggttgagctggataatataaggttccttacagctctagacatttatgatttaacattttttatggattgctaatgctgctttttttttgttttaaatgtcaaattcttgcatgtataaggccttgattctttcaggcctgggttgtgttgatttatgggcatgagctaattccagatgactcattctagaagtgattgtgtaagtatcctttacttagctaaacatatgcaacataaattcatctactataacatatgttctctcagaacatgctactggccagagttattagattttgttcacaccatagatcctgctgtattttatagcacttcagaataacaatcattcttttaaaacccttctacacacctttgctgtttctgtaaatacacctgtcctttacaagcatctggctctttctatgcattcttcctccagaaatcatagtattatagatttggaaaatgcttggccttcattttcctgttacagactggtttaggtgtccctcttaattgttcttaatgcattcagtatattcattcatttcttaattcattaaaaatatgcaccatgccaggtgttggggacattgcaatgaacaagacaggcatggcccctgctctcattcagtcatgtctaggggtaaaggtaaaccttggataagtaataattggtgtgctgactgttaagaagaactacagtgctatacaagctgtatgatcatattgggctttaaccaattccttgggaatcagatttctagatgaagtggcatttaagttgaaatctgagtagtgagtaggagttagccaggcaaagatgaggagggggaccactccaagctgagagaacagctgaaatgagaaagtccatgcaatatttttttttttttttttttttttaccataagaagatcacaccggccagaatggagagagggctggggagggtgatttgacctgagtctagagaggcaggcacagatcagaccaggatgcttatggcaggccacgctaaggattttggactttatccttatggaagttggaaatcattaagagtttaaagagagatatgatcaaatctgatattttaaataaagctcatttggctgtgatgtggcaagtgggctggagggcagggtggtgagaggagacacaggaagctcagttgggacattcctgctgtggttcagacgagagctatgtgggcttggactagggcagtgtgtctgcttcaaggggaaagggtttggtgttttgtggaatttggggaatgagggaatgtttcatgaagccgaaggggagagtgtttttaaaaggaggacatcatcgactgtgccagatggagctgagatgtccaggaaggggctgactacactagaatgcattatttgaatatcatgatgtggaagattttttgggggggtgggcagactcttgctctgtcacccacactggagtgcagtggtgtgatctcagctcactgcaacctctacctcccgggttcaagtgattctcctgcctcagcctcccgagtagctgggactacaggcgtgcaccaccacgcctggctaatttcttgtatttttagtagagatggggttttgtcatgttggccagcctggtctcgaactcctggactcaagtgatccgcccactttggcctcccaaagtgctgggattagatgtgagccaccgcacccacccagaaagatatttttgacctcaggaagaatgcttttggtggaatgacgagggtgaaatccatagtgtgtggcttaaggagtgaatggaaagaagaggaggagagagaggtggagagactacacctctttccagaagtttggctctgaaagtaaagagaaagggttaatactagatggtaacagtaagtaaagaaagaattgtagttttacagtttttttgtttatttgtttgtttgttttttgaggcagagtctcactctgtcgccaggctagagtgcagtggcatgatcttggctcactgcagcctctacctcccgggttcaagcaattcttctgcctcagcctccctagtagctgggactatgggcacgtgctgccacgcctgtctaatttttttgtatttttagtagagacagggtttcaccatgttggccaagatggtcttgatcttctgaccttgtgatctgcccaccttggcctcccaaagtgctgggattacaggagtgagccactgcacccggccagttttacagtttttaaaatgggagaagcttccacacatttagatgctaaaggaaggaacagataggaaagatttaagaatcaggagagaaaagagacaatagcttaagattcccgactatggggtagaggagaatgcttagaaccaaggtggaggaattggtcatttgtcacatttgctgacattttactgacattttctggctggatgtctgtctccttcactgggctgtaacctcctgaaggtgaaggctgaaattctatttgattttatatccctagcacttagtgtaggacttagcacgataatgtgccctctgagtgtttggctgggctgacgtgtcacttgtggtaggaaggtctctacagatgtgttcccttaaggatatagactgaaggccttgaatgcttaggaagctggggattgacttgaggtaggtagggcttcttggatagattttttaaatgagaactatgaaatggcaaagctgtctggcctgttaggttagtaactttggctgtttatgcctgatccaaagccctaggctaaaatcagtcatggtggagataaagagcaacctacaacatgcaagtcaagaactaccacagtgaattctctccttcttagctatctccttggtctagaaagaaagatgaaccccacagcagcaccccacaagaagagaaacagtgctcactcatttgagtctacttctcatcagatctgatgcaacttatctgcacaggccatgaatggaacaatgaaaagatgacctgaaatctttccccactcagttgctgttaaatttaacacagacataaaaattaagaaattcagtgaaacaattatattgcatttgtatttttcttctgcactgccattaatattggctggtaaaaattattccatacttatttccatgaattttgaaaagacttaaaactgcctgatatacttgggtgatattcttccaggaatgataaaatgagacagaaatggcctttgagtgttttcaggaagggaaaatggaaaatgaaagctggactaaaaggtgttacaaaagcaaactagttaatacttccaagaaatgaatatgctaagatattgtttgctgatcaacatttattaaacatttactgtgtaccactgatctaggctcttggccagatatgagcaacaaaaagaagatagtgtagtgcttgccttccaaaatctagcacagtcctagaaagaattcaggtttcactaaggctacttagggagagagttctctaggttctagaaattaaggcaggcacccacacaaagactcagttgcaaatgggtggaaagaatgatttttattaatcagcacaatatcttaaaaatcccagtgtagccttctttgataaaagacagagtacatgacttagaggcttaagaggggtcttctactgcccattctggatttctgttttgagacttggaagttctaaagtccttgcagaggagattctgaggcccaccagtagcctaaaatctccaggcctgctcccctcactgcccccactcctgggtggaacacagacgtagaagatgctactcagctcagtggccctgcccaccatgcacctgaccctgtgaatgcctgtggctggccgttcaggttagttcttcttccctcctctcccacaccatggagacacaggaagagaaggaagatacgtgtttttctctagtgctgacattagagcctgagactccggccttgcatgaggccagatgggctaaggtttctatgctgggtttttcgagatctccccagacccttccagcaaattcctctttttactcgaggaggttttggaaacaaatgagtaagacagacgtagtctctgtaataagagaatggtgagtcaaggacacctgaaaaacagtaatagctaaggtcggacagaatagaagggaaaaaaaaaaaagcaaaaagagctctggagacacaggagaaaatgaagctcagatgtctgggaaggcgagagtatctaaaacctttaccagagaagactggagggcctctttgggagatgaaactctctgtcacctggagattcaccaaagactctgaggctgaggggaacagtatactgtggaactgatttctgagaccacagttggaaattgtgtgttcagagtccttacaagtctgaaaaggcctttatttttacagccacacttgagtcaccatttggctgtagaattctccctcagaattctgtaaacatcactccattgggtctcctggcattttatttccaaataagagagcaatgaccactggtttctttgcacttggcagacacctgattttggtgaaggtgttggagtgtcttttgttgggagaagtgagtgtgaggagggtgggggagtgttctggaagtttgtaggatttcttgtaggattcttttctgtcatttacaaatttcaacagattatctgtaatatggcttttttcagtattcctgcccaacaatccttagattctttaaatatgaaatctagattttcttctattgagaaaaatgttaacttattcttgatcattccttcatttgttttctggaatttctgttatgtagaagttatcatatattattcttcctgtttcttaattttctttcataacttctctgttttttaggagattccttaaattggttatctgtttcacagttgccaggtttggtttttggcatattattctgctacttaagatctccactatttttttgttttgttttggcgcccatgattttactggaaaaatccttttgttctctccttttttgttaccccttttcatttatgtgacaccttcctgaaaattacccctccctttgagatttaaataaaatgtctggctcttcatcccattcttgatgggaagtttaatgcctcccctaactcctgttttttttttttcttttcaattccaagaggttttgtacttggtccccacctaggtccaattttctttgtcctagatttcctaattgtacctcttcttagagtctgttcttacagcctgtcctggtgcagacatggaacacatcgttttcctttgtgttccccaaatggcattctttcattccattcaccttgtgtggacacactttgctgaaggtctgaggtggcgaaaagggtggcgtcacagctctccagagagtattcatgtgttttaaaaagtcctccatctgccccattaccagggatttgtcacctaccaccttactaacaaggctcctcttctgtcctgttgaaaggaagaatcactaatggatgctagcagggcttagtacctaggtgatgggatggtctgtgcagtacctgccatggcacgtgtttacctgtgtaacaaacctgcacatcctgaacatgtacccctgaacttaaaagttggaaatcaaaaaagagaaagggcctctgttctctgcctttcttatcttccagacagaactccctttacctgaattctaaagtcctctttgtttctatctgatatttaagtcaaaaagatgttgccacacctgttctctccttcagagaattcaggttcctgctattataatccctttttattccttgatgcactaaatttctttttctgaaaattcttccttgttttctttactaaatctatcttgcagaaagatatctttgccctgattgttcagcttatttctggcagctaatttttcccatatgtctaatgtttcttgtataagagaaaatagatggcttttatttctaatcagaggtctatttttctcaatgttggcaaatcctgtgggttccctaagcaattgtgcatctcagggttcagttccttctggtggtttcctgctttcttttcctatgtgaggcttacgtagaatttatttaacatgcaataaaatatgcacataacatgaaatatgtttacaatatggataaatcccacaatcataatggtaggagaaagaggccagatacaaaacagcatatgattccatttatacaaaatttaagagtaggcataaccagtctgtggtgatacagattagaggagtggctatcatttgagtggatgttgactgggaaggagttagctggagtcctagaaattttctatatcttgatgtgggaggtagttacatgaatgtatacctgcgtaaaaaagtcatagagctatacattcaagattagtgcacattactatatgtaagtcatacctcactttaaaaaatgtcatgtgatgtcatctagaactagggaaggaataatttgagagaccttcttgatttggagaggaaaagaatattttgagggcaggtgttacttagaagaattgctctacatagcagtcttttcttcctttatcctactatcagacatttctccaactagaataagatgtggttacaactgtcctcttgctgtttcgtgagaattgcttagttgtttcctacacagaattttaaacgttgtggtaaatacaagttcaaagtcacattgccagtgcttcggaaacttataatctagttggagagacaagactaacataaaagagaatttagtgttgcttttttttttttttaagtgcaaattttgaggcacagaattcccccagggattcaggagaaagagcactcagtgggaaaaggaggaattgattttaatgaagcggggaggactaaggtgagtttttgaaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcagggttgagaggacagtacagtcaggggagggtagggatcgggaaggaacagaggccaggcctaaactgtatgccccggtgggaaatactatacagaggtcttttcttttacaacaaagcaattcttattatattacaaagaaaaccaaaatctgtgtttatgacaggatgacttacagaaggatacaaaaaattagggagtgatatattaagttctccttaatattttctcctctgacactacattcatgtatctgcaaaaacatacatgtgctttcagacacacatatgtatgaacacacatacacacacacacacacacacacacacacacacacacacacccttcatactcctgtgctggtggggaattcggagtttatctaaagtacacacttcatactcctgtgctggtggggaattcagagtttatctgaagtgctctttgctaggctctgtgggtggagctgggagggtaatggtaaggttggcagatatatgaagacaactgaaattcatatcagcaggctgagtgttcatgtcaccagaagtctgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctgaggagctgctcttgtgctgtttggcccctgcctactcggaatggaacaaaggtatggtgtgtattgtttttctactgaatttaggatatttatttttgatggtttgtcttcacgtcttctgtaactagatataagaattgagagttcttgctgggggatggggagggatttaggatgttaaaacagttttcaaatatatagtgtttgccatcttcagaacacctgatttacaattcactcagttacttgggtatagaacttgcttgtatcgcaccctgcttacccttgatattctatctgcttgagccctctctgcaaccctgtccactttacccaacccccttatcagcaacactgccttttctgtatacttcccttcttttttctgtggctgctagcagatcttgtttttggagctttccttctgtcaagacattacttactgctttgctcaggtctcagaaagctttaggatccagagagatactaaaggctgaatgggcatggaagacccagggtttggacttgaggggtgctctggactaaatggtacactgaattcatggatcaaaagtgcagttagtcttaaagctccaatcaatacaatgttgactacttcatggggtaagtaagatttttgtgggctggttagaacttacttgccattcgcaacttgtttttatgggaaaatatcaagtgcagtataaaataaacatttagaccactacctagtcataaaggggggggtgctttctgtagtatatttaattaaacacatattattataacattttgctaagttctagttctcaagtaaatataaagctgttctaaagatattttaggagtggtgacatgtttaaatctcaggtttataaaaagggttgtaagaatgactgttgtgagccattagtttcaatgttgatttattctctcaacaaatatttgttgaaatcctcatgtgcgctaggctgtgggggtgcaacggaaacctaaaacaaacttggttccttcccttgcatagcttacagttttctaggggacacagatattaatcaaccaacctcataattaaaaatgaaattattggctgagcgcggtggctcacgcctgtaatcccagcactttgggaggccgaggcgggtggatcatgaggtcaggagatcgagagcatcctggctaacacggtgaaaccccgtctctactaaaaataccaaaaaaaaaaaccaaaaaattagccaggcgtggtggcgggcgcctgtagtcccagctactcaggaggctgaggcaggagaacggtgtgaacccgggaagcggaggttgcagtgagctgagaccacgccactgccctccagcctgggtgacagagcaagattccatctcaaaaaaaaaaaaaaatcagtttgaaagtgatgagagagaaagtgatgtgaggctgtgtcacggtgggatttgaccttatatggggagtcagggaattcccagtggggctactgattgaactgagacctaaagtataaggcattgggggaacctgctcccagtatttcaacatagtttctttctattttccataagtgtcggctggctgagaaataaagggagacagtacaaagagaagaattttacagctgggccgccaggggtgacatcatgtatcagtaggaccatgatgcccgcctgagtctcagaccagcaagtttttattaagggtttcaaaaggggagggggtgtaagaacagagagtaggtacacagatcacatgcttcaaagagcaaaaagcagaaccactgataagggtccaacaaagatcacatgcttctgaggggacagggcaaagggtaaaagcagaaccactgataagggtccaataaagatcacagggcaaaggacaaaagcagaaccactgataagcatctatgttcagcagtgcgctgcatgtattgtctttttttattattattaaattttttattttattttattattattaaaattttattattattattattattaccctagaactttaagttctagggtacatgtgcacaacatgcagatatgctacacatgtatacatgtgccatgttgatgtgctgcacccattaactcgtcatttacattaggtatatctcctaatgctttccctccccccttcccccaccccacaacaggccccggtgtgtgatgttccccttcctgtgtccaagtgttctcattgttcaattcccacctatgagtgagaacatgcggtgtttggtttttttgtccttgcaatagtttgctgagaatgatggtttccagcttcatccatgtccctacacaggacatgaactcatcacttttatggctgcatagtattccatggtgtatatgtgccacattttcttaatccagtctatcattgatggacatttgtgttggttccatgtctttgctattgtgaatagtgccgctataaacatacttgtgcatgtgtctttatagaagcatgatttataatcctttgggtatatacccagtaatgggatggctgggtcaaatggtatttctagttctagatccttgaggaatcgccacactgtcttccacaatggttgagctagtttacagtcccaccaacgtgtaaaagtgttcctatttctccacatcctctccagcacctgttgtttcctgacattttaatgatcaccattctaacaggtgtgagatggtatctcattgtggttttgatttgcatttctctgatggccagtgatgatgagcattttttcatatgtctgttggctgcataaatgtcttcttttgagaagtgtctgttcatatcctttgcccactttttgatggggttgtttgtttttttcttgtaaatttgagttctttgtagattctggatattagcccttggtcagatgagtagattgcaaaagttttctcccattctgtaggttgcctgttcgctctgatggtagtttcttttgctgtgcagaagctctttagtttaattagatcccatttgtcaattttgacttttgttgccattgcttttggtgttttagacatgaagtccttgcccatgcctatgtcctgaatggtattgcctaagttttcttctagggtttttatggttttaggtctaacattgaagtctttaatccatcttgaattaatttttgtataaggtgtaaggaagggatccaatttcagctttcgacatatggctagccagttttcccagcaccatttactaaatagggaatcctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcaggtagcatgatgcctctagctttgttcttttggttttggattgtcttggcaatgcaggctcttttttggttccatatgaactttaaagtagttttttccaattctgtgaagaaagtcattggtagcttgatggggatggcattgaatctataaattaccttgggcataatgcccattttcatgatattgatacttcctatccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctttgtctgttattggtgtataagaatgcttgtgatttttgcacattgattttgtatcctgagactttgctgaagttgcttatcagcttaaggagattttggactgagatgatggggttttctaaatatacaatcatgtcacctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagagaatgcttccagtttttgcccattcagtgtgatattggccgtgggtttgtcataaatagctcttattattttgagatacgtcccatcaatacctaatttattgagtgtttttagcatgaagggatgttgaattttgtcaaaggccttttctgcatctattgagataatcaagtggtttttgtctttggttctgtttatatgctggattacgtttattgatttgcatatgttgaaccagccttgcatcccagggatgaagcccccttgatcatggtggataagctttttgatgtgctgctggatttggtttgccagtattttattgaggatttttgcattactgttcatcagggatattggtctaaaattctcttttttttttgttgtgtctctgcccagctttggtatcaggatgatgctggcctcataaaatgagttagggaggattccctctttttctattaattggaatagtttcagaaggaattgtaccagctcctctttgtacctctggtagaattcggctgtgaatccatctggtcctggactttttttggttggtaggctattaattattgcctcaatttcagagcctgttattggtctattcagagattcaacttcttcctggcttattcttgggagggtgtatatgcccaggaacttatccatttcttctagattttctagtttatttgtgtagaggtgtttatagtattctctgatggtaatttgtgtttctgtgggattggtggtgatatcccctttatcattttttattgtgtctatttgactcttctgtcttttcttctttattagtcttgctagcggtctatacatttcattgatcttttcaaaaaatcagcttctggattcattgattttttgaagggttttttgtgactctatctccttcagttctgctctgattttagttatttcttgccttctgctagcttttgaatgtgtttgttcttgcttctctagttcttttaattgtgatgttagggtgtcaattttagatctttcctgctttctcttgtgggcattagtgctgtaaatatccctctacacactgctttaaatgtgtcccagagattctggtatgttgtgtctttgttttcattggtttcaaagaacatctttatttttgccttcattttgttatgtacccagtagtcattcaggagcaggttgttcagtttccatgtagttgagtggttttgactgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatattctgttgatttggggtggagagttctgtagatgtctattaggtccacttggtgcagagctgagttcaattcctggatatccttgttaactttctgtctcgttggtttgtctaatgttgacagtggggtgttaaattctcccattattattgtgtgggagtctaagtctctttgtagatctctaaggacttgctttatgaatctgggtgctcctgtattgggtgcatatatatttaggatagttagctcttcttgttgaattggtccctttaccattatgtaatggccttctttgtctcttttgatctttgttggtttaaagtctgttttattagagactaggattgcaacccctgcctttttatgttttccatttgcttggtagatcttcctccatctctttattttgagcctatgtgtgtctctgcatgtgagatgggtctcctgaacacagcacactgatgggtcttgactcttgatccaatttgccagtctgtgtcttttaattggaggatttagcccatttacatttaaggttaatattgttatgtgtgaatttgatcttgtcattatgatgttagctgcttattttgctcattagttgatgcagtttcttcctagcattgatggtctttaccatttggcatgtttttgcagtggctggtaccagttgttcctttccatgtttagtacttccttcaggagctcttgtagggcaggcctggcggtgacagaatctctcagcatttgcttgtctgtaaaggattttatttctccttcacttatgaagcttagtttggcaggatatgaaattctgggttgaaaattcttttctttaagaatgttgaatatgggcccccactctcttctggcttgtagagtttctgccaagagatccgctgttagtctgatgggcttccctttgtgggtaacccgacctttctctctggctgcccttaacattttttccttcatttcaactttggtaaatctgacaattatgtgtcttggagttgctcttctcgaggagttatctttgtggcattctctgtatttcctgaatctgaatgttggcctgccttgctagattggggaagttctcctggataatatcctgaagaatgttttccaacttggttccgttcttcctgtcactttcaggtacaccaatcagacgtagatttggtattttcacatagtcccatatttcttggaggctttcttcgtttcttttcattcttttttctctaaacttctcttctcgcttcatttcattcatttgatcttccatcactgataccctttcttccagttgatcgaatcagctaccgaagcttgtgcatttgtcacgtagttcttgtgcctggttttcagctccatcaagtcatttaaagacttctctacactggttattctagttagccattcatctaatcctttttcaaggtttttagcttctttgcgatgggttcgaacttcttcctttagctcggaaaagtttgatcgtctgaagacctcttctcgcaacttgtcaaagtcattctccgtccagctttgttccgttgctggtaaggagctgtgttcttttggagggggagaggtgctctgatttttagaattttcagcttttctgctctgttttttccccatctttgtggttttatctacctttggtctttgatggtgacgtacagatggggttttggtatggatgtccttcctgttgattagttttccttctaacagtcaggaccctcagctgcaggtctgttggagtttgctgtgggtccacaccagaccctgtttgcctgggtgtcagcagtggaggctgcagaatagtgactattgctgaacagcaaatgttgctgcctgattgttcctctggaagcttcgtctcagagaggtacccagcagtgtgaggtgtcagtctgcccctactagggggtgcctgccagttaggctactcgggggtcagggactcacttgaggaggcagtctgtctgttctcagatctcaaactccatgctgggagaaccactattctcttcaaagctgtcagacagggacattgaagtctgcagaggtttctgctgccttttgtttggctatgccctgcccccagaggtagagtctacagaggcaggcaggccttgagctgtggtgggctccacctagttcgagcttcctggccgctttgtttacctaatcaagcctcagctatggtgggtgcccctcccccagcctcgctgccaccttgcagttcgatctcagactgctgtgctggtaatgagcgaggctctgtgggcgtgggaccttctgagtcaggcatgggatataatctcctggtgtgccatttgctaataccattggaaaagtgcagtattagggtgggagtgacatgattttccaggtgccatctgtcaccccttcccttggctaggaaagggaattccctgaccccttgtgcttcccaggtgaggcgatgcctcgccctgcttcagctcacacttggtgggctgcacccactgtcctgcccccactgtctgatgagccccagtgagatgaacccggtacctcagttggaaattcagaaatcacccgtcttctgtgttgcttacgctgggagctgtagactggagctgttcctattcagccatcttggaaccacctgacacgttttgtcttgataaacatcttaaacaacagaaaacagggttcaagagcaaagaaccggtctgaccacaaatttaccagggtggaattttcccaaccctagtaagcctaagggttctgcaggagaccagggcatatttcagtccttatctcaactgcacaagacagacagtcccagagcggccgtttatagacctcccccaaggaacgcaatattttcccagggtattaatattaatattccttgctaggaaaagaatttagcaatatctttcctagttgcatgtacatttataagctctctgcaagaagaaaaatatggctctttttgcctgaccctgcaggcagtcagatgttacggttgacttccctttttccataaaaatcggtattattctgttctttttcaaggtgcactgatttcacattgttcaaacacatgttttacaatcaatgtgtacagttaacacaatcatgacagtggtcctgaggtgacatacatcttcagcttacgaagataataggattaagagattaaagtaaagacaggcataaaaaattataaaagtattatttgggaactgataaatgtccatattaagatgaaatcttcacaatttatggtcctctgacacagttccggccggtccctccgtttggggtccctgacttcccataacaataaggagagttaaatctgtgaggaagggatcaaaaaagaatattctgggtatagggttgtacattgaggaaatgaaagaagaccagctatcattaggaggaagaacatagtacaaaataagctggaggaagtgcgtaggggtcattacatatgcttcacctcctaggctatgttaggaattttgctgtttctcctaggaacaatgacaggagactgacgtggaaaaaaaggttgatagggtggaattattttaaatttccatttaatctatgttattctgcctcattcttcatgacattattatgcgttgcgtgcttgtgtcaaaacgtctcatataccccacaattatatacatctatatactcacaaaaatttaaaattaaataactatgttattctggtcattgtggaaagaacaaattagagaaagagtgaatgtagggtgaccagttaggggtctatggcggtggcccagagggccatggtgatggcttagattagggtgacagggaagatggttatgagagagaattaagaggtaagattaatggatttgacttagctatagggtagggagagaaagggagtcgttgaagataacaggttgtcatgaaggacatttgaaggatgagaatgagtgagatgcactgagctgaattttggatatgctaagtttcaggtgtctttaagacatccaaatagatatgtatgaaaggcagttagctatacagatacaactttgtggctcaaggtctgcccatatatgtgtttgaaagtcatttgtgttcaggagataattgaagccaagagtatggaggagactctgtagggaaaaagtgtcaaatgaacaggacacagaactgagccttgaggagctacaacattgaatgaccagatagaggaaggatccatctacaaagcaaacaaaaaaggactgaaaatgtaggaagaaaactagtaagctgttaggtgtgcagaaacaacaaccacaaaaagtatacctggctataaagaaaaggagaaagagaactagctggagggtctttggggctgaaatgctttaaaaaaaaaaaaaaggtttggaaggtttaaaaaagcaatgtaatgtagattccttctacataccattcttgaaatgacaacattgtaaggatagctgggcaatcagtggttgccagaggatatgaacagtggggatgtgactgtaaagggtagtccttgggagtttcactgaggaagttccttggtggtgatagaagagttatatgtcattttgtttgtttttttgagatgggggtctcgctttgtcagccaggctggagtgcagtggtgcaatcacagttcactgtaactttgaaacctggggcttaaatgagcctcctccctaagccacccaagctgtagctggtactacaggtgtgctccagcacgttccacaagaactatatatctttttgttcttcacattcctgtcagactttataaaacaaatggatccagtagggaacaaacacaatcattatgctgactgtcaggaatatagagggaaagaaaaaatgttagccttaaagtatttgaaaaccactgactgtatgaaaatgctacttccaggcacctgggctatggctcagatgctgatattaacacatcagaaaggtctcaatttagtgactgtcccacatgctccagccttcctgattttctctctctgtattttttaaatgacagagcctgaatatcgtggacaataattgaggaggatcagagagcccagccaggcaaaattagaacagacttgggtcttgcaggctatacttggtgagatctgagttcttgagaaatgtgtcacattcaggaacctgccttcactttttctgctacttattctgtaatggaagaaacagaccaccactgtgtgagaggggtccttcctggcttccctcctcacagctgtgtttcaaaggggaagagatctgtgaagggcaagcacaggcacagccagagcccacagagtccactgggaccagcatggggacaatcagagtctgtggtcctcctgcctactgcatgccctacactatcctgtgggggttggggtgagataactgctgtgggggaggagcactgtgactgaaggaaacatcttttctcagctgtgggcgtgcctaacctctgtctcaaacccaactctgcctttaccttggagtgtccagaaaagacagcaggggccaaatgacaagccaaagttagtgtgacatttccacggagtaggggttgcaaaattgccgttggaaagaggagaaataaaggccatggaaagaaactctagggaaatgacaggccttattcacagactatgtccagaataaaggagccccagggtcaagggtcaacagtaggcctcttggaaactagggtcccattggagtcaggaaataaaaaattcaagtcattcataaaagtcttgaaaggcatgacaatttctaacagttgctagaaatggtaccaactctgggttcttgggctgttaatgcacagaaattggcatgagactgaaaaagtttccccagacaaggcattattggagtttatacctggacataagagaggcagcacaagagagagagaattccctgactgaagccagtagggctttttttttttttttttttttttttaaattaggcaaagcatgggaattgacttcaggggtagggtatgcaggatgggctgggaaagtgtgaagggtagggtatgccagtcagcatatctggttacagtggttatcttcaataatgggcaacctggtgatctggctggctacagcaacagtgtaaatcaatggctcagcattccttacctatgtgggacactcaacaaccttggttatctcctaaggccagtttctggaattatttaagtaaaaggtatggttcaaacattgtggcctaagcaaggtagtagtgtgggtttgtggtgagtggggatgcacaaaagaatgctctagtcgatataggctgaagccaagctccgttcctacttggtctcagaaaaaggcaatgttttctttagtatacattggccaagaactcagacttttataaacttgcttgaccagttgtcactgcttcgttgtgatctcttctgccactgggaatggatttattaactacagggctttgtgttgtgggagaagatttagtgattccaagaaaggaattcacttttattaaaataggttaataattaaaacttcaaagtgctacccagccatagaagtttcctgaagaaagaaaacagagagtcattggccatatgaggtggagatggtttcatctgaagtgtggaaaaaacagataggcttgtgttctttcctgtggcaggtgtgggtaaatgtgtcccccccaggggcctgcccttgtccatagccctacagtgtcttgcaatgtaaacattttcttttccaaggatctggtagggtggacataaatccaaggctcataaagtaggaagaaaagggggtggcctgggagttcctagcaggcagatcctcctcatactcattgtatttccagggtggggcagtgcttcacacatagtaggagctccaggaatacttatcaaacaaaagaacaaaggtaaagagaagaaagggaggtcagatggaagaaagcgcatgaccaattcaaaaactagaccccctatgaagttgcctgcagtgatcaattttaccatgagctggcagcacagagaaaagttctggccagggcaacctcgaggttcctgaacctctgccccttttctcagcctgggactgaactccctgttttggagatctctaaaccaagtatacacctcattgttccaaaaacaaaataaaacaaaagtgcagtccttcggcatttataaaatgtgagttccaatgtagctgaaaactgcccacccctcagccttgcttaatgttttaatttttaaaatttaaataaattttgttccttcatactttacacttcgaattttggtgcctggcagaaggactagtccgtcgagagagaaagaccatgatacaggtggcgatttggccgctgtcctctttggacttgaggtccacaatgatgtggtcgttggtgttggggatgaacttgaagaatgaactttaacgtgcgcggggcccacctcccccatgtggctgacggaaatgtaaccgaagtcctgggtggtgctcaggagtcctcgctgcaccgctgggggcaggaccggcgctgcagcactttccagcaggcggactaggggtgtgaggcagcctggcggtcggatttccgtggcggccctgggagcattgcagctgcacacccagttcttgtggtccacgctgcccttgtggcctgccactctcacccattccacgttctcagtcactatgtcccctccttgcccaggctgcccccctacagacgctggccctccactgccatgaaccccttctccactgccccatcgccttcggagagaattacccgagacacggccttgctgccatctatctgataggtcacccctctcccatggtccatagagtagtttcccaccagagacgttcagatccgagagctccatgcccctctccactttccgccaggtgggactctagaatgcagtggtctttgtttcatttcaccaccaccctgtccctgctgtctgatagggttgggtatccccttttcaggtaactgaaccaggtgttttcttcttgggcccttgaccctgtgcccaggtcagcaatgactgcgactgggtattgaatcctacctggcgtcctctggaaggcaaccagggggtaagtgtcattgtccatggccttggtcatgggcgcaagcacaggaaggccccgcacacttatctggagagagcgcacagactcattccattccaggtggtcagagggctgggcaggcatgagactgaagggcaggcgggacccagtggagcagggagtccgacttccacccttagtaagctcgcctggcctgagttatgtgagagtagtgatggctacacaaattaaagcatagaataaaatttcatagaactgtatacacacacgcacacacacacacaaatagatgcctgtgaaaactggtgacatgagaataaagtctgtgctctagttaacagtattgtaccaatgtcaatttcccggttttgatattgtaatacagtaatacagttacataagagatcactattggggaagctaactgaagggtacaggggactctggactatttttgcaaatttctgtgagtctacgattatttccaaagaagatgttttaacaagtgaatgagaatgaaaaatatgaaatttgcaatgactttttctttagtattttgccctttaagtgtaatctaattattacaatcatcattattactcatgcatagtgtacaggaagcacttctcttattaaaatataactcaaaacttccagaacttgtcactggaagacactccatccaggcagtttggctgacttgaaagccaaacctgtttgcagtaggaccttccttaattatagcagattatagcttgattatacttggttatagcttgttgcaggagtgggctgctctctcttgagaggtcaaactttacttacaattgtacatcagaataagtgaggagtgagtatactttgaaaaggcatatttgaaacagcagtttcctcattgtttttattgtggaatataacatacagaacagctcaaaaaccataaatgaagaacacttagaaaatgaacaccagtttaacctaggttaaaaaaaaaaaaaaaagaaaatgtaatattacctgtgagcaccccagaaatctctcatatgctgctttctttctttctttttaaaatagctttatagataatatgatttaaataccataaaattcacctgatttaagtgtaccattcaatggtctttagtatacttaatggagttgtgcaaccatcttcacaatctaattttagaatttttccatcacctcatgaagaaaccatgtgcccttgatcagtcagtccccattttctgtctacacccccaccattgtctctgataaccactggtctactgtctctgtgaatttgcctattctggacatatcatacaaatggaattatatcatatgcggtctttgggtctgactgctttcatttagcagaattttttgagatgcatctatgttgtagcatgtattgtaatttattcctttttattgccaaatagtatttcattatatggatgtatacatttatccactaactgatagacatttaggttgtttgtactttcgggctgctatgagtagtagcaaagtgaacatttatatacaggtttgtgtgtgtgtgtggacatatgctttcagttctttgggtggagaccgaggagtagaattgctggatcaacagaaactctaacatgttgagaatctgccaaacctttccaaagtttatcaacaacagtgtttgttggttcctgtttctctgcaacctcagcaacacttgatattaccttcattttttcttatacctatcctaatggatgtgaagtaccatctcactgtagtttggtttgagtttctatcatgactaaggatggttaacttctattcatgcgcattactgaccatttatatatcttctttggagaagtttctattcaaatcgtttgttttattttatttatttaaagatgggagtcttgctatgttgcccaggctgctctcaaactcctgggttcaagtgatcctcctccctcagcctcctgagtagctagggctacagatgtgcacaaccatgcctggctcccctttgattatttttagttgggttgttttcttattattgagttttaaagttttttgtatattcttgatacaaggttcttacagatatataatttgcaaatattttctcgcagcttttgggttattttcattttcttgatggtgtcatttgaaatgcaaatgtttttaattttgataaagtcaaatttctcatttcttttcttcttttgcctgtgcttttggtgttgtatctacaaaatcattgcctgacccaaagtcacatagatatattcctatatttctaaagtataggttggtgcaaaagtaatcatggtttttatcttgaaaagtaatggcaaaaactgcgattacttttgcaccaacctcacaaatgactcaaagatgttctctatgtgttggctcttaagttgtttatttcttcacagcagactgagatccattggctcaaaggctgccagcaccagacttaaaattgtacacacacaattgttttaaacatagcccaaataagcatatttttagccatttagggcctgatctgcatactccatgaaattggcaatatttattatccatagataagataagccccagtgttataaagttgccaggctgctgctgtcctttgagttcactaaccctgagactccctgctgtgcctctgacttatcccctttcctagaagtttccttgctctcctccccttctgaatggtggtccctccaagactccggatagtttcaagatgtgaaggactcattcctcctgcttacttgctaaagcagcaccctgctaaagcttgtgcatgttgctgccagctcatcatatctttttcttcgatcagtccagaaattctggaactcactccctacagttttcctctaaaagtgttatagttttagctattatatttaggtctatgattcattttgacttaatttttgtatgtggtgtggggtaggggtacaaattatgcttttgcatgtggctattcagttggcccagcaccatttgttgaatacaggattattcttcaccccattgaatggtcttgacactttcttgaaaatcaattgaccacacacacgagcttatttctggactctcaattctatgtttaccttcatgccagtactacactatcttgattagtgtaatattgttgtaagttttgaaatggagaagtatgagttctccaactttgttcaagattattttaatcagagtcctttgtgtgttcttacgaattttcggatcagcttgtgagtttctgggatttagaaaggaattgcattaactctgtagaaaaatttggggagtactgccatctaaccttctgatctatgaacatggagtatcttcctctttatttagatgtttaattttaaaaatattctgtagtttgcagtgtacaagttttgtacttcttttgttatacttattccaaagtgtttattgttcttaattacattctgaatgaatttttttcttaatctcttttttgagttgttcattgctaacatgtagaaatgcaattgatttttgtatattcatcttgtatctgacattttgcctaacttgtctattagctctggaaattttttagtaaatgttttaggattttatatatacaagatcatgttgtctgcaaatacctttactcttcctttccaacttgatggctttattttgcctaattttcctgtctagaaccttcagtaaaatgttgaatggaagtggtgagagcagatatccttatcttcttcttgattttagggaaaaagtatccagtcttttgctattgagtataatgttagttttgggtttttcatgggttcccttaattagattgagaaaattactttctactattagtttgtaaagtgtgtcgttgtgagggggtgggagttagtcatgaaagggtattttttttcaaaatttttttctgcattataatttcttttgagactattatgtggtttttaccttttattctcttaatgtggtatattacataattgattttcatgtattaaatcaatcctgcattcctaggataaatcccaattgatctggacaagtttatggactatcagtactaatttttctctaaatgtttgatagaattcaccagtgaagcctctgggttctatgtttttctttgaaaatactttaaattactgattcgatctcttttcctgtcataggtttgttcatgttttctattcctttatgagtccattttggcaatttgtgttgctctaggaatttgcccacattacctaaattatctaatttgttggcatatatttattcatagtatttacttatagtccttttaatatttgtaggattaatggtaatatctcctctttcattccggatttttttgtaatctgtgctttatctctttatcttgttcaatctacctgaaggtttgccaattttgctgatcttttcaaagaaccattttttgattttactgattttctattttttttgttttttctacttcttttatttttaccctgttattattttcttattctacttgttttgggttttgtttgcttttccttttctagatctgaagttgaagtcttaagattattaagatcgttcttcttttctattatagccatttaaagctacaaatttgccccatgtcttgctttaattgcatcctacatatgtgctcctttctgattaaaactctctccttaaagatatatagtaccctgactcttgtaatatttttctcattttctgaaacaatacactttagttttcttgttagggaactttatttaaatggagtcacgttgcctctgtgtgtgtgtgttttgttctttttatccaatattatgtctgggcattggtgcacgttgttacaagtagtcttaattggtttatttgtctttttgtgttccacagaatgctactttactgttatagcgtataatttacataacatataaatacataatttatcatttcattgttgatgaacatttgcattgtttccaatgtaatatactcaaatgtaatatgaataatgctgtgatgtacattcttgtacatgtatcttgaagaacatatgcacatatttctccagtgttgagacttagctaagagtaggattgttaggtgacagtatatgtgtattctctgttttagtgtagaatgccacactatttttcaatgagattgaacctcactacattgtcattagtaacatatgagagtttccatactcctattatcaacatttagtacttgcagttgttttaattttagttgttctggtaagtatagtggtacttcattgtggtttttattttcacttccccattgctagtaaggctgagctctgtttatacagttagtcacaatttggatattctattttatgaagtacctattcaaacctttttgcccatttttcttatagattgtctttttcttattgatttatagacattcttctatattctgcatagaaatcctttgtcatatttatgttgcaaattttcattatgtgtcttacctttttactcttttattgtgttttggggtgtatatgttcttttggtgtaatctaaaattgcaataattttccttttgggtagagctttttgtgttttgttgaaaaaaatccaccgtgtcccaagattataaaaaatttctcctaaataccttccaaaagcttgattgtttatcttttaaatgtaagtcttttaacttgtctgaaattgatttttatctatggaataaggaaggagtccaatctatttttccaatatgggatcccagttaccccagcaagtttagtggaaacatttatcctttccctagtgatctacagtgtcacttatcaagtgttggtgtatatgtggacttgtttccaggcctctatcctgttcccttgattattttatctaccactgagccaacactatacgatcttaattattatagcttacaataagtcttgatatttgctaggacaaatcctctctcatctcccaccttgttcttcttgaagaatgttttttctctttttggccctttgcatatcttaataaattttagagtaagtttttaagctgtaaaaaaaaaaaaaaattctgggggttttattgagactatagtaaatctacagataaatttggagtaaattgattatcttcataatattgagcttcctatctatgaacataatataactcttcgtttatagatacacttaatatctctcaatagagttttataattttctccaaagagatcatcttttgttaaatgtatttcttgatatttcattttttatgctatcttttaatttttatttatttatttattttttgagatggagtttctctcttgttgcccaggctggagtgcaatggcacgatctcggctcactgcaatctctgcctcccgggttcaagcaattctcctgcctcagcctcctgagcagctgggattacaggcatgtgccactacacccggctaatcttgtattttttgtagagacggggtttcaccatgttggccaggctggtctcgaactcctgacctcaggtgatccacctcagccttttctgctatcttaaatgatatatttttaaattcaatttttgtattttttattgctgatgtgagaataaattgatttcttaaactattgattatatatctaacagctgtactaaactctcagagtcttataatttatatgtgggttcttctgaatgtttatgtatacagtcagttctaagtatcttcaaaaatgattttttttctttccactccttatgtgtttgacttttttttttcttgccttaatgtgctgagtagcttattcaggtctctttacttttacctaatgtctttttctgtttcagggttacatctaagataccacatcacattagctaaggagctatcatgtctccttaggcttctcttggctgtaatatttacttagatttttcttgttttggatgaccttgagtttcaaggagtacagaccatgtattttataggttacctctctactggaatttatctgattttttttctcatggttagactgggattatgggtttgcaggaggaagaccacatcatattaaagttacattctaacataatttatcaccgttgatattgacggattgtcacatttccttactgttaaagttactctttttttcatcatttccatactgtactctttgaaaggaagtctctatgaaaggaagtctctatgtgcagcccacatttaagaattgattatttcagattttctacataggcaatcatgttatctgtgaacaaaaacagttttacttctttcttcccaatttgtataccacttatttatttatttgccctattttattgtctagaactttcaatgcaatgtagaaaagcagtggtgagagacgacatccttgccttgtccttatcttagtaagaaagcttctactttctcattttttgtagatgttttaattaattaattaattaattaatttatttatttatttatttaagatacagggtcttgctctgtctcccaggctggagtccagtggtgtgatcataggtcaccccagctttgaactgggggctcaagtgatacttacatattggcctaccaagtagctagggctatagatgcatactgccatgcctggctaatttttttttttttttttttgagatggagtctcactctgtcacccaggctgaagtgcagtgccatgagctcagctcactgcaacctccgcctcctgggttcaagcagttctcctatttcagcctcccaagtagctgggattacaggcgtaggccaccatgcctggctaattgttgtattttagtagagacggggtttcaccatgttggccaggctggtcttgaactcctgacctcaggcgatccacctgcctcagcctcccaaagtgctgggattacaggcataagccaccgcacctggcgcttttttatttttattttttagcaatggggttttgctatgttgaccaggctggtcttaacctcctggcctcaagtaatccttctgtgttgacccccaaaaacacttagattaatgggtatgggctgctgtgcccagctgtaaatgttctctatcaagctgaagaagtttcactgtatttctagtgtgctgagagtttttatcatgaatgagtgttggattttatcaaatgcatgtgatcatgtgacttttcttctttagcctattgatttgatacattatattagtgacttttgaatgttgaaccagccttacatgcctggaataaatcccatttggtcatagcatataattctttttatccattgctatatctgataatattttgttgagtatttttgcatctatgttcatgaaagaaattagcctgtagtttttttttcttgttataactttgtctgattttggtattagggttatgggctcatagaatgagtcaggaaatattccctctgtttctgtcttctggaagagacttttgaaaattggtataaattcttctttaaaattatagtagaattcaccagtacacccttctgggcctgatgctttctgttttagaaggttcttagttaccgattcaatttatttaatatatatagtactactcagatagtctatttctttttgtacaagttttggcagattgtgtctttgaatggattggtctgtttcacctaggttatcaaatttgtgagcgtagagtttttcatagcattcctttattatctttttaatgtccataagttccatagtgttgtcccttctttcatttctgatattgtattttttgtttttgtagacacagggtctgttttttttttttcctttgagagagggactcgctctgtcacccaggctagagtgcagtggcacgatctcagctcactgcaacctctgctttctgggctcaagtgattctccagtctcagcctcccaagcagctgggactacaagtacaagccaccaatgcctggctaattgttttgcattttttgtagagatggggtttcattgtattgcccaggctggtcttgaactcctgagctcaaagcaatccgcccacctcagcctcccaaagtgctggcattacagatgtgagccaccacacctgccttagacacagggtctcactttgttgcccagactggtcttgaactcctgggctcaagtgatgcttctgccttggcctcccaaagtgctgggattacaggcataagccactgtgcccagcctgatattaatatttttgcatcctccctctctctctcttttaaaatattagttagcctagctgtgggcttatcacttttttgatcttttcgaagaaccagcatttggttttgttgcatttctctattagttttctgttttcaattccattgatttctgctctaattttcatttctttttttctgcttcctttgaatttaatttactttcctttttctagtttcctaaagtggaagcttatgtgattgattttagatattgagtatcacagggtacagtaggtgaatttttcttcttttaaccatggagtacacattttgttcgtgtgaggatattctttaattcactagatatttactgagcacctaccacgggacaggcactgtagtcttggccttcatagagtttaccttttcttgaacagaatactgaacatcttcccattgaaaacaaaatacctaagacggggagcaaaatgtacatacagactgaaaattctgaatgagttgccttttcttcctccaccctttttctcagattatgaccctctggaggatttctagcttcataagtagtctttatttgggctccttgccctgcttggactgcaagtatagttgacatttatatcattcctatccttgcctctccctcagctctgagcttagaagccccagccactggtctttgaagagatcttcagggtgtgaggtgccatcagagcatgaatgaatgacatttttacctcataaaactctactcctctctgtatttttttgaggtctagattttgaattttcaaaataagtttcaagagcatcactgtttattccataggccctcgacatagtaaaccaatgacatttttattaatataggtattttctgtgatctctagtgaggtaaattttaaaaattcgtttgttacacacttatatctggttcctactaatcttcagaaaaagaacaggatggagataagtcaggtgagatacatacattgactatgaagctgacttctaactagttcctagtttagatcataattaagcatcagaaaataacagagcccaggattagggtgagacaagtgagaccacttttaagttgtagaaaatttaaggaatgtaaaaaaaacttgattaaaacaaattattttaacacaatattttttcattttttttttcttttgagatggagtctcactctgtcacccaggctggagtgcagtggggcgatctcagctcactgcaacctccgcctcccaggttcaagcgactttcctgcttcagcctcccacgtagctgggactacaggtacctgccaccacacctggctaatttttgtatttctagtacagacagggtttcaccatgtaggccaggttggtctcgaactcctgaccttaggtgatccgcttgccttggcctcccaaagtgctgggattacaggtgtgagccaccacacctggccaacacaatattttttaaggccaaaatgaacgcacaaattccatgacaaacgaaatatccaaaacttaaagacaggatgttatactgccacactgccattacttctgaggcaaaaaggaaaaagcgtgcccctgtataaatgtattttaatggttattttcaagaatattaatgtatttgaaaaaatattgaaatgttaaaaagtaggtgtattaaaattcattttagttttttttttttttttttccaaaaattgcattcaaatgtattttacactttaggcagttcttaagaagggagagtgcggttttttgacacttaacatttaaaggttttattggccacattaatctttctcacaaaagttttaggttatctataagttcttagaatgtcaaagaagagaagaaaaactgactaactttaaggggcggtggaagaagcagcaacttggcaataattccgcagccaacttcgcgtgttcaggcatcctttttctccagtaaaattttgtgcaactcgtctgcatcctcgctggtttttacccgaatcaacatggtgactggcatggtggcattcttctcgtcaattggtggatttggaacacagacgataagaacgttattcttccctgttcgcgtacatggcatattgggtggaatcagaacattcagcaatatgttgcctaaattggtgtctgcccgcaccaaaagctgtgtcttctgatttgctgtaggttttaaatgcagagtacctatgcctttctctttaaactcattgtctttcttgtaaaacagtttacactttttggagtaaaaagcatcttcttttacttcggtaactactactttgggcggctcatcattctcttcttcatctccacctttgcattcaccactgtcaccttccgcttggccctccaatggtttagtgggaaatggtgaagagactggtttactctgggtagtatctttgccaaataaactggagtttccaggggagaaagaaaatccagtcagggggacagagcttaatgagcccaaaacagagctatcaactttcttgtcgaaattaaatgaggcacttgtcgctcctagtgatgatgggtccgttttcttttcagatgccacctccaccttcttgtcaggtgtatcttcagttttgttgccatgaaacaaaaacgttgactcttgctgtaattttgttgagccaaaaagggaaggagactgtgtttcagccgccactttgttagattcactttcagaattcctgccactgttcccgtgttgctgttcaatgtttgctaaatatttctcatagtccttaaagataggtgtcagatcacagagggggtttgtattcacgtgcttcactatccaatcccgcacggagcagttcaaggcggccaactgcttgtgataggcatttccgacacaagctttactggaagcaaggccagaggaggagggctgctgactgtccccattagttttgggatttgaaactttatcaaccaaggcggtagggccatttgcagcaagagaaccaaaggctaccttgggctctgccgctgcctttgcactggtgaagggaggggcactggttatgttgtttccattcgacagtccttccaaaggcttccctccagcgccactaccaaatccaggaaagcgtcctcctccagaaggtaccaccaaacctttaaaacctttaaaggctcctccagtgtcagattcgaatccaacatttctgcgctttgctttctttatggctctattcttcaagacttcctcactggccatggagaatgttcccacctcttaagcttcatcttcttgatcccaattcctatctgtcagttccttctcggcatttcttttggccgtgttttcgaacctcctcggcggccgccgctgcactcgctgggtcttgggtgcggcgaaacccagggcgcagcggcgcaggggtctggagcccgcaggggtcgccgggctgagcgcgctcggccgcttccggtgctgcgctgcggaactcagaggacttggtgttcggcaagcccagagactcaaacaccatgtccatggagggggggtcctcacgctgtgttcagcagggaggcgagagcgccggttcagccagagaccgctgggggaaccgcgccgaacacgctccgggcggccattttgtaactcgaatctacccccaaaaccaattcgaaaaaaggcaattcattttagttttaatgttttatagcaaaacaagaatttgctacagttttatttttctgattttgatagaagcaaattcattgatatctttaaaaatactttggggaaaagctaatcatttaaacaatacacagaaaagcatgtatataggtgcacatatttttttcttttgccttctgctccaatgtgactttcacgtggaactgaggacaaaagtgtggttgagtgaacctgttctacatggttgtgatataagttgaaatctaacagagaactttggctatatgaattcattcaatggaacaacaaaaatctagagaggtttgccttttaaactcttagactaattattccaggaattgcctcagtgcttatgttagcttggtgtcagatatctgtactcgtaagaacaaagtcaaaagagaagtcatgaaatttagaatggcttcttcctgtcaaatacatttagaacatatttttggaataatttcaagtccattgggaacacaattactaggaatttgggacagaggtgacaatgagaatctgctttgagaaagtagatcataatattacagagctatgccttcatcagtttaaaattggaagtggtttctctgttattttctaccctggagtgttcttaaaattatttttatctcctttaagaaatttgcagcgcttctaaaaatgaaactgaaagtgccacaaatatgcttgtgctccaaatcagttttaagttaacatgcaaagagaattttggctactttttgtttggagtcaaatataaaactaaacaacatgtgcccagatttcctaccatggatttgcaaaagctattttgaaacctttcttggcagaaatcatattctgttatgattcagtgttgcactgtaaacagagtgtttagaaattggggtttgagaagtgtaacggctagtttccttaaaagaaaaaaaagattcaaatgcttggtttgcggctggagctttttgtaaattaatcaaattgagtgcagtgggaggggtgattcattaagtagagagctagtgaagacatatcctgtgaaaggcagtgggctaagtggtagggggagaaggaagatacagagtgctttcaaaagtgcctaaatgtaagtcaacagggcagtgtgccaattacagtgttataatgttctacagaagagggatgtacaccaagaatgccagcctggacctctggtgtgtcttggaagacttaaccaggaaggggacgattcgtttctatttgacccaagactgatgctgcgtggtgaaggagaggaactgcgttccaggcagaggaagtccagatgcgcaagagcagagatgggagggacagcacagtggcttctcagaattgaatatggtgttagacttctaaaagagctgtggtagagggagaaaactgtcaaaggaaatcagtaactgttaaaggaaaataccttaaacgtcctgttttcaggctgactaatgccttaggggagcaaatgagcaacagaaacgatatgagcaactgctgttctttcaaaatacccaggcagaggaaccggcagacgatgggcaggcaagtaagagggctattagttccctagaaaagtggagaggcatatttaacaagtaagaagtatatttacattcatatcagggtggggagaaatgcatcctcaggtagccactaaacctgggtacttggaacgcaaggggcttacaaaatattttagggaaaaggggttttgagctgtcagtttgaaatgattgtctcttaaaacctaacattattaaccttccccctcaaaatgtttgccttttcatagcatcgaacaaacaactgagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaaggtaccaagagtcctttgctttctctcactggtgacctttcttgcaattagatttggcaggaaatgtgttcatctagaaattttaaatgaaccaataagcaaattacttcccctagaaaattttactcttgcgtgtttaggccatttctctgatctaaaagttgtatgttctatttaattttcctctctcttataagaactctaatttaaaatttattcctgacttgataaatagtaaaacctctctggggtatgtgtgtgtgtgtgtgtgtgtgtgtgtgtgtgtgtgtgtgtgtgtttgggtgtgcataggtaaagcacacatttacctggtttggtattcaaagacccaagcctcctatgggtctccttcctctctctcccataagtgtgtgtgtgtgtgtgtgcgcatgctcctgtgtgtgtgcatgtgtgtataggggggctcttttccaaagcctgctggacagcagatagaattttcccgggaggctagttgtgattactaaacaaaaatagcagggccccgactgttcctgccctgaacagtgactcttctgaccatttcctagaactgatattgttgccaacttccctcccatcccctcccctcctctactgtcccttccccttctctcccttctgtatagatcacctctccccagtgcagcagcaataccaggacaggattgttttgttagtttttttctcaatgactgccaaagaaatagcaacatggcctggcagagtcagatagcgctcttgggcatgtgttttgtcagtctaattctcaacaccagtaactctgtgagtgtttaccccacctttcaagctttgctttagcctaatttgccctatgtggctttagtcacttggtattaggcttttttcttccactgtgttgtcaatcttatttctcaggtcatttaggggtagtttagtgctggtgcattcagaataagagctgagtagttgtccacgagttacctgttacccaaatctagaatgctgtctaacgttcacacagatttactttgctctgtacctagtatcaaggcccagcccctcatgttatttgatttttaaatgctaactaaccactatgaatcctgaagacctgacacaggtctcagttaatttagaaagtttattttgccaaggttgaagacgtgcacccaggacacagcctcaggaggtcctgacaacatgtgcccaaggtggtcagagcacagtttggttttatacattttagggagatataagacatcaatcaacacatgtaagatgaacattagttcggtctggaaaggtgcagggagggggcttccaggtcataggtagataagagacaaatggttgcattttttttgagtttctaattagcctctccacagaaggcaatgatatatgcatttatcttggtgagcagagggataactttgaacagaatgggaggcaggtttaccctaagcagttccccacttgaagttttcctttagtttagtgatttgaggggcccaaaatactttcacatttccccccttttctttttaaaaatctgttggagaacgcattttagaagaaaatgagtctctggcctcaggtttcgtctgatctctcatggctaggatggtttattcctagatagataggtcctgagttattaggaaagctcctttttagaaggttgtgaagtctcatgtcctgtgaagagaaaatagggggaggacaacaacaaacaaaagaacaattctggaaaatagatatatgccacattactctgaagtccatacatcagtaggcaggtatgaaagtggcttatgtatgtaaataggtcgctgctattttcttctgaagctcaagttgtttagcttcatttcacagggctttatgaaagcacatcttagtttccagtgactccaaatttggaaaaatggaggaaaaaaagaaggaaaaaaattgaaaacattattttgaagacatgtagctaagaaaaattagaattcagtccaaactgtagaaaataataaaaattgaaaaacattacacaagactagaatctaacaatagatgtactatagtttttgaaacataatttttctctctcccctttcccatttttatgaaagacaaatcatggcaggactggttttccttattatacttggcctaattctttgtatacagtgcagcaagaataattattttttatataagcttttaaattggctttgatggaactttttccacagaaggaatctcagagaagacttttttaaagcacagcccagccatggatttgtaccatgaaatacctatgagttgggtgaattcctctccttttgagctcctaacaaaaacctggggctcctgggcctgtcagtaagtgaccttttttacttaccacaggtcaggaaccctgtacagggactgtggagacaaaggtatgaggctagtttttccaagggactttttattggctccataagtcaagtttaattctttaaaggaaagcacactatttcagtcaaagccttggtaaaataaccagtttcttcaaatgtgtgctgttacaaatgaaaacagattcttattgcacttatgcaaataactgtattgtcataagtaaagaatactcacaaatagattccaaattctgtagaaatcaggtagttttaaaaacaaatatgctccaaattttgttcaaaggagtatactccattgttaaaaagctgtaaatagcttaaaagtttcttgattttgaaaaacaaattatcagcaacattttaagcaaaaagttaaaaaagattacttcaaacttctattagtttagtccatgcagttaattcttgttctgcttgatattcatgaacatttcagctctccatgagtcctcgaagttttttctctattttgatgtcacagtctccagagctatcagaaacatgcattcaagaacacctgttaagagttttatagctgattataaaactacctctgaaaaggaccaaaaaaagatgacaattgtctgtgaataatgaaaagttttagggcagccatagtcagacattctgttacctctgtagcacacaataatttaacataaaaattataattattactgataacatacagtgtgtcatatcagaataataggagtttcccataattttggaatacatactaataacatatttatacaaatacagcccaaagaaaaccaaacaccatttcatattggacaatgcttcctgtataattttcataccaaaaaagccaaatatgtcacttttggactttagggaacccattaataccatcttaaaggactaattagttcagaaaaagacataatgtataatttgatttcagaaagtttgtcaaatatcaaaggttttaaacacttaatatcacaaaataggattacaggtcattgtaaaataagtcattcatttagccaaagtgataaggatttcaaaacaaaagggcaaaaaccttcattctttgagagagaagacttaattttctaaacattaagccctaataaaaaaacagcatgaagccaattagttttccaaaattttataaacaatccataaaggtttaatcttgatcataagatatatcttccatgagccttttatatctttgtaacctttattaaggagttggttaatgttttaagaaaaccttgttaatttgacatgggttgatatgctggtcttgcatcagtgtgcctttgacattaatggttaatttatagagaaactgaactcattttatctctaaaaattaactttgtgatctcacaagcccacctcttctgcaatagcccctgggccttgaggagttaaatgcctttaatttctggccctgcgtctcaggaatgcagtttattttgattggcatcttctagggggcctggagatgaggttttaattgctgtcagtgtttgagatttagcaggacttggtgttctttttagacccaagagtcaaagccctgtaactcaatgtcacaaggactttaaaagcacatacaggaagatacaagaatgtaataaccttaattaaaaaaacattttacatctcagtttttcctaaggaaaccaaacttaataataatggcatgggagttattttgataaatgtaaaatctgttaggccagttaccaaaaggcaaaagaaaataccttctgcagtgcacagaatattatgttggaagaaaacaattcctttagacctttaaagaaatgttgttagcatcaggccaccaaaaaaagaaactgagcagggaaaaaaacttatatgagctgaaaattagttgaaggggagtgttactatttcacactttttaaaagaggagagaaaaccaaaaccagcgagatgtaatataagtgtataagtggcattttttttaacatcaaacccaacctctagaaagaccattattatttccctttaatcataggcaacttgatcatataaaagtttttgttttgttttgttttttataaatcttcttcttgtgacttatacagattgttcatgacatgcttgggctttctggtttgtcttgaactaacttccttccttcctttctctctctctctttctttttctttctttcctttgttttttttgagatggagtctcactttgttgcccaggctggagtgcaatggcacgatctcagctcactgcaacctccgcctcccgggttcaagtgattctcctacctcagcctcctgagtagctgggattacagatgcacaccaccatgcctggctaatttttgtacttttagtagaagcagggtttcgccatgttggccaaactagtcgcgaactcctgacctcaggggatccacccgccttggcctctcaaagtgctgggattacaggcttgagccactgcacctggctgaacatccttctttcttaaacagtcattttactctaggactaaatttaccatacaagattctttctcatatggaattatttctctttaagctttcttaccgaaaaaagctctttatttttataacttgctttacatgtcttttatttcttggttccttttaccttgttttgtacatgccctttaaataagctttgaattagacaaaaagtgttcaccttttttaaaaggacatactgctttttttttttagaaagaatgttttcctacaaatatatttttattggaaaatgcccaaataatgaaatatctattatttaatataactttagattctaaattataatgagtttgtctacaagtatttatcctattacatttacctaattattttaatcatttacctagatcacttgtaaaaactgcgattgtcattatttgaagttatggaattgccattgcaaaattataactgagacagtgaaaaagatttgacctaactgactccatcctgctcttgcttctaacctccaagctgttcttgttcatttctggttgtaggtaggccaaactaattttgggaggaacttagtttatagtttagctttgaaacaaagatagtaacagtcctttcccaaaacaaactttactgctcgtgaactagactgcctaaagccacaagattagaagttatggtaatcttactaaattcaagatgttgctattttaattaaactaatatcagtgtcttatttatgaaagattacacaagtaaagatcattctgtcttgggctgaatttatagttttgtaacccctgtgccaaagtttgacaccttatagtatttggcagggataataactatgaaactgcttgattaataaatgtaaacaaaaaatgtatgctggcaattcttaagacattcctaatattactttacgaataatttttaaagctagcttatttattaaaaattttacttaagttatgtaaagttgaaaaagcattttactagtcttttcttctctcctgataatgtatttatttatgtatttatttatttatttatttattttttagttagagtttcgctcttgttgcccaggctggagtgcaatggtgtgatctcagctcactgcaacttctgcctcctgggttcaagcaattgtcctgtctcagcctcccaagtagctgggattacaggtgcttgtcaccatgcctggctaatttttttgtatttttagtagagacggggtttcaccatgttggccaggcgggtctcaagctcctgacctcaggtgatctacccacctgggcttcccaaagtgctgggattacaggtgtgagacactgcacccagccaacacttttagtttcttaagccaattaattagagctctttcatacattttcagtagtgaaacagtgtgtacacaacatgtaaatacatagatatattgggcatgctgatagaaaagtacatcttatagatttatagaaacctttttttccccttagactttcagattcctgataaactgtttcacaaccctaggcagttgtcagctaaatagccttaaatttgcatactaaaggaaacaactcgggtgaaaatgatatagcaaaagttacatcataaggtacagagaggaaaaagtctggtggtgttagagggagattaaaaatggatgccaaattaaacataaaattatagaagtctagcataggattctataaggagactaattttatttaggtagggaatgactacctatcttttaactggatctctgagctctgggcagagcccatactgaatcctgggtctccaaaaagggagaattaatatgagattaggctacgtggtgcttttacagtgcactcagaaaaaaaaaaaaattaaagacatttctaagtgtctaagccacattcttccttaaaaacccaagagtaacctctgttgcaataactattttagtcaaaaaaaaaaaagtaacacaatacaaaagtaagctgttcgagaactgagacaaacttgtctgtttacattcttgaaaaaatttgttttccctggaaagggagtctggtgccttctccattttctttaaggaaccccaggctattataaactattttaggtcctccatgcagcagagggtgcaagagaaaggagagatagtagaagtaaatgaagaaaacagaattctgtcaactgaaaagaaaaaaacttttgctcaaaaaaaaaaaaaaaaaaagacaaggtcccaggagaaaaacaaaaacatgaagtccttttaaatacaaacacacacatatgcgtgcgcgcgtgcgcacacacacacacgcacgcatcttggatgttaggttttaattaagctgacttttaaccattgagctccttaaaaaaaaacttttaaaatctcattaccatatttcagctaggacaaattgctgctatttcagaagtacagccattgctctttcagtttggcctggctaacaaaaaggtggccttgttatgtaaatgaagacccttagaataaaaaatttttctttttgttttttttttttttcctttttctggccattttttcccctccaccccataccacgtgtgtgcgtgagtgtgtgtgtgtgtgtgtgtgtgtgtgtgagagaatttagccacttcagaggccttgttccccataatttggaatttcctttggatttgatcaagttggatagagttgatcaaacccaatgggaaaaagtccaaaacaacagtgaaaacaggaatgaacaacaacaacaacaaaaacagttaagcaaaacaatcacacaacttatatcattactgagtactctaatagtaaggagaaattaagaccagctggttgttaatcttaactttagccaagacaaaccccaattcagttacttagctagggatgggtctcagggtgtagactgctctctaccatactagaagcagagagaaaaaaaactcatcttccctgttggaagtgagctcaaactccataaaagagttacctgtcttccatagccatggaaacaggaaatcttcccttcctttttggaagcaagtaaaagtttttttggaattttacttgctttttttttttttccagcaaaataaactttagatctctaccacatttggggacatcagggattctctggagggggtgctctcaggcctcagcaaattgtcctattggtttgagccataaagttagctcatgctggtaccaagcatagatttgtcaaaggtcaggggcatctccactcagaatcccttcatggttaccaaaatgtgaaccctgaaaatctgagacaggtctcagttaatttagaaagtttagtttgccaaggttgaggacatttggccatgacacaacctcaggaggccctgatgatatatgcccaaggtggtgagagcacagtttggttttatacattttagggagacaagagacatcaattaacatatgtaagatgaacattggttcggtttggaaaagcaggacaacttgaagcagggagggggcttccaggtcataggtagataagagataattggttgcattcttttgagtttctaattagcctttccaagggaggcaatcagatatgcatttatctcagtgtgagcagaggggtgactttgaatagaatgtgaggcaggtttaccctaagcagttcccagcttgactttcccttttagcttagcgatttggggggcccaagatattttcctttcacaccagtattgcacctgtagcttgcttggctcctcagatagggctgccagcttgaccaataaaaatacaggatgcccagttaaatgtgcatttcagatttaaaaaaactaatgtatttttagtataaatatgtccaaagtagttaatgggacacccttttagctggcaactctgctctaggagaacctctaagtaattccctgatggcccattttgatgttcttccatcttctgggtggattcaagtcagtgaagcctcagacatagttctgtcactggtaaacttccgccagcacttcaaggtgttggagttttctcttccaactattacagctttgggactctgtctctgggtttcctctcctagttttttaacttagcgggccatttcacagagtgccacttagccagccatttaaggaggccttaaagtttactgattaagagcatcatctctccttatagactacctggtttagaagcctgattccacgacttactagctaggtcataaccctcgacaggtttcttagcctttctggacctcggtcttctcatttctaaaatgaggatgaaaatattacctactttgtcaggttgctgagaggattaagtgatgccaaacacataaaacttaaaagaatgccatatggtggtatatggcaagcacctcaaaaaagtgaattatagttactatttctctgcaatgagcttcttgtgtagcttatatagagggacttttttacaggaactcagattgtttttgtatctaatatgctcatctaagtatagtgattgctttcccacagactagcctttctcttcttcattcaaagccttacaggtgattgacctgttctcttgacacattagtcctcccctcttagctctcctgcccatgaggaagcaggttctgccagctttattcccagatgcagctcaccaagcatttgcacgttgaaactgcatttctgtgttaacttatgctctgtattctcccatccacttctctgagttcagtaaattatagttggattctcttcgtagctatttatctgaagaaactgtcttttctagtttctaggttccagccaagaacagagacctacctgttctacccaccattattcagccatttttcttctcaacacaaccaagatcaacaaatcctataagccatgattctcatctttaaagcctatcaatttttcacaacctcctctaactggaaaactgttgtctccctgtcatctatgaccgcatggttctgccaattttccctttcatggcctggcatgccaaatagctgcagttggaatgttccatcagaattaattgaaaggttgttggctacttatcaatgagaaaggagtcataaaataatccttcataaattgaagcgtggaatatgctttttgcctcataacttggagaacatgaaataattctggatataatgaaattcagaaatatcagcatgattcacttatgttaaagtagatgtttttagttttaaaaaatttggtgtttctggtttgcgacagatttctttatttaaaaaaattctttaactcttaaaaccaacaaaaaatcaccagaaacaccaccaaaatagaaaaaacggaactatttatatcccacctctagccactccgtccccctcaaagttgtggtaagatggggaaaagatactgagcaacctgttttattacagtctggttctcatgctaaaacagggttgctagtgttaaataaaaatacaagacccttggttaaatttaaattacagatttatcaactaattttctgaataaatatgtcttaaatattatagaaatcatatttaaaaattcattatctgaaatccatatctaactgagcatcttgtattttatctcacatatatgctgtaaaatcttaaactataagatcttttctctttgaaatatgtaacctttggttgactattctaggggtcaaggatttcagagtgatgtaaattatagatatatatttactactacagtttttccttgtattggccccagttggatcttatccagcttggcttttataaaagaggtgtttctgaagacttctttattctgctgtctctgttctctaaaatgtgtcattttgtgacatggagtttatcttcaatttattaattttatttctaaaattacctattgatgattaggctttatcttcaatttattaattttatttctaaaattacctatttatgattaggcttttttttaatatttaagtattagctattgatagtttttgttttaactaattccattataatttaatatcattatgaaagaatacatttaagcctaataaagattaatttttatttttaccatttcttttttttttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcccggctaattttttgtatttttagtaaagacggggtttcaccgtgttagccaagatggtctcgatctcctgaccttgtgatccgcccgcctcggcctcccaaagtgctgggattatagacatgaaccaccgcacccagcctaaagattgctttttaagattaggaaagaaaaagaagtcagaagaagccaaattggtaccgtaaccaggtggatgcctaatgatttcccacagaaactctcacaaaattgcccttgtttgatgagagaaatgagcaagaggcatttttatggtgtgattctggtgaagctttcctgggcatttttctgctaaacctttggctaactttctcaaaacaatctcataataagtagatgttaccactctttgtccttgcaaaaattcagcaaacaaaatgccttaagcatctcgacaaactgttgccatgacctttgctcttgagcggtctggctttgctgtgactggaccacttccacctcttggtagccgttgctttaattgtgctttgtcttcaggatcatactggtaaggccatgtttaatcttctgttacagtgcttcgaagaaatgcttcaagatcttgatcccactcgtttaaaatttccactgagagctctgctcttgtctgcagctgatctggatggttttggcagccatcaagtgcaaagtttgctcaactttaatttttcagtcagaattgtgtaaggtgaatcaattaagatgcctgtggtgtaggctattgttcgtgctgttagttgttagtcctcttcatttggggcataaacaagattaattttttctttgcaaatggatacggatggtctgccattgcaggcttcaacttgaacgttgtcttctctcttcttaaaatgagttatctatttgcaaactgctaatttctttggggtatacatgcacatgtaaaattttcaaaaagtacaaaattaaatagagtaaaaactgaattttctctccttctctgatccctagtcaccaagttcccactctagaagcaactaccattattatttagtttcttgtgggtccttctaggggtatcttttgcatttgtaaactagtacatatttataatattcccttccttagtagcagactgtatacattgtcctccactttgcttttttttctgaatggctcttgaacttagaaagcaaaagaaagataatattgaatatccctgacaagcaaagtgttgacccagaagctgctagtgagacttcaatttctctttccctcccatccattaataaacacagagatttctattttgtacctgggcatgagggagaaaaaggaagggaaattgggtggtggagtctgtggtttgtggggagctaaaaatgggaattgttctggcccgtagaccaggttggattgcccaagctcaggaaagtggcaatcagaaaaataatggcactatttttaggagagagttggaggattcgtgggaagtaggagatggccagaactcgttatctgacaaagaagagccatttcacgtcctggtgtccacatgtgacacacaattggagaggaggctatttcttctacctacccttggaacctagcaatgatgtgacattcctcaaactcctaggcagacaatgtgaaagattataagccagggtaggaaaagagggaaaagcagacaccaagcagttacagatcaggttgtgggcatgtgtgtagcatgcttctggggaagtccccaaaatacgttcgggacacttgaaaatgtgctaatttctagtcagcaaaacagttggggctcttgccatcatcatttgtgcataaagatagactgcaactttattttatattgtcaatctggtgaggcctgggaaaattgggttatatgtaaaaatggaaaatgctaaatatacaacatatgcaataccttgtaacaggatggtgaaatggaagttgaggttgcaaaacaacagatgcccattccaaattgaagttctgagaaaggatttacaaagaggctgagaaccagtagatcattcttaaatccctcacccttataaggaatactaaagcatagaaggggagtttgaaatataacttcttaggaagagttatttggaaagctgtactgagagtccatgccccttgcaggggcaacttctgagggatgccggcccctctccttaggccagaatttagctggaccacctctagagagtctgatatgtgttctccaaggttaagggacacagtgggctggtgtctgattctcccctgagaaatctcaaggatgaaagattggccatgtagctgtgacagacaagctgaaggagaagaggttgtgttaggcacactggcactcccagaattcagtggggctagaacagttgagtgtttcctatggatgtgatgtggaccatgaatgggaggcataaacgtagagtcattctaggtccaaaaggcctgcagagaaaagttggatgtattgctacgttgctaggggctaaggaaagcataagtaaccaggtagcatagagatacccaggtgcagagaacttcaggtgggtgtttccaagcaattggacggatcctcgcaataacccactgaggtatcccttagaatcagctttaagcaaaagccaagcccagatagtgctgctgctccgtgaccaaaggacctttgctctctttctttaactctcctttttcctccagctccatgtctggaagggtcaggaaccttggatgaaggcatgaggggagaggaggaatagaagcattgggtgaggccaggcatggtggctcacacctgtaatcccagcactttgggaggctgaggtgggtgggtcacctgaggtcaggagtttgagaccagcctggataacatggtgaaaccctgtctctactacaagtacaagaagtagctgagcatggtggtaggcacctgtaatcccagctacttgggaggctgagacaggagaatcgcttgaacccagtaggcacagaggttgcagtgagccaagatcacaccattgcactcaagcctatttctgatacacaaagcaaaaaaagcatgttataaacattataaatagaatgactcaattatttaaaaaatacatgcataagcacatgtgggtgatataagagcagtcttagattacctgttaagggagctgagctggaagcttcctgggctatgcctccaggctgtgggctttgaatataatacctttaaattttttttaggctcaaattattataggcatactatataggcgtgaccactgtcacccatgtgtctctgtgagaccaacaccaaatgcctttttagacaagagtgtgttgccagcattctcccagttctcctacaaacaaaggtgttacttattgaggtatgtgtcctttgccattcactacaaggaaatagaatgctattttgggaagagttgctaagtgttttgactacaaattcatcgtccctccacgtctcaaacaggacacctggaccactagctattttctccagtgaactccaccctgaatctgttgacttagcccagaaagcctgccagctgccttattactaggagctggttatgtgtgctgtacaaatactgttaaatttatttgacataaaactgataataaacataggtttgggtataaacactgttagtttgtgtaagtgaaaggacaagagactatgaactttatgaatatataaccaagtaatctacaactgcttaggggcttttatgaaaatctctaaatcttttgatcaagacctttacagagacactgtagcaaagtgttaagagcaaaggcaatggggccttctcacctgggtgcggatccaggctccaatagacagtctggggacactgggcaatttagtcaatccctttgtgctttaatttcttcaaatgtgaaatagaaataatatttttagtagccgtcttacaaaaaacaggttgttataaaaaaatgtttaatttaatgcctgttaaattcatggtagttagtacacagagcataatttatttgtatatatatgtctcaaataatctgcatatatccttgggactgggaccacaggagcagaaataagggatttccctcccagcaggaagttggatgcactggaaaattagattaaggctactgttaaccatcatgcaggcaaaaggcagggccagagctggcagcagggtcagtgggaggacaggaaataacaaattctgggaatttcagccttagctggagtgaagacactgccacgaagggaacatttgttaacagagctcactttttagtccagtgctaccaacgctgtagggatttcataccacattctgagaaagataagggcttgatccacctggggacatgttatcagtgatgagcatctgattttattattattataaaaaataatatatgttcacaattaaaacgttggaattcagaaaagtagaaggaagaatctcacctacacttgcatcacccaaaacattttagaatgttttgttctggtggttgctgtcctccctctccccatctccttcctccttccttttctctttctcctcttcctcctcttcttcctcttggtaagaaataatctgtgtaccacaaaatttacccttttaaactgcacacattaatcctttttaaaaaaatattcaaacgttgtgcaaccaccaccactatctcattccaaaacattttccgccactcccaaaaaaaccctgtaatgattgtcgtcctcattccccttttctccaagacactgtcaaccaccaatcttctttctgtctctatggattttcctattctgaacatttcatatattggaataatacaatatgtggccttttgtgtgtggcttctttcacttagcatcatgttttcaagattcatccatgtcatagcatatattagtacttcatttacttgacttttatggctgaataacattccttgtatggatataccacattttggctatgatgaatacttttcctatgaatatttatctaatttttatgtgggcatatgttttttgttctcttggttataaacctaggaatggaattgctgggctatatggtaactctatgtttaactttgaggaactgtaaaactgttttcaaaaggactgcatcattttacattctcattagcaatgtatgactctgtttctcctcatcctcaccaagacttgttattatctgtctttcttgttgacatcttttgaagcacaaaagttttaaattttgatgacatctaattttttttctttggaccttgtgcttctggtatctaaaaaagtatatggttagaataactaagtcttttattctaatatacttattagactaacatacacacacatagataatagtctaagagagagtctaagaaatatatctatttctctctctctgtcacccaggttggagtgcagtggcatgattacggctcactccagcctctgcctcccgggttcaagcaatcctcccagcttggcctcccaagtagctgggactacaggcacataccaccatgtctggctaatttttgtatctttttgtagagagaaggtcagactatgttgaccaggctggtctcaaactcctgggctcaagagatctccccacctcagcctcctaaaattctgggattatagatgtgagctaccacgtgtagccagtctaagaaatattttttaaattgcctaatccaaggtgatgaaaatttattcctattgttttaagagttttatagttccagctcttatatttaggtctttgattcattttgcgttaatttttgtacattgtgtgatgtaggggcccaaattcattcttttgcatgtggatgaattgcagcaccattttctgacagactattctttcccctattgaattgttttggcatctttgttgaaaaatcaattgatcataaatataagggtttatttttggactctttattccattgatttatatgtctatccttctgccagttccacacattttgattactgtagctttgtagtaagtttttcaaattgggaattgtgaatccttcaattttattttctttttaaagatagtttagttactctaggccagcttgtcttgagtctttagggtcagcttgtcaattcccagggggtgaggtatggggggggaaagcagccagaattgtgattaaaattgtgttgactgtggattaatttagggagtattaccatcttatcaatactcagtcttgatccatgaacatggaatgtctattaatttattaagtcttctttaatttctttcaacaatattttgtagttctcagagtataagttttatactactttgattaaatttattcctaagtattttattctttttgatgctattgtaaatggaattgtttgtaaattttatttaaaaattaacggctagcgtatagaatattgctgattttcaaaataccttgtatcctttgaaggttttaatagtttcatttgtagatatcttagggtgtcctatatacaagattgtgtcatctgtgaatagagacagttatctttttcctttacaaactggataccttttatgtcattttcccgttcagttgcctccatgtagaaatggaggttttagccaaggaaactgcttgtctggttcctgcttttagggggaaaacagctgtcaggttttcttagatgcctttttttttttttttttgacggagtctggctctgttgcccaggcagaagtgcagtggcgcaatatctgctcactgcaacctccgcctcccaggttcaagagattctcctgcctcagcctcccaagtagctgggattacaggcacgtgccaccacacccagctgatttttgtatttttagtagagatggggtttcaccatattggccaggctggtttcaaactcctgacctcaagtgatctacccaccttggcctcccaaagtgctgggattacaggcatgagccactacgcctggcctattagttttctgagtgtgttttatgacaacaggatgttggatttttttcgaatgccctttctgtgtcaattgagatgatgatgtggtttccttctttgttctgttaatgcagtgtgttacattgaatgattttcaaatgttgaatcagccttgcatctttcaaatattgaaccagtgtggcataaagtccacttgttttatggcccaaggtaaagtgttctctgtatgtctattaggtacagtcagtttatggtgttgttcaagtcttctattccctgttaatcttccatctaactgttccgttctctagttttcttgttagacttaatttttcaaacagttattttatgtaaaccatttttgcatcttgtgaatattatgatattagacataatgtcagattctatgcacatataattttatgttcacattaaatattaactaatatatttagccatttttctgttagaatttaagatcatcatagttttatttaaaattaaaactggtatttttgcgtttaagagcttctctgtatttggagttgtttcataaggtagttgaattactggtaaaatagtatggcaattaaagcattcaccaccaaccttcatatacttcagcctgaaggtgggcttcacatggcccaatagcctcaatgtgaaagtaatggaagacatataggagtatatttctgcaatctagagatagggtggcacttcttcactctttggataacacttcaaaagtacagctcatagggcaacaaaaattttaaatatggacgaatatgattttattaacatgagatttctgcttaatgaaggagaccatggacaaaattgaaagacataatgacaatttgagagttttttgcaatgtttataatcaacaagggattaatatcaagcatagagtaggaagtaatgcaaattgacaagaaaaagacagaaaaataaaaagggaagaaagagtatgaactagcattttaccgaataaacccaaaggctattaaacatatgaagatacttactaagtagtaatcagaaaactgcaagtgaagcaagcaagtttcactttacatcatttagagtagtaaaaagctagaagctaagatgatgccaaacgtcagagacgtagaagtcctcatccatgtgatgggagtgtggctgttgcagccattctgaagagtaatctggcagtaactagccagatgagttttttgtttgttgttcttgtttctttttattttgttttgtttttagagccagggacttgctatgttgcccaggttggacttgaactcttgggctcaagtgatccttctatctcagcctctctagaagctgggagtacaggcatgtgccactgtacctggcttctgatgaggtttatgaacatactaggatccataaatcctgctcttgtttatacctcaaagaaattctgttgtgacagaacctaggagtctacccctgggagagtgaatttgtaaaatgtggtagacatgaaccgtggaatactcaactgcagttagatgtgggctagatgtacacatggcaacatcatgggtgtcaaaatcatagtgttgagtgaaaaacagtaagaaacagattggagacctaatgccatttatataaattaaaaatgcacacacacacaatataatacatattttgcacaaacatttagaatggcaccttggaggggaggaaaatgagaatgggaactagagataaagggaataaataaataagattaaaaagaaaagagctttgcatggatcagatacatgtcatgaactagaaagtatgactaacacaaccctttccacttgatgtcctaaacgaatgaatgaatgaatgaatgagttcatcatatgtgccttctttaatatgtatagcattaccatccattctttggcactgacaaatttttgctcccactgactggtttatgagcgtgccttttctccccataccttaccagctcagaacattcttagtctttcagactgttctcatttgaggcaaaaattgcatctcattgtttttacttgcatttttctgtcaaatatgatgctaatatttcactaaatatagtttggcaaaatgtgtttgctaaattgttttggtgttagaagtttttcattttacatttgtatctattcagattttccactgggattatttccattgctattaaatttaaaagtcctctcatatttgatattctattttatacattttcatggcttggtcgttttgtgtccttaatcaactagaatacttagagaactaattgccacagcaccatgttagatggtccacatatttatgataccttctttagaataaacagttaacataattaggatccactttttggctgacctaatgtcaataatcagtgatttgattattatagttttatggtatatttttgttccatttcgccttcattattcttccttaaaaaagattttagggactaccatttgtttgttttttctggataaaattataacccaaatgacctagattttatcagcttgtaaggtcaaattaataatactatattctcatgaatttatttataatagttggcagatgtcacattcttcgttgcatctatgcaatttatctttgtgcaaggagcatagcgatctttatggtaattgcttcagaacgatgattaagagttacaattgcttcttggccttttggctaagatcaagtgaagaattacagacttatttttttctgcatctcttgaaaaagaaaaattaagaaggggtagctatcagtgcaagagtttcctgagggtctcccataatacaattgtatttttctaacgagtttgctagtatataggtttgtttgtcctacaatgaacttttaaagttctatatattcctttaagtataaaataatgaccataataatactattatttattaaatgcctgctttgttccaagcatggtgctagacactttagtatctattatttcatctaacctccacgacaactctatgaagttatgtatcataattttatagatcagaaaactgaggctcaggatactgctaataagcagcagaaataggattcccacccacatgttcccaaagccagcattttttctagttcatgactctaattttcaacaatcatataaccttgaaataataatatgtaccttcattataccacttgcattttcaggaacatcgttcaataatgcattctttatgtattcctgattttattaagaaagccatttgtgtttcaccattaaataaggtgatagttatgactaagaaaaatatttttattacattttcttaagcaatgtttaaaaggtattaaaaattaagtgaacacccatgtacccagcacccagcttaagacataaaatattaacaacagaatatatatctttccttgattatatcacatatcctcccacccatgctctggaggtaatcacttttttgaatggggcttcaggatagctattctctattccctcagctttattgaggtataattaattagcagaattgtatacaaatgctcctcaacttacacatggtgtgaagtcctgataaactcatcataagttgaaagtactgtaagtcaaaatgtagttaatacacctagcctaccaagcatcgtagcttagcctaacatgctgtatgcatactcagaacatgtacattagcctgcagttgggcacaatcacctggcaacatggtccactgtagagtatctggtgtttacccttgtgattgcacatggctgactgggagctgcacccgctaccgctgcccagcatcttactgtgtatcactagcccagaaaagataaaaattcagagtatggtttctactgaatgtgtgtcatttttgcagatcagatgcccctccctgtgcattcccatagcgcctcgaagtcatctctatcaatcattcatttagtcgtaaggaagtcttgtttgtatatgtgtatccctgacatgactgagacctcataagttctctaagtgccatatgaataaagaaatgaattggtgttcatcttaagtcatagtctctgcagatattgcttgatctaagggagtggcaccctttgttttgattttcctttgatctttggaagaccatgcattcctatttcagtgatgcttttaaaaagccatttttgtcattaatccagatttgttctcatttgattctagttgttgaaatggatgaaaacaacggacttttgcttttagaactgaatcctcctaacccttgggacttacagcccagatctcctgaagagttggcttttggagaagtacaggtaaggaaatattaaaaggataatattattaaaaacaaaaacgtgaccaagatgtccatttaacatctatatctgtaaacatcctatattaccttgaatactgtttgagatgggtatttaggacatatggtaaaaagtcatatgataaaacaaattctttaaggaacccccagaacttggcagggattacaaggaaaaaaacaatacaaaactttgggaaaaatccctaaggaaactcatgcaaaactatttgatgccagatcactactggatagaatggctggttgtattttctggctttagaagagaatttccttcagaggaaacactttaatagtttgggagaggtacacaatcaaaaatttatttttctgtgtatttaggaagtttatgtatatttgggcagctaattttaaggaaacaaatgagaacctgcccggaatagacataataaaaactaatctatgccttgacctttcctcacccactttgttgccttttcacatgacgttcccgctatctcatctctgcttctcaatacattccttttccatggaggtgccaggctgtggcaagagaatgaggaattggatttggaatccccatggtgccagtctctaagtcactgtttgtgtccattcttagaggaccttggcatccagaaggagtaattatttaacaggtaatttagaagagaaagtcttgcaagcctgttcagccagttgtcagttgagtctgcgtggctatgccaacccaccaaactcacgagaatcatccattcatattgctcttcacagccactctggcatttaaatccccagatgtttgtgataacatctctaactgcctttccttgtaaagtatgctttaaaggactgatcacaaaatatattcttcagtgtggactgtaaataactgtttaggaactaatttaaataaactaaaactaggtaaacaaattgatttgtcatctaaaactaaccatgagaatttatatttgaataaagtcatgacctgtgctgggaaccgtgttctatgaaaggctctttttggaatgtatttgagtccaagattttgcctgatcatgcttagaagcaaagtactccagcctgtgtactatgtcagccacccaaaccaaacatttcagttcattgttgctgaccagtaatgaacgattcagtaatagggatctcactctcttttaacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgaggtaatgaagtcctgagcacacaactcctaagctcatgctgcaggaaaggcatcaaatgttctccgattcttttgcaatcactgctcactttgaagtaggttcagttgggatgatgaaaaaaggactaattaagataaatatttacatttgcatagaaagtttatacttttaaaactgtttctagaaagacaaatatggtatgttctaacttataagtgggagctaaataatgtgcacaaataggcgtagagagtagaatgacagacactggaggtttagaaaggtgagggggtagcaagtaggtgaatgatgataaattgtttaatggataaaaggtacatgattaggattaataatgctctgatttcaccactgtgcaatctttggttgtaacaaaattacacttgtaccccataaaattatacaaatagaaaagcatttctacactttacaccattgggagtgaggaaggagctattgtaaggaagataggggaggatgaataaccgtctcacttcccaccctaaggcagaacacattttctataaagggccagagtgtaaatattttaggctttgcaagccatacagtgagagttgcaaccactcaaccgtgctgttgtaacccaaaggcagccatagatggtcctgaataagactgactgtgttccaatcaaattttatttatggataatgacatgtgaatatcatataattttcatgtattacaaaatatcattgtccttttgattttctttacaaccatttaaaaaggtaaaaaccatctcctcagctgtgggcaagcttcaaaagaagaaagaagccactcttagcttgcaaggttgtacataaacaagtagcagcaggttggattcggcccacacatggtttgccaagccctgatttatagtatcctaacactaaacacccaacgtagtaatcctgactgaacctcacccaatgtttcattggaaccagagtaatatgatactaatgatagcaactgaaattttccctgacccagacaattaaaaaggagggagaaaggaggactttaagttaagaaaccacacgtatttgcaaaggtactgagctattagaagagggaagctcatattctcaattcctttgcttaactatagggtcatatttcttcatcattattttgaaatttgtatcacttctgctagattgccagtataaacacacagcaatgcccataatgtgctactcaagcaattcgactttgtttttctgtgaccctacatgacaaaatggttagggataacatgttggttgctggttgactggccccttgatattttattctaaagcatatgggaactctaaagtgtggatatgctctgatttatttttcagggaagtgtttgtttttgtttttgtttttgttttgtttttttgaattaactgatttagtaacaaattgcctgcaacatatttcttaactgatcacaaccccctaggatactgtggtactacaactaaaattctactttatatgatacctttgtcccacactacctcctggaactatacttgcataatttcaggattacaagagccctgagttcatttgttgtacaataacagtaaagtgtggtaataattttatatagcttgtgtagggacaacagcacataaatgatatgatcgctttatagtgtctaagatacaattacctaaagtcttaatgagagacattctatgggaacacactaaatttaagaagggtaagaactttcagggagggtaagaactcatttagttgagttattctgtaactactgtcctgaaaaccaatttagtttcatttcaggggcttgtgtggacagttgtcatgcattaaaacaacagttttcaactatagtatcacaacacattggttgtgcagtgtgttgcagatagtttattattgaaaaggggccaaagcctgtgatttttactccgttgggtctatttccttgatagacccttacttttcgactcttgcctaatcaactaataaacatcaagattgcttgtccccgacccttctgtctgacctttatttactgaataaagcctccctggtttacaaaaaacaagggaaaaggccagtgtactttggtggattgccagtaagaattattagcaattgaaaaatccaaagcaatgaacatccattttaaaataacttaccgtaactcccaaagtcctttaaaatgcaggatttcgttgctgaacccagagattgaaggtacattcaaagaatcattgattttttgaatcttttgttttttggggagaaaggttgttgctcccctcacttccttccagattctacttatttggatagcttttaacgcaatgctggaacttgaatattagtacagccaagtgttgatatgcagatttttaaaatacttttcctatgattatatatcttattttacctgatcttatactctgtgtacaagtctgattcttaaaccagataatacgttcattaaagttagaaactttcttcttatagaagaagcactaggtttagaatcaaaaacccaaatttgaataccagtttactgtgtgttgtatatttctgaatgtttcctcatctacaaaaacaaaaaattcatagctttttgataagaattgactaacatagtatgtaaaactgccccagcaccaagtttgaaatataatagatgtgtaatcatttgtttgtttattaaactttctaccacaccctacagtggtataataactctgttatataatgaatgctcaataaataaaagccgacttaatatgtctagatagtcaaaaatacttggatgattgttgtgcactgagttgggattactacaaatgttggatgtagttcctcaacactaaattttactgtcttgcctagctggtaattctgtccctccttaaggatgaataatatagtctgttaaagtgtggctttaatatacaaaatatattatttatccttaaaaagggacagaatctttgaaggttgaaaaaccaacccccaaaatggtccgagacatgggcttttgtcctgtactatgtcccagtcctctctcttactgagagctactgcttgaagcatgcaaagaaatgaggatctccgtgatcttcatttctttcctctacagcatgactttttctcgtctgtgcctactgttagaactacccctccttcaagcagcatcactgtggaaaatggaacttgcctacctggttgatgtccacaccatgagcatttgatatgttctaacaacaaagatgaatcccctcagaatctcccgtcactttcacagtcatccttgaacagaaacttttctctggactctggtgagagtccagtttttcaattcctcacttctctgtcaatatgttggtataaggaacaaactgtctgtcatactagatgacactatttttttctcttttcaacctttccatctgtcttatcctagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtcagaaatctgctttctttccatgctttccagttatgctttctgtgatgaatgttaggtgagatagtcaccgtaagattaaggaaaaaatgggtcaatgtggtatgtccctgatactgcataaacacaacctctatttgtgattcaaatgttaggcagactgtcctgggcaaagatgattttctttctattaacccatactattatagtacaactctacagaacaggtaataaatctagttctgaataaggaaatttcttcaaatgtgaggttcaattgaccagtctttccagaacaggtgattaccttctcaaatactgaattaaaaaccaaactgaaattcacagttgttggttttgttgttaaattccaggtggacaaaaatcttcgattcatgatcttgatggacggtgttcatcctgagatggacacttgcattattgtggagtacaaaggtatgtttttatccccattgataacgaaaaatggaaaacattcttaataggaaggatggtaatatctatatgaaatttcatcacatgttcatcttttagctccattttgaaagaatatagcgtgttatatccttgttctagaaatatggagctatctttcaaataatttttccagaaaacaaattagaaataatgtcatctagatagtgacaggagcaaagatttctttcataaggcaatagatattttacattccacctatagtgatttcttcaaaactacatttattaaataaatgtcttttattactttcacctagaaatatcatgtaatataatcatgcactgcttttcatatgaaaagatggccttactgccccaacaatcatttgaatatgagctttgcatgtaatttgcaaaaggtacagggaagtatgttaatccacttttttctgatcctttgggctcaacacctggaaaaagttgacagaagaaagcagtctatctatgagctagagtggaattaagataaaagtcttcatgagacacctagtatccaccaagtcaaatgggatgaatttagtcgcttgaaaattcagaaaatatactattgaaagctttaagttttaaaatcttactgtttgtttttcctttgatataatcaattcttctataatcaaataagttcaattatacagactgtatacagaagtccttgtcttggaattcaaactatgggtgttcaagatttcaccttgaatatctatacctctttgtttctccacaggtcataaaatactcaatatagtagactgcaccagacccaatgggggaaggctgcctatgaaggttgctctaatgatgagtgattttgctggaggagcatcaggctttccaatgactttcagtggtggaaaatttacgggtaatattttgtatgaaagtgataccaagtatcacgcatggcacattgctaaatgctgtaagagtaaatacaaatgtaattgagacatgatccctccccacaagaagcatgcaatcttattgggaaaccagatttgtaagttgcagattaccaactaaggtttctagctcaaaacatgatggagcatgaaggaaatgttgagatctgagagcacctcaggaggagccaagaaagagaatcatctggattcaccatgtagaccgtagagcagaacaggaaaggcctgaagtgggtcatccaggcttaggtgctcttggaatatggttcctaatggggtgtgtgcagcctcaatgtagacacatccccttggcactgtggatgctcatatcagggagcagtgtgcccagaagagagtcctctagttggggacctctagtgcacccagaggagggtcctctggttgggggtcttaggcaggagcccttctgctctgggtccaagagtggggttggggttgacattggggaagtgtgtatcctcaacactagtattgtaagtgctcaatacatgtccacttaataaattaatgtatctgataagtgatccctgtctaacagtgtggcagaaaatgccctgctttgcaatatgaagataacctttgtcccgttctttgctttcttctctaagtctatattcattgcctcccagagtgtgtaaccacatgagaaatagagggaaggttctgtccttaagaagttaaaagtgtgactgggaaggtaaaacatacttattaagggttaactagcatcatgccattctgtgtgatggtgagtttgtgtgtgtgtgcacatgtgcgtgagtacacacatatacatttaaaaaggtcttgaatataccaaaatattatgtctaggtgatgggtagcttgtatattttttctgtatccttgtctgtgtttgtcaaattttatagaaacaataacagtaacagctctctgaccttctaccctgtatgttctgcgtcctgtctaattcctcaagttccttcactgcctgtcactctgatgcttgctatatatcagtccatcctgctttttgtttcttagacccaaagtgtcaagtgcacacctgccctgggtctttgtgtttgctgtttccatttcctggagtgcagctggccctgatttgcatgtgaccagcaacttttcatctatgtctcaactcaaatgtcacctcttcactgaccatcctgtctaatgattccctccatctcatcccactcaccccagccactctctgttccattgccctgttttattttcttcacggtgcatcattctttgcaatgactttatttacttgttcattatttgcttctctcactagaatgaacactccatgagagcagggacctgctttgccttgttcaccactttattcccagtggctagaaccacgtctgacacagagtaggtgcacaataaatattggttacgtgaatgaataagcaaatgaacagcactgtgagaagggcatcatgactccatttacagagaagatacagacatggagaagttaggtagtttgcccaaggctgcccaaccagtaagtggtgggtcaggattttcaacctaactgactccaacgtcatgctcttaatcactgtgtatttgtcagattatgttgaacacacctgttataatctacaaatataatgaagccattttcatgttagtaaagagttaatttcaagaattacaatgcccttaaaatgtgcatgcacaccaactacgattatgcatcctaccctgtgtattcagctagggtccgaatgaattgccatatacaaggagaaagctcagtgcctttggctggcttggtaacattttcctagtaaccaattgaaatttccaagataaaaactccggggaaatcctccactaatgacatggagccttgttctatttctgccttagttacctatcaattttatctcctgaaagagttccaatctgctagaatatgtgtttttctgtgatttttccagcagaggagactccaatctaaatcctgtcatttcagaggaatggaaagcccaattcattaaaacagaaaggaagaagctcctgaactacaaggctcggctggtgaagaacctgcaaccccgaatttattgtccctttgctgggtattttgtggaatctcacccatcagacaagtatggctagacactttgtacatttttacatacaacttaacgtatggtggaatgagcgactttgctgtgaaagcagtgtgacatgagaaggaaagtgattagtaggtgtctggaactttttaacaagctgctggagaacccagagcatgaataaaagttacacttggcagccaggaactctttcagaagataaaataacagatagatattctccgaaaggatcccaggaaagaggatggcaactgccatttattatgtgaagtgaactggggacttttaactaagccatctaagttaatctcccaatagcactatgcgtaggaagggggtattgttccttttttgcagataaggaatctgaaactcagaaaggtcaagggacgtgcccaaagtcaccctgttggaaacatgagttgagaatggaaccctggtatgcttagttctaaagctcttttctctataccatactgcattccagaatagaattatgtctttcttctcatgttttaggtatctaatgtgatttttcttgcagcaatataacttctgcaaatactatgaatcatcaccaatgtatgaaattgttgaaagaaataaaagaccatgaatttgatcttgtcccctttgccaatgctcagttaagtcaagaaaacctacatgattaatttcaagattttcttgaaacaaaagaattgcttgccaaatatgcaggaatcgaagataaaatctggcagggtagtttgttttttaatctgatatcacagtgcctatggaaaaactcattttgaatctcatcctaagtctgactccagcgtcatgctcttaatcactgtgtattgtcagattatgttgaacacaccttgtatttgaacacaatgaaaggaaaagcttaattgtgacttagttacacgggaagaaatattttattaggttcctagagctgttgtaacaaaggaacataaactgggtcatgtaacaaaaatttgttacaacagccctagaaacctattacaatttttgttaacaaacgtttgttaagttctaggggtcagaagtttgaaataaggtgtgggctgagccatggtccgtttaaagccgctggggaaggattggttcccggccctctcccagcctctggttgcctcagacactccttggcttgtagatgaccatctttactctgtctcttcacatggcattttccctgtgtgcctatctgtgtccaaattttcctttttttataaagacatcagtcagattgttttagagcccacctacatgacctcattttcacttgattacctccataaggaccctgtctccaaataaggtcacattctgaggtactaggacttaggactttaacatttcatttttgaggggaaaacaacccatcacacgtatttatattaaaatggaaacttttcatggcaccaattaataacagttttatacatttttaaaaaaccaatatgcagattttatttttaattgacagcattaaaattgactgcaaagttgagtaaaatttgaagaatgtttcattagtattgataatttatagttgagttttgatttatgtaatacccctttgaattcaatggtaatattaatgagttgacacaaaagttagtgaatttactaaacttggacaggcatagttttgaaactgttatgcttttgcttcaaagccaaatcagttcttctaaaaaaaaatatgaaccagttgtgtcaatgtggatttgagtgctacatgaaagtacatttttagtacttgcttctttttattgggaaactttttgggtatgtgtggaacaacttgagcatgagaagctactttttgaactattcattttataagatctatagatcaagtctttctgatgaaaatgtaggatctaaattgagatgtactctgtttaaaatatacattggattccaaagacttgataatgcagaaaagaatgcacaatatctcaataatttttaaaaattgatttcatattaacatatttggattgagttaagtaaaatctattaattttacctgttactgtgtacttttttaatgttgctactagaaaatttaaaattacacatgcttgaattgtatttctgttgaacagagtttaataatttttggcatcatagaccttttaatagagtaaaatcttagctgtatagaacttctgggaacttgggcattctaaatagtgaaatcatgctaggtagcaaaattttctggataggtatagtttatctctctagatgtgaaaattttatgatttaggtataattgtcttctcagaaagagtattagaacataattgatattttcttgatatcatggattcatcatttcaaagttttagaatgtaatgtaacagcttgatgttcctacagttcactggaggatgttataacaggatgtgttctagtccattgagctgtttgcccctgcactaaacggccccaggcagtaaagcattatatctgctcgttacagttttgctaagttagtgatcattcttcactgctgtaacaaatctttaccagcagtctcaatccttctctttgatttgctgcttctagccacctaagtaattaagtcaaaaattaacttactttcactttttgtacatatgcttatgagagaggccctgagcaactctcctggtgaaggactgctagaagcctcactcatagatgacactccaaggaaaaagaatcattttctcaaatcaaagcaatttcggttcgaataatacgaagagaatccttgttgcagtcttttctctcgctaacctctcaccactttgccccacaagcatatgcagtttccagaacatgcacagcagtacagggaaatcgaagccctggcttttcaaccagaagatgaaggggatacctgggaagcagaaaatcatggagagatttcagataggaggaggcttaggaaagtgagcccataaaattatggataaactcctgggttaactccaaagctgcactgtgtgtgtggacctgaccctaaaaaggatatcagagtacatatgctaaaaactacaaaacagatgaaagaaatcaaagactctaattagataaatggaacagcataccatattcatgaattggatgttcaatatagttcatattttaattatccccaaatttatagattcagtacaatgcccatcaaaatcccagcaggatattttgtagatctagataatgtctaaaatttataggaaaggcaaaggaattagactaatcaaaataattctgtaatagaagaataaaattagaggaacatattctctaattttaagattagctataaagctgcagtaatcaagatagtgtgatactggtgaaggaatagacacagacatcaatggaacagaatagagaatccagaaatagatccacacaaatatggccaattgatttttggcaaagatgcaatttggggaaatgtgaatgaaaaaaaggcttttttttggggggtggggaaggattctcactgtgtcgcccagcctggagtgtggtggcgtgatctcggctcactgcagcctctgcctccacctcccgggttcaagtgattctcctgcctcagcctcctgagtagctgggactacaggcacacaccaccacgcccagctaattttttgcattttcagtagagatggggtttcaccatgctagtcaggatggtctcaatctcctgacctcacaatccacctgccttggcctcccaaagtgctgggattacaggcatgagctgcaagccactgtgcccggcccggaaaaaggcaatttaatggagaaagggtagtcttttcaacaaatgttactggagaaattgcacacccatacacacacacaaaaaaaaacctacctcgatctgaaccaaaaaaaaaacctacctcgatctgaaccttatgtcacatgcaaaaagtaagtaaaaatggattatagatataaatgttaatataaaactataaaatttttaaaagaaaatataggggaaatattcctgaccatgggttagggaaagacttcttagatgttgcatcaaaagcatgatctattttaaaaattaatatattattctttatcaaaatttaaaatgattgctctataaataggaaactattaagaggatgaaaaggcaaactatagactctgagaacattttgcaaatagcatacctgacaaagaatttgtatccagaacatataatgaactctcaaaactcagcaataagactacgatttaaaaataattttaaaaatcaatagtaagaagatttaaaaattggcaaaatatttgaacagatacatcaccaaagaagatatatggatgtcaaataagcatatgcaaagatgctgaatagcattagccattaggaaaatgaaaattaacaccacaatggcataactattagaattaatggcactttggaaaattgacaataccaacttatgtcaaaaatacagaccaagaggagccctcacactttgctcttaaggatgccaaatggtgcagtccttctggaaaacgcttttgcagtgtctttgaagctaaccttactgtatgatccaacagttccactcctgagtatctgccctaattaaattaaaactttattcacacaaaaaatctatatgcaaatattaatagtagctctattcataatcaccaaatcaacccaaatagccttcaacaggtgaatggataaacaagctctggtatagtcatacaacagactactactcaagaataagaactgctgcatacaacagtgtggatgaatctcaaaggcactgtgttgagtgacagaagccagtctcaaaaggttacatactaaaagattctatgtatatgatattctggaaaaggcaaagttatagggatagagagtagatcagcgattgtgaggaggtaggggttaaagaaggattttactacaaaggtgcaatgcaaggaagttttgggggtgatgaactgtcctgtatcccgattgtggtggcagttacatgaatctatatttgtgttaagatctatagatctgtactccctcaaaaagtaaaaaaaaaaaaaaaaaaaaaaaaaaaggatctcagtaaatttgaaaaattaaagatcaaaaaaggcaaacatggtgattcttaaagagcaccttaagccttggtagttaaggcaagcatattgggttttttgtttgtttgtttgtggggtttttgtttttttgttttggttttggtagaaacagagtcgagctctgtcaacccaggctggagcgcaatggctgaatctcagctcactgcatcctctgcctcccaggttcaagggattctcctgcctcagcctcctgaatatctgggactacaggcatgcaccaccatgcccagctaatttttttaaattttttgtatttttagtagagacagggtttcatcatgttggccagactggtctccaattcctgacctcaaatgatcctcccaccttgacctcccaaagtgttgggattacaggcgtgagccactgagcccagcaagcatatttgtttaaatcatatttgtgatacaatcaagttatattacatgcacattttatggacttcataatcccttgctaaagcaatacatataataaatctatccattttgtgttatatggagtacaattttattttaaatgctaaaggaaagtttatagatgtttaaactttgctaagatttccttgattgtatataaaatttatttgatcctgagcttatgcagtgactcatcccctagctataacgttttcatgagcaatcatctgcttcacaaaaacatttattttatcatacagttactgatattttgtgaacaaagggcagggactgtttatgtgcaggcaggaaatgcatgtgtcattttaccaagaaagtacacttacctgtatttgtctgaatttattggataataagtcggtcctcgaggcgagtttttgtgacagtaatcttgttaggactgcccatgacttctcatcaactggaagcagcagtacagtagaaggagcggtgtacatgggattgtggttttggttctaccaccatctatctgacttctctgcacttcatttgtctcattgttaaaaacctgtcatcattttgacatgctacgttctcttgcaacgtagctacatgtgtataattgcttaatgtggtctcttgctgatgtgtttctttttaaacttcttgttgacattatttagctctcttgtatcttccaaattttttcagaaaagattggtctaaggttaaaacataatttcttttgatcattgctctttgttacttgtaaattcatttgtcattcactgagcagcactgtgctaagtactggagaactagagataaaatgattgtctgttctcagagtgatggtctattagaagagaagaacaattggaatacagaatgatcaatgcaggcaaggggatacagacgcaggagaggagacgaacactggatgagtctatgaatgctgcattttaaagaaggagtaggaactgaccagcaaagataaaaagatgctgggatgagaaattgcagttcagaacaggagacaggggttgtatgagcactttaggacatgctacgtgatttggattttttcctggaaggatagggagcctgatagtcgggtgaggaacagggatgtaatcagatgtgaactggaggggttagtttgtatgcctgtgtgatggcaaagggaaaggaagaccagtttggaaactattgcaataacccaggaaggaataatgaatggcagtggggagtgagaatgcagattcaagaaatattaagtaggttgagttgcaaggatgtggagaagaattggaggtggtgggtacttgaccacttaatgtgatgctgtcatttaaagcaattaaaagctgtactgttgcatgtaagcagttggcaaatactttcacttcccacaataccccatctagatactgatcttatttttattttatagagagacaaagacacatcaagaagttacagaactttgtgaccaccacacattatgttttaggaagagtaatgaatagtaacatagttggaggcagggaaacctgttagtgaaccatgtagagactaaaggctggaagaagatgagacaaggtggtgactgtaacagtgggaggatattaatgtgtgtaaaaagagaaaagctactgacgcctttggtgcagtgacagcgttctcacctgtgtctacaaaattgattccaagatcataaatgtgtcaccttggtgctatagaaatacaaatgattatgtactttttacttatctcactaaaaatatctatcacgtctgtgtaaccaatttgtagctcaagaaagtaaaattccctttaacagaaatgtctgtctataaaacccatgttaggtgaatcacagtgacaaatctcgttctctggatctttctctttctgctccaacacaaccacaatcaccttcttgtatgacattgaaattgaagagttaaggcttttcaagaaagattgtggtatggaattagatttgggagacaccacgcttctatcaatgccacagttagaaattagatctcagccagacacagtggctcatgcctgtaatcccagcactttgggaggcagaggcgggcagatcacctgaggtcaggagttcaagaccagcctggccaacatggcgaaaccccatctctactaaaaatacaaaaattagctgggcatggtggtgggcacctgtaatcctgctacttgagaggctgaggcagggagaactgattgaacccgggaggtggaggttgcagtgagccaagttgtgccattgcactccagcctgggcaacagagcaagactctgtctcgaaagaaagaaattagatctcagagcccaggagtagtcaagaccagcctcagcaacaaagtgagaccccatctctacaaaatgtcaaaaaattagtctggcatagtggtgcatgcctgtagtcccaactacttgggaggctgaggcaggagaattgcttgagcccaggaggttgaaccttcagtgagccatgttcatgccactgtactctacctggatgaaagagtgagaccccgtttcaaaaagaaagaaagaaaaaaagaaattggatctcaagatgggttgcaactgaggatatgtgtgtgtaacaagtagattttttttttttttttttgagacacagttttgctcttgttgcccaggctggagtgcaatggcatgatctcggctcactgcaacctccgcctgctgagttcaagcgattctcctgcctcagccccccgagtagctgggattacaggcacccgccaccatgaccggctaatttttgtatttttagtagagacaggagaggggatttcaccacattggccaagctggtctcaaactcctgatctcaggtgatccgcccgcctcggcctcccaaagtgctgggattacaggcatgagccaccacacccagccaacaagtagatttttaatggttttgaatgtaaaagcttttcagattttactcccaaagttttgtggcaactgtgagggctgaggcttcactggctgcacagcctgtgtcagacagctgggtggagagctggggctgggctgactgctaatggtatggcctcaagcaagtcatgtgtcttctctaaggcttagtttctctctctctaaaatgagcatcataatagtgcctcatggggcattgtgaaggtaatcaattagttcatattaaacacttagtataatgcctgccaaataatagttaatccatatattaacattaaacacaggagtgtgcaattcccacctattttcagtagtcagtcttgctacatctaacttcaattccaatcaccatgcaattatacttaaaaacaaagtataagtacaaccttctttgactgacacttcttctctaattagggacattagcccaaatatagtctttatttttccatggaataagtggaggaagattggaaagtgaaaatgtggagaaaataaaacaaaaatctgtactcatcagaccatgcacctgagaataaactttcttacatgggaatgcttttatttctcaggtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacaggtttggcttaaatatttttagaggataaaaatgttttataattttttttcaatactattagaaaataaatggctcacctctggcctcttgacaggttcctattttgtttgttatacagtaaaatccacacatcactttttattttatttttttgagatggagtctcactctgttgcctaggctggagtgcagtggagcgatcttggctcactgcaacctccacctcccaggttcaagcgattctcctgcctcagcctcctgacgaactgggattacaggcacatgccaccatgcccggctaatttttgtatttttagtagagacggggtttcaccatgttggttaggctggtcttgaactcctgacctcatgatctgcccacctccacctcccaaaggactgagattacaggcgtgagccactgcgcctggcctacctcactttttaaaaatggaagtcttcccatttaaataaaatgaactatccaataagtatgtcacaaatctaggggaaaaaaagactgaattttttcctaatcttttcatcctatataacagtgactcaaatgttttcatcatctcagaaccttactagcgagtaaacagtgaagaatcttttattaaggtccattgatacagctcaaaaataaattattttatgaaagtaaaaagcaataagaaaattagttttcatatcagtgcaaatattacccaatttcccattccacagatagtacatttgaacaagtaacaataacacactggaaatgcaatccaagaaaagttaacatgatgccacaaagctatatttttgaatactactctaagccaaatgaaaccatcatgggctatttggaaatggactaacattttggagagtggtacatgcaattaccaaaagctcaccctctcccagccttacctctgcaaagtcagtatgaatgataaatcagctcattctgtcttttgctaacttcccatattaaacgagttatcaaatctggtcaattctccttcataaagcactcacaaatccatcactcgtctccagcctcttctgccctggccttaattctgcctctcaaaatttctcacttagactcctgcagtgccccccaacttgtatctgtgcctcccccacaacttcccttgatccatctttcatgccagtgtcttcaatctgctggtcacaatccattggcaagtcacaaaattaatgccattgctcacagccaatgttttaaacatgaaatagaatagaataaaatggaataggatagaaaatacctgagtacattgcatgtaacaagggtattatttcatgaaactttcgtttcataggtacccttggtagggggactccagggtcctaatgtaaaatgtagtctttactgggatgataggcaaaatgtttgaaagcccctgctcttcattgctgacaaagtaacctttctaaaatgcaaacattcttgtttaaaattctgtaggatatccttagtgcctccaggataaaagtgtttttaattttattttccaggtctaaaggtttttaattattccagttcttagcaaggtattcaagagccttcgtcattttacatttgcctaactctccaaaaatcttctctttcgattgccccagcagttttcaagctttaatgaacataggaataattgaagagactcacataaatccagatccctggactcccttcccccacagatcctgattcagtagatctgaggtagagcccaggaatctgcatttgtattcttgtgcctcaccaaagcattctgggtgactagaaagtcaacaccgttgggtcttagagctaagacgaagtatagaggacacacagagaccaagtgctctaactgccttgcaaggggaagaggaaaaaattgtgaccaaggaaagcttaatctggatctttggcatttagagatgaggaggatgtcacgagtaagtagagaggagaaagagattctagtcagaaacaatggcatgtgctggagaaggcaagtgtataatgggtttggtgaatgcggatactttgaatgagggcataaatatatgtgattcattcagaaatgatttattgaactccttctgtgtgcaagtcatcatcccagatacagaggatacagctgtgaagaggcttttgccctcatgaagccatctgtcttcctaagtagagggctggtgagtgaaagcagaggaaaagggtgagataggcggcagccaggctcggagaaaggccccagaagccagtgcagggaatttgtcctgtgagtgaggggagctgcagaaagttataaagcaaagaagggacattactgagtttttatttagaaaaaccatttcagctttgcagagaatggactggggaacaggtagaaccactggagtaagggagagtggttgggagggtgtggctttctatagaaagagattagtgaagctctacactgaggcaaggcaaggagttgcagaagaagatttgagatacatttagaaggaagaagctttaggatttggtaaaatttttttttttttttttttttttttttttacagaaaccagtacatctgtagctttgggcatataaaagtatagttttgagaagaaggtcagctactgccacgtctttatgagatgggcacctatttccctccttatattttctttatccagatcacatcctattccattcttgggacttaaaattccatgttttatgcaaggatacatcttcacatgggatggacagaattctaggattgtcagagaactctaccacattactggctgggtttaaggataaaaactggcatctgtctattggctgtgctttgattaggacagcaagagcaccatatattagagacacaaagttctgggaatttcttaaagataggctaaagtcatccatatatccaacaaatatttattgagcacctcctatgggttcagtcatggttgctactttcaccaaacttatattctaattggggtggggaggcacgaatgtgcaggcatccacaaaatcatggccagattataagcaacatttctgtaatttacttgtttgaacaaagaggcccaaattagtggttttcacacgtttttttctagacatagacttctttctttgaatgaaatctgacttagaaacctatcacactagacaataggagctgctctgatttaggcaatggtgggaccactgaggcacttttgtgggacgccttgtgaattatctgaggggtctcaaagctgctagtctggttgacttttgctacttaagtactaacttttgccttcattacttgttactttctttcactgttctcacacctttgtgtctttaagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcagggtatgctattgtttgtctttgctttcttgtataatggaaatacatgaacacccctttgttttccaataagcatttattaagtcctatcaactgcctaacagagaacagatttcacaattgatcagcaatctcttgttgaatatttagagaatgtactgaagtccctaagtttttcttttggaacatcttttatctgctatcaccacgtgttttttgttgtttgtgtttgtgagtgtttttggcatggcaggaacagctatttaaactgtggggctagaaggtaggatccacccaaagaggtaatcgcctggagcaaggtgaggtagaagcaggtaacccttgtctgcagctatgctgaggctgaattgcacaaattaagaattaggcctaggtctgcagcttaatctagccctaacacatacatacagagccacaagctaagaaagagttcatgttgtaacctagtcaccaaaactggacagatctccaaaagcaaactaaatactagcagacagagggtgcaagacaaagaggaggtctgaaatgggacaggagtaactgcaaagtcagtgagtaaccagctacctgtggcttatatgagatgcctgaagttgtacaggggagcaaagtttagggatgtcatcaggaaatggacaacactcacactcttaagacacaagtattcattaccctcagggtaagaagtactcccaagtttatctttcaattcctgaacattaatgccagataatacttgctattctcaaaagcaatgatccccagaaacctagctggggcccatggccagtctgtgacaaagtttttgctggcaaatagtgaaataagtaagagagcaggtatgtatatcaactctcttttcttgggatgaattgttattattccatgactaagtcctttctatttgggggtattaaaacattatttcttcaatgaaataaaagggtagcagaggcaaggtttttttcagtcctcacttagccaaataaatggttgatatctatattagttcccagataatttctagaaaattgtctttgaaatctaatgacctaggaagcattggtaaatggtattttcattaggacaattggtatgaaaaagagaaaaacttttgacagttttttataaaacattttcagtgaaaccatttctatttagctgctatatgacaatgagaaacatctcacatttatttcctcacctgcaaatttatggtgggatttgatgtctcattactaatagtacttcagatagcgataaccagctgtatacatttgatgttagtgacatgaagcggttttgctaatatagactaggatttgaatgttgcagttcaggtgagagaagagactcttaatttcccattcattcctatcatctatcatctaagagcatttgagtcttacacattcttagaatttttaaagaccttgaccacttgattgatattcttctctttaccatgttgtcatttgcacagatgattgagacagatgaggacttcaatccttttcctggaggatatgactatttggttgactttttagatttatccttcccaaaagaaagaccacaacgagaacatccctatgaggaagtaagcagcaacactggtggaagtctgcttttcttccttctttctttctttccttccttcctcccttccttcctttcctcctaaataaacttataattttagaataactttagatttacagaaaagttacaaggatattaattataattaatacaatattaattataattaatataattataattaatacaaagtattattaacaactcactttactatggtacatttgtcacaactaacaaaccaatattaaaacattgttattgatcaaagttcacacttatttctttatgagccattcccaaagattgacttctctgtctgctcacttccaaacacctgctcaacctaagctgttattagacctgtgagcattgatctctaccttcattttcctgtgcccctcccaatgggtgtctctggaaagggagttagatcaacatgaagcaacacatattttattgaattcaagttctgaacaaatccctcgccagtggcagcattatgtaaagatccatgacattggagacagtgtcaagatggggactgatgcccctttctgctgatcatgattcctgattaggaggctttgagcagttatttaagctgtctgagctttaggggtttttgtttttgtttgcttgcacagggcttgctccccccttgccagtttgtcgtgatagttaaatgacataatatatgtgagcatgcattgtaatttaaaattgtctatgaatgtaagaatcattagttatgaggatatacggtctgcccttaaacttattgtatgtgccatttaaatgtgtgatgtcctaaatgtagaggtttaaatataccttcacctaatagatgtaataaatgtgctcttgaactacattttaataaattgactagtacttgctattgaagaaatcctatatggaaacttcagtaaaagtaataatctgctacctgatttataggtaataataataaaaaaactggcactgggcacggtggctcacacctgtaatcccagcactttgggaggccaaggcaggtggatcccctgaggtcgggagtttgagaccagcctggccaacatggtgagaccccatctctactaaaaatacaaaaattagctgggcgttgttgtgggcacctgtagtcccagctacttgggaggctgaggcaggagaatcgcttgaacccaggagacggcagtttcagtgagccgagatcatgccattgcactccaacctgggcaacagagcaaaactcggtctcaaaaaacaaacaaaaaaactggatttttacaggtaagaaaatcctgtgtgaggcaccgtatagatgataaataggcttacatctttttagacaaaataaatctttacatttattgctttatatatcaaatacttaccaagcttgctttatgccaagcacagtgttaaacactttggaaatgttaagacatttaatccaacaacaaccctgtgaacagatactactatctgcccccattttgtgggggaagaaactgggattataagagttagaataacttgcccatggttatacagctaatgaatggtgatgcggggctttaactcaagcagtctagctcaaagtctatgctcttagccactgtgtagcctttcaaatctgaatttacaaaacctataaattgaggtttcttagcctcaagagattcacctttgaaaatttttaaataacttcatttaaaatatttaatttggaaaaaaaatcactttttcacagctttccataatgcatctgctggataaagcaagcagcagctctgttgcatatttaaatacaccatggggcaaaatcatgatgcctgctctgcacatggtactgttagactgtggcttgagggcttttatctcccaggattttagggagagttctatatgctgaggtttggttaaagaggttatgcctatgtgtggaagagctccttttcttgctacccggagacttctcatattgcctccctcctgccacctttttggaggtattaattgcctttcaaactcatcatttctatcacactaactctccattcttaaatgcatggctcctgtagctctccatcctcctgctccgacctggaagggctcctctctagctctgctgcaaatctgctacctttcactgcctccagaccccacccatgcctttcccttccttgcttcacttctatgtgggactttctgcttaactgtctcctgcctcatggtgtgtaagtaagtttcagcatgtaattctgggtgactaatcattttccatagacaccggaaggcattgctcctttggcttccagttatagacaaggttgctctaaagaaaacttatgctagcttgatcctcctttctttgtgggtgacttttaagaattacaggattagtccatatttactgataaaaagacttttttcagctgatttggggctcttatgtataggtgtaggatctgtcatccagtaggctctacttacagagggctcgcacactggtgcaaggcacatctcataaactggtgaagctggggcagactgcatcaagtagaatgcgggatgagaagggggcaggcctgctgagctccggctgatctgaaatttccagagaacttggaaatctggattttcatgtgaaatacccaaagttataaatgtagaaagctgagtcaatgttcttaaagagttatagactacatgaaatgagagctaggctgtatttggccaaaggatcatcagtatgctttaagctgtgaaggtgaggagagaagccagctaggggacccccgagtgcaaaaatgtggaggctcttgctttcagcatcacaaacacactacctgcccttgttctccccctaccccaaaattgattctatgtattgagagaactgtagaaatatatttgacctgggagccatatataggggtagagaaggggccagctatctcatggacataacttttgtgcttgccctcctgtcatccgcagtacctacttctcttccctccacatctgaacacccctccatgtactgtctgggattgtacagcctctgccctgcatcttcggtttccacttgtctgcatgctttctagattcacgtaattagttgaattctcctgtcaatgaatcacttccttttcttttcaatgtggcagtttattcctgtataattgctttgcaacattttagttggatctggaaatgcagaggagataggttatgcacgcaatttgtccgtcattgtgaaccaatagtcttctccttagcccagtgacagtacctccttgttttcctgaatattcttttgcattcttttggagttcctctttccccagccactgcttaagtctcttgtttccttccaggactctgtgttcattccactgttcttcccaagtctcttcctgggtaaactcacctgctaacatcacttctctgttaatgactccaaaaataatccatatgtccagcccagagcgctctctggctacctccagtgctgtcaagctttgggttcttaatagtcaactgcctgctagatataattgtctgaatttctgaatgcttaatacataattttcaacttgttcaaagttcaattcctcatcttccttctttaaaatgttctttttcctttttctatctgatcgttggtaatatcattccccaagtcagtcaagctagaaacaaatgagtaatctttggttcttcccttttccttacatccccaaatctaatcagtcatctagacctttccattttacaccccaaatatttcttaaatctacttccaattctcctgtgtgcttctctcccagctaaaaggccaaaaaaggccatttaccctgcattgggaggaaccaggtcctggtactgcatcttagccaggccgaccttaacctgaccaaattgtagaatcatgtttctaaacctctattagcaaaactctgccctatgtttgtaacctcagttcacgatggatataattgttttatacaaatggtgcaaaaaagagaaatagatctaaaaatgccaaacttccaatcattctgtgtcatttaatagcctgtcacttatggaaagtttgcctctactgatattagcatgatatttaccgggagaaaatttgttgcagacactgaaagggctcctctaaactctaacattggtgccgatggattgttaaaactatgtgcaaccaaggataacttctctttattttctttatataagttatctcatttttttctctcaacagtctcataatagagaaacggaggcttagcaagcttaaggtcacataattagtaagtgcagggctgagactcaagaccatctctgcttgtctcctaatcctgtgctgctttggctcttcaacagtttaaaagttgggattctttaaggataaggatcttgaccacttgatttaaagtaatcctgttctatgacaggccagaaactatagactgttgtgagcttccaggctctgctttgcctctgaatgttcaggtggagacttgaacactcggcttttagaatgacgataacagcaaagatttcttgagtgcttactatgtgccaggctttaagtattttatatacatcctcacaacaatcctatgaggcatgttctattattgtcttcattttatagatgagaaagccaaggcacagaacggtgaccaagatcacacagctagagtctggatttgaacccatgaatctgcagtttgtgctctcagtcagatgctccccctgctcttaatccatttcctgttttccttctttcgagtcctgctgcacttagcatctttccttttctcctcagcctgtgatatctgctcccagagactcttctccttggctctccgtgcctctgccatcatgggcagctgctcctcccagggacaggagggatccatactctgcttcctgggttgcccctgctagtggttccatgtctatttcagatccatagccgggtggatgtcatcagacacgtggtgaagaatggtctactctgggatgagttgtatataggattccaaacacggctccagcgggatcctgacatataccatcacctgtaagtctggaagcacctggcgcccccaggccattgctgaggacgctgtggatatgcataagcagtcagtgactgccgaagcccccagattctgactaatgtgtgagattccaccattagagcttcattcctttgttagtttgttaaaaagcaaatctggttaggaaggtataacattaaagagtcatttatacattcatgtgaatgtgttattgcacccttctggaagtgggttttggtataagaaagagaaatacattataagagggaaagggtatgtttgccaagacaagaatgagtatttgtgtggcaaagacatggtcattgaattagtgaattcctgcatcacatttttgtctgtgctcacttctgagcaagaatttggtgggctagttggtttaagggaatggcccactgagtttctgtctgcctgcacttcaaaactgtttaagtctttaggatcatatctagaatatttgcactgaaattcagaaagggcaatttgccatttttatatttgcaaaataatcaccaaaggaaagagtactttttctcattaccacagatcctctgaaaaaaaatgcagaaatttaattttaaaattctaattatttaaaatgtataagcaaaagtttgtactctgagcttgcaagcagaggcatttattaaaatttcttttttacttatttccttttgaatgtttttaaatgatatgaaaaagcttaagaatgtggagctatgtaaaataaaaaggaagtaaccccaccaagcacctctcaggaaaccctgtttcctgcccttccctccacccactcttatggtaagctttgataatagctcagtgtgtatcctcccaggcctgtttctggacatagcaacatttctctacatatatttgttttcaataagatgtcccacatagttggtagtgagggagtgttattgttgccgttgtttttatttttttttaattttggcaaagcacacaccacctttgggatgttgctattgtttttaaatgaaatcctagtacagatattctgcaacttgcattttttactcatcaatatattttagatagccttccacattgggacatccaggtcaacctcaaatcttttaacagctgtaagacattccaagtttttttcattttcaacggatcatatacgtaactcttgttctagaaagaaaggaatctggcaacttttgaggggatcttggggattttttttttcttaagaaaataattccatcttagaaatcgctaaactctatcttgttctattgtgttttggtaacaagggtcacaaatataagatgtcatcataaatattgggaagcagtcacagtccactttatcttgttgctctgaaaatgggatttgtgaatttactaaacattcttctggttataaaaataatacatatccactgtcaaaaatttgaaaaaatatttttaaatgaaaaaactacaaataatcccactacccagaaataataattgatattttggtgtctagctaatctttctttttttgcttccaagcacatataccatacatacttttctacctgtgtgtttatcaacgcgattttccacagtattgtattttcctacatcatttttaatgcctgcttacctgataccacatacctatattagcactttatttaacctctttgacctgtaagtcatttctaacttttcactatttgaaacaatggcaaataatcatgtggatgtgtcttgcacacattcatagtgacttctgtaagttaaattcctaggagcggggctgctggattctatgaatacagcgtctaggcttttagtgccctctgccaaatcgttcttcgggaagccagttcacctttccaaaaataatgtatgagagaatacatttacctgtaccttcactaatactagattctgttgcttttgtgtacaagatatagatctagattttcacatataaggattccttaaagcaaggaacatcatagtacaataaaaataagacaaaatctcgttcaaggagctgtctgtattcaacaccctgaaagttctgagctacatcaacagctggaacagtacagaaacactatctctcagggaggacagagtaccaggtaccaaatagatcctggcaaaggaacaggcatggaagtttccagagcacattcccatgctttatctctcttacaggttttggaatcattttcaaataaaactccccctcacaccacccaactggaagtcattcctgatgtgctgtgagcagaatgggcctgcgattttgcaagtaaggaatatcctgtaggtttgggagctgtcctaccgtgcatcccgtgacactctctttgacacctaaattaagcagacgcgttgcctgacagaaacccgacttttgcgggactgagaacagctaacattacaagaccattcaagtgttttaaaaagtaaataggctaggcgtggtggctcacgcctgtaatcccagcacttcaggaggccgaggctggtggatcacctgaggtcagaagtttgagacctgcctggccaacatggtgaaaccacgtctctactaaaaatacaaaaattagccaggcatggtggtgcttgcctataatcacagctactcaagaggctgaggcaggagaattgcttgaacaagggaggcagaggttgtagtgagccgagattatgccattgcactccagcctgggagacgagcaaaagtccatctccccacccccaccatcagaaaaaaaagtaaatcagtagtgcatccagtccagagtccatagaacctttggcctggttgaggtaaacatacagccaataagtaaacaaaaccaaaatcgtccaggttgtgagtgtttaaaacataatcctgagtacacgagggaaagcagcaacaaaaactgaagagagacaaactaaaaaccgagggtgagatggaaagcagcagctcctcatttccaatagacctctctcctcttttggactaatgacgatgaacttgcctggcacaaatcagatttgacattcctttcctgcagcctgagatatgattttattaagtgaattataaaacctgtctcagctgggctcagtggctcatgcctgtaatcccagcacttgggaggctgaggtgggcagatcacttgaggtcaggagtttgagaccagcctggccaacatggtgaaaccccatctctactaaaaatacaaaaattagccaggtatggtggtgggtgcctgtagtccaaggtacttgggaagctgaggcatgagaatcgcttgagccagggagacggaggttgcagtgagccaagactgtgccactgcactccagcctgggccacagagggaaactcttgtctaaaaaaaaaaactgtctcctcatgcttctgattgaagggaccacataatatgactgcaaagacagtaaactccttgactcatgcatttatttattccacaaacaggtatcccatcccattgtgttataataatctattaattgtttttcccagtagatactgagattcttaaaaataggaactgtcacctgggtagccctagtgcctagcacagtgctgagcacacgtatggttttattcctaatatgaattcaaggaaggaaggtacaagtgaatttctctttcccattgtcagcatgagtcgcctcttaaaataggcttcaatgtctttagcagtaaaattaaggtttgaattagaatatcttttacatactttccagttgtaaagttacttgttccatattctaatctagcataaagcactgggctagaacttctaagttataattataagctagaagggatgctaaggaaatccacatgcaactttattacaaggtagactctcatgagcactgtatttgttgtacaaactgattgtcgggaatactgaggaaagaaggattgcatgtgaggttttgagatgaccaggaagaacgttgtagagagatagcatttgaggagtaaggggtaggggattggcttaaagattgggaaaagttttaaacaagctaaaacagagagagaggaagaatatcccagacagagagagtgggtgaggttaaaaggtggaaaaatacaaggtgaattcatgcaatggcaagtcttcctcatatggcaccgaagtaagggaaaccaggaaaggggcaggagtgggaactgggagaataaggagagttaagagggctcaatgcagatgctgagcaggtttagccattgtgaaaaagcaacaggaataaaagctaaggaggcagcagctagagcaataagtccaaggtcttagagatagagcagttttgaaggaagacaaattaaaggtgtttctgtataagtgggtgaatgaagcagagcagagatgaaggcaatagaaattaagagatcactgtgtgcatttggacattgctgtctcaaggagacttggagtctgaccttttgagttaaaactccagctctgtcacctaccatatgaccttggacaaattattggatctctttgtgttccagatttccatctgtaaaatgaatgtaatagcacttacctcacagggttatgtcatagtataaggcatgtctagaaaagtgacatgccatggtaagtgaacaatagatgttgaccatatcagccccatgaaataaacaggaataccatgtggcccacagtcagttggtaaatccttaagacttgggaggagggtcatattccagttcacattccagttttagattctcgcttatcttaaagcattatagaccttgaactaaataagaataaaaatttgccccagtgcagtaagaaaatgaaaaggcattgaaatgagattcatactgttgttcattaataatatcttcatttcacaggaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatttctagattcataattagaagtgtttattaccaacttctcacttagattaacatcaatgatgtttgattattctggttaaccgctcacatgcataacaataatgctagaaattcaggaattataattttgtgatttatactgtgtggtaaattattcagttctcactgcaaataaatataatgtatatcaatgtaatgtaggtcagaatgtctatggtgagcaaataaaagattattttaaaatatgaatttttctcatactaagtctatctttattctcctgctatctttccagttctctccttctgatatcctgataccaccagttctttgacatcaccaggaccaccagttcactgacctgatatcagctcctatgtcctcacttccctttgcactcctctcgcatataccccacatttcctgctgtctccccatctccagtatctcatgtctcacttccattacttaaataaccatgaaatcatctttctacttggctctcacatccactctgtcaacaaattgtcacctccatcttcagaatatacccagggtctgaccaatctctaccacttccactgctaccaagatcagaagaggaaggaaactcaaaggtacgataatcttggcattagggactgattttcctccacagacacccgccaattccagaaaaggccaagaaactgaatgcctcaaaatttgctcaaagccatttactgggagatgtctcgtggtcgacacattcctagtatgaagtcatcctaaagagtgacagggaagctgctagctcttgtgtgctgccaccacacctggccccctaacttgttttttgaagcaaaaatattgacaccaacacgtgacaagaccatgtggggaaacaaaaatttcaggacaatttcagaaatgatcatagatgcaaaattccaaagtatcaacaaatccaacctagcaatttataaaaaggatgatttattacaattcagttggctttaatctcaatgcaaagttagtttcacatgtgaaaatcaaccacattaactgaataaaggagaaattttagtcccggcatggtggctcacgcctgtgatcccagcactttgggaggatgaggtgggaggatcacttgagtgcaggagtttgagaccagcaatttcagaccagcctgggcaacatagaaagactctacaaaaaaatttttttaaattagctgttcctcatggcatgcacctgtaatctcagctactcagaaggctgaggcaggaagatcatttgagcccaggaggtggaggcttcagtgagccacggtcgtgccactgcactcagcctgggcaacagtgagaccctgattataaatagaagaaattgtataggattatgtcaatttatgtacaaaaaagtttgataaatgctttaatagccattcgtaaacaagtgaataaagaaattcatagtaactaggaatagaaaagatttttctctgaaagaaacactacagcaaatattttagcagtgaaatgtttaaaccttcccagattggcagtatttcaaggagaccagccatcaacacttctttgcaatataatgaaaattctagtcagtgcaataaggcaagaaatatgaagtgtaattattagaagaaatagattagttgcagagaatattcttgtgaacacagaaaattcaaaacattctacagataagtagaaataatgtttagcaaggtttctgatataaggtcaatatacagaaaaaaactaatatttatcagtgatccacagaaaataaaattttaaagataccttttataacagcatcaaaatatcaaatacctaggaataaatctaataaagtatgtgcactatctctaaacaaaagctacaaaacaatattcagataaaacctaaatatcaaagacgtaatagagggacatgtcatgctaatgaactggaagactcaattttttttttttttttttttttgagacagagtcttgctctgccacccaggctggaatacagtggcccgatctcagctctctgcaacttccacctccaggcttcaagcaattctcctgcctcagcctcctgagtagctgggattacaggtgcctgccaccacacccagataatttttgtatatttaatagagatggggtttcaccatgttggcaaagctggtctcgaactcttgacctcaggtgatccgcccatcttggcctcccaaagtgctgggattacaggtgtgggccatcatgccctgccaagactcaatattttttaaagtcaaatttacccaacaacttttaagcctttcaacaggtatttgttttatggaaattaagaggcagtttctaaaatttacatagcaatagaaaatttcaggagtaaccaaggcactctttaaagaagatgaggaataaggaggataggaagaacgagagaaggaggtggagagggaggagtagaagaagatggtatgtgttctacaggataacaaacttatagtaatttgacagtagggtagtggctcaagggagacaaatagatcaatataacataatggaaagcacaaaaactcaggcaaacatggagacttactttcagacgaagatggtactgcagatcagtggagaaggtgcagtcttttaaataaatgtgctagttgaattggatatcatatgctgggagccttgacccctatgttataacagaaacaaggaatcagtgtgaggtgaattatagatctaaatgtgaaaagcaaaacaataaaacttctacatgatgatatatggaaatatctttgtgaccttgctgacaagatttcttaaacagaacacaaacaagcactaaccatcaagagaaaaaaaatgaacaattagactacagtaaatataaactctattcatggctcacagctgtttacccaagagaaatggaaatatgttcacaaaaaacttaatgtttgcagcagcttgattcagaattactcctaaactggaaacaattcaaatacctgtcaactggcacatggctaaacaaaaggtagtgcatctatacaatgacatactatttcataattaaaaggaataaactgttgacacatgcaacatgaatgaatcttgaatgcgttacagcacatgaaagaagccagactcaaaatacaaatatatagatggagaacaaatcaatggttgccagagtgtagtgggagggagaggcagttactatgaaggagcagcatgagtaaaattttgcaggggatggaaccgttctgtatcttgatggtggtggaggatacacaactctatgcatttgacaaaactcatagcactgtacatctaaaagcgtaaattttatgatatgtaaatctcaaaataacctattaagctcttaataacctattcataagctactattaacctattcactaagaatgatattaagggaataaaaaggtaagccacagagtggctcttacaaatttaaaagaccaataatatagtaatagaaaattttgaaccactcacaaaagaagctttgaaaagatgctcaaattaattactcactggggaaaggcaaattaaaattccgctgagacaccactacccatctaccagaatggctaacatgaaaaaggcaacttcaagtgtcactgaggatgtggagccataggaagtctcatactctgctggtgggagtataaattagtacaatccctttggttaatcattaggcacccctaaagtgaacatacgtgtaatctatgactccataatccccttcgtcagtatatacccaacaaaaatgtacacatgtattcacaaaaacacatgttttctgtaagaatgttcatagcatccttttttctaataggaactggaagcacccccaaatacccgtcaggagaagattaaaatgtggtatattcaaaaccatgaagatctccacttaaagcaatcctttttatttttttttttatttttttgagatggagtctcactctgttgcccaggctggagtgcagtggcctaatctcggctcactgcaagctccgcctcctgggctcaagtgattctcctgcctcagcctcctgagtagctgggattataagcacccgccaccatgcccggcttttgtatttttagtagacacagggtttcaccatgttggtcaggctggtctcaaactcctgaccttgtgatccacccaccttggcccctcaaagtgctgggattacaggtgtgagccaccgcacccagcctgaagcaattctttaaagtgatgatcacagacccatggaggtcccaagacccttttgcaaagtccttgaggtcagaactattttcaaaataatactaaatttttttgccatttcctccacttgttgacccttacattgtagtgtgtataagtactgacaccttattctggacggaggtagaggcatcaaaccatgctgtcattgtattaggtgcttacagttaaaaaaaaaaaaagtttgttttatttaacatccatgatgttgcaagaaaaagcactgatttttccgggcgtggtggctcacacctgtaatcccagcactttgggaggctgaggcgggtggatcaggaggtcaggagatcgaggccatcctggctaacatggtgaaaccccgtctctactaaaaatacaaaacattagctgggcatggtggtgggtgcctgtagtcccagctactcaggaggctgaggcaggagaatggcctgaaccctggaggcagagcttgcagtgagccgagaccgcgccactgcactccagcctgggggacagagcgagactatgtctaaaaaaaaaaaaaaaaaaaaaaagagaaagcactgattttattaagtgtataaatttagtaagaatcttgagtacatgttttataggaagagtgagcacagcacttctgctccatactcaagtgtgacggctgtcccgagggaaggagcctacgttattgagccatgaactacactggccatcttttttcatggaacacagttttgctttgaaagaaaaactgacacaaaaaaactaacgaagcatggtggtgcaggcctgtaatcctagctactcgggaggctgagatgagaggatcacttgaacccaggagttaagagaaaattaaggaaatacaaatggccaatgaataaatgaaaagaagcttaatttactaatatgatgcactgagataaatgtacaagagagggcactggcaaaattatgtatcattttagagcttagaagaaataagcatctatcaattaggaaataaatatattacagtaaatcacattatattaatatgtagtggttaaaaacaatgaggtagctctatgtttattgatccagaaagacgtacaatgcacatttaaaaagaactaagttataaaaatatcacttatgtttaaatagcactttacaggcacaacttgttttattatgctttattgtacttcacagatattacattttgtgtgtgtgtgtgaattgaaggtttgtggcaactgtgcactgaacaagtttatcaagccattttcccagcaccaggggctcacttcatgtctctgtgttacattttgataattctcatatttcaaatgttttcattattattatatctgctattgtgatctgtgatcagtgatctttcatgttactattctaattgttttggggcaccacaaacccatataagacagaaaacttaataaatattgtgtgggttctgacttctccacccacatgctattcctccatcttcctctcttccctctggcctctttattcccttagatgtgacactactgaaattaggccaattaagatccctacaatggcctgtaagtattgaagtgaaaggaagagaaggtcacatgtctctcactttaaatccacagctagaaatgattaagtttagtgagagaggcatgttgaaagccaagataggccaaaagttaggcctcttgcaccaaagagttaggcaagttatgaatgcaaaagaaaagttctttaaggaaattaaaagtgctactccagtgaacacacaaataagaaaacagccttactgatgatacggagaaagttttagtggtctggatagaagatcaacccagccacaacattcccttaagccaaagcctaatccagagcaaagtcctaactttattaaatctatgaagtttgagagaggtgagaaagttgtagaagacaagtttgaagctagcagaagttggttcacgaggtttaaggaaagaagcagtcttcataacacaaaagtgcaaggtggacccttccttacaccttatataaaaattaactcaagatggattaaagacttaaaacgtaggacctaaaaccataaaaaccctagaagaaaacctaggcaataccattcaggacataggaatgggcaaagacttcatgactaaaacaccaaaagcaatggcaacaaaagccaaatttgacaaatgggatctaattaaactaaagagcatctgcacagcaaaagaaactaccatcagagtgaacaggcaacctacagaatgggagaaaatttttgcaatctacctatctgacaaagggctaatatccagaatctacaaagaacttaaacaaatttacaagaaaaaaacaaccccatcaaaaagtggataaaggatatgaacagacacttctcaaaagaagacattaatgcggcccacagacatatgtaaaaaagctcattatcactggtcattagacaaatgcaaatcaaaaccacaatgagattctatctcatgccagttagaatggcaatccttaaaacatcaggaaacaacaggtgctggagaggatgtagagaaataggaacacttttacactggtagtgggagtgtaaattagttcaacctttgtggttgaggatctagaactagaaataccatttgacccagcaatcctattactgggtatataaccaaaggattataaatcattctgctataaagacacatgcacacgtatgtttattgtagcactgttcacaatagcaaaggcttggaaccaacccaaatccccatcaatgatagactggataaagaaaatgtagcacatatacaccatggaatactatgcagccacaaaaaatgatgagttcatgtcctttgcagtgacatggatgaagctggaaaccaccatttccagcaaactaacacaagaacagaaaaccaaacaccacatgttctcactcataagtgggaatggaacaatgagaacatatggacacagggaggggaacatcgcacactggggcctgttgtgggatgggtggataggggagggatagttgatgggtgcagcaaaccaccatggcatgacctgcacattctgcacatgtaccgcataacttaaagtataataaaaaataaataaaataaaaagaaatgaaatagtggcattcacagcaacctggatgaaactggagaccattattctaagtgaagttactcaagaatggaaaaccaaacatcgtatgctcttgcttataagcaggagctaagctgtgagaatgcaaaggcgtaagaatgataaagtggaccttggagactcggggaaagggtgggaggagggtgagggacaaaacactacacattgggtacagtgtacactgctcgagtgaatgggtgcaccaaaatctcagaaaccgctaaagaacttattcatgtaatcaaacaccacctgttccccaaaaacctattgaaattaaaaaaaaaaattgtgctgaaaaaaaaaagtgcaaggtgaagcagtaagtgctgatgtagaaactgtagcaagttatcctgaagatctagttaggatcattgatgaaagtggctatactgaacaatagattttcaatatagatgaaacagccttctactggaagaagatgccagctaggactttcatagctagagaggagaagtcaatgcctggcttcaaagtacaatgtgaatcttttgctcagggctaatgcggctggtgactttaagttggaactaatgctcatttaccattctaagaacctagagcccttaagaattatgtcacattattctgcctgtcctctatcaatggaacaacaaagcctgttttcaggtaatacacttgttttcagtatacgttactaaatattttaagcccactgttgagacctgctactcagaaaaaaattatttctttctaaatattattgttcattgacaatgtgccaagtcactctggtgctgtgatggagatatacaaggagattaaggtttcatgcctgcaaacacaacatccattctgcagcccatggatcaagaagtaattttaacttttaagcctgattatttaacaaatacatttcataaggccacaactgccattgatagtaattcctctcatggacctgggcaaagtaaatttaaaaccttctgaaaggattcacctttctagatgctaccaagaacatctctgattcatggggaggatgtaagaatatcaacattaacaggagtatggaagaagttgattccaactctcttggatgactttgaggggttcaagacttcagtgtatgaagtaactgcaggtgtggttgaaatagcaaaagaactagaattagtagtaaatcctgaagatgtgactgacttgctgcaatctcaaaactaacagatgaggagttgtttcttatggatgaacaaggaaaatggtttcttgagatggaatatactcctggtgaagaggctgtaaacactgtccaaatgacaacaaatgatttagaatataacataaacttagttaataaaacagtggcaggattcgagaggattgactccaattttgaaagaaattctactgtgattaaaaggctatcaaagagtatcacatgctacagagaaatcctctgtgaaaagaagagtcaattgatgtggcaaacttcattgctgtcttattttaagaaattgcaccagccaccctagccttcagcaactaccaccatcaaggcaaggccctcaacgagcaagattacaactcgctgaaggctcagatgatcattagcatgttttttagcaatgaaccattttttaaattaacatatataattggtttttagacataatgctcttgcacatataatggactatagtatagtataaacataacttttatatgcactgggaaaccaaaaaatttgtgtgactcattttattatttgttttctcgcgggggtcgggaatcaaacccacaataactctgaggtatgcctgtaaataatatataatgtatatatgcatgtgtgggtgtaagtgtgcatgcatgtgcatgtgtgtgtgtgtgtgtaactccaaggacaaagatgtgaagcacttacaccaatctattaacagggagaagaaagacaggaaggtaatggaatcttctacctcttactctatatgcttctgtaccatttaaatgtattactataaagcatttttatatttgttgtggaattagaaaaacaaaaacattagtatatataacattgtaaacccttaactctaccgctgtaactcagttataatatttttagtattcttttctagctttattaaatatttctatttttagttagatattttatatcttcttagacatcatgttttcatattactacatgttaaaataattataatattccatattctgaatgagccatagcttcaacttttcttcaattgttgactattaaacaatcttatgaagataccatccatattacatttttcatgttttaaattcttttcttgcaagaaaattcttgaaattggattatggaatcaaaggatatgaacaattgttctgatgcatctcagtcttccagtgaatgtgcaggcccatgtaacatggacagtcttctgtgttctacctaaacatatatttcccacggtgctccacaatgttaattctgcagaaactaccact

SEQ ID NO: 659 - DNA, 2439 bp, Homo sapiens
tgactcgcctgctgtgctcttgcctgctgtgctctcgtaattactttcggaaaggttttctggctacaataaaatctgattaaatttgttaccaagcaaattgaattgttcaggctgcaacctttctagaagttttaaacgttatttaaaagaagatttcaacctcactccatttcagctttctctgaggagctgctcttgtgctgtttggcccctgcctactcggaatggaacaaagatcctgttgtgcctatcacctgttgaagttgccagtcttaaggaaggaatcaatttctttcgcaataagagcactggcaaagactacgtcttgtacaagaataagagccgactgagggcatgcaagaatatgtgcaagcaccaaggaggcctgttcataaaagatatcgaggatttagccggaagttgttgaaatggatgaaaacaacggacttttgcttttagaactgaatcctcctaacccttgggacttacagcccagatctcctgaagagttggcttttggagaagtacagataacatatctcactcatgcctgcatggacctcaagttaggagacaagagaatggtgtttgacccttggttaatcggtcctgcttttgcccgtggatggtggttgctccatgagcctccatctgattggctggagaggctgtgccaggcagacctcatttacatcagtcatctgcactcagaccacctgagttaccccacactgaaaaagcttgctgggagaagaccagatattcccatttatgttggaaacacagaaaggcctgtattttggaatctgaatcagagcggtgtccagttgactaatatcaatgtcgtgccatttggaatatggcagcaggtggacaaaaatcttcgattcatgatcttgatggacggtgttcatcctgagatggacacttgcattattgtggagtacaaaggtcataaaatactcaatatagtagactgcaccagacccaatgggggaaggctgcctatgaaggttgctctaatgatgagtgattttgctggaggagcatcaggctttccaatgactttcagtggtggaaaatttacggaggaatggaaagcccaattcattaaaacagaaaggaagaagctcctgaactacaaggctcggctggtgaagaacctgcaaccccgaatttattgtccctttgctgggtattttgtggaatctcacccatcagacaagtacatcaaggaaacaaacaccaaaaatgacccaaatgaactcaacaatcttatcaagaaaaactctgatgtgataacatggacccctcgaccgggagccacccttgatctgggaagaatgctgaaggatcgaacagacagcaagggcatcatagagcctccagaggggacaaaaatttacaaggattcctgggattttgaaccttatttggaaatcttgaatgctgctctaggagatgaaatatttcttcactcatcctggataaaagaatacttcacttgggctggatttaaagattacaaccttgtggtcaggatgattgagacagatgaggacttcaatccttttcctggaggatatgactatttggttgactttttagatttatccttcccaaaagaaagaccacaacgagaacatccctatgaggaaatccatagccgggtggatgtcatcagacacgtggtgaagaatggtctactctgggatgagttgtatataggattccaaacacggctccagcgggatcctgacatataccatcacctgttttggaatcattttcaaataaaactccccctcacaccacccaactggaagtcattcctgatgtgctgtgagcagaatgggcctgcgattttgcaagaatgcaaaaccacatgaaaatttcaagaattcactgatctgatgcaaaataaaaatttatcattacatcttgaacccaggaagcttacagcaaagagactatgctttatgacgtcagcaatagataattccacgttgcctttgtgatttgtatatatagcttacatttgtggatcactacatagccagattcaaaaatattttacttgttccatccacagttctctacagaaagaaccaatgaacccaataggaacaaattctctgtggaaaacaaagcatagctgtagtagatacgaatccaatcacagaggaaacaggaagagaaaaacatccaagactacagtgaaaactggaaatggtctgttttcgtgatattcgtatgattaagatgcaaattttttcttaggaaaatgtgattgttaactagcattctgttttacatgttgacatttctaacacacacaccactgatttgaacttcaaaatttattttctgattatatatgctaggtctgattctgaagatacaagaattcaatggtggaatttgtctcctgaaatt

SEQ ID NO: 660 - protein, 486 aa, Homo sapiens
MDENNGLLLLELNPPNPWDLQPRSPEELAFGEVQITYLTHACMDLKLGDKRMVFDPWLIGPAFARGWWLLHEPPSDWLERLCQADLIYISHLHSDHLSYPTLKKLAGRRPDIPIYVGNTERPVFWNLNQSGVQLTNINVVPFGIWQQVDKNLRFMILMDGVHPEMDTCIIVEYKGHKILNIVDCTRPNGGRLPMKVALMMSDFAGGASGFPMTFSGGKFTEEWKAQFIKTERKKLLNYKARLVKNLQPRIYCPFAGYFVESHPSDKYIKETNTKNDPNELNNLIKKNSDVITWTPRPGATLDLGRMLKDRTDSKGIIEPPEGTKIYKDSWDFEPYLEILNAALGDEIFLHSSWIKEYFTWAGFKDYNLVVRMIETDEDFNPFPGGYDYLVDFLDLSFPKERPQREHPYEEIHSRVDVIRHVVKNGLLWDELYIGFQTRLQRDPDIYHHLFWNHFQIKLPLTPPNWKSFLMCCEQNGPAILQECKTT

SEQ ID NO: 661 - DNA, 55404 bp, Mus musculus
  misc_feature (1)...(55404): n = A,T,C or G
ggcagttgccagttgcacaatgtgcatactgggaactgagctccagtcctctgtgagagcagtgcatggttttatccactgagacgtctcaccagacagcctcttgactctctgcattacatcctccgatcctcttattacccttcagccccatatttctttcttctacttgctaatcatatgctgacattctttttggttcttttctgtctgaattttatgatttttttttttacttattgccacgcagtgttatccagtaggctggcctccaactcattgtgtagcccaggatgattttaaactcctgcctccccctctctagtgctggtgtcacagaagtgcaacatcttgtcctgcattgggctcttccttacttagcaaggttattagatgttatcttaagaatggggaggctgagtccaaggcatgcctgaaccacagcaagaactgtttcaataacacatgcatgtaattgctgaggaggatatgggtgcgttcctttgttccccgctacagcctttgccagctttccactgtcagactgagaacttttttcatcatcatgcagaaaaatgggaagtactggaggatgctaggaagtaaaaaggtgcaatactacaactttgtgtatcctcataggaagaccaagggcttccctgttagagctccaccccatccccattgttgctggcaaggatatcattgattctgtgactttccatcctagagcaacacacacttctggccagcctccactttcattcaaaagtcctttgagacctggcatcatctccctatagggtcggatttcgtttttttttttttttttttttttttttttttttgccttatctacaaccaaaccgaagaaatgtggtttcaggcaaaggctcgcttagcgtattcttcctttctactttactttacggatttctgcacacacatatcacagcaaaggtctattacttctgacctttcattttgggtttgagacagggtctcgcttcagttggctcctggaatcttgagccttcacctgtcaagttctggaattacagggttctgtcagtacgtctgcttagggcaattctttacataagtaggtgactctaaattacccctcgagtgttataaataaataaccttgtctcctcgatgcagaacgtctgtcgaaggatgggtcgctttagtttctttcgttgcacggatttatatgataaagagcctccaggtttcggacctgctgggccgcctggaaacttccaccctcactactgtcgaggaaaccccacgttttggagccacagaaggttcctgactttcaggacgccgccactcaaccttagcggctgtcacctaactcaaggtccaaggacagtcaaagacggcctagtgcacaggttcaacggaaccccgcccctttatttcaacgtagttccgccaaaaacctctcctactgacgttcccatgggccaattaggtttcgaggcttagagggcggctcctccaattaaaaaagagaattttcagattggcaccagtttagaccaatagctgataagctccgagtttttttaccctatagaagcgttagtggtgatgacgaacagcaaaatcacccaattactgtgcctacggcggaggttgccccgccccagctgcaggaccggcggagaggaccgcttcggcgctcagtctccacccggattccgccatgttgagtcttgtggggcgtgtggcctcggcctcggcctccggggccttgcggggactcagcccttcggcggctctgccacaggcgcagcttctactgcgagctgctcccgccggggttcatcctggtaagcgccttcctggaggagctagttcggttcttctccccgtgaccttgagcttgggcctatcggatccgttctccataaggattcccgggcagcggactactgtccagccgaggagtgcaaggacagtcgcccgtgggagcgttgatataaccagcagcgtcccattttgtgaggctagagtggccggcagctgcctcgaccttgaggttttgaggggggataccaaactcgagaataatggcggttctgtgcacgaggtcgggaaaacagtgcgggtgggttcccgattgcagcgtgcccttctccatgcctcctcctatcttgcaggagacttagtctgggctcagctaaccttccctcgggggataaatctgggattcgggtgaccttaagctgtcctaacaccaacgccttccaatacctttttgtctgctagccagagactatgcggcgcaggcgtctgcggccccgaaggcaggcactgccaccgggcgaatcgtggcagtcatcggcgctgtggtggacgtccagttcgatgagggattaccacccatcctaaatgccctggaagtgcaaggcagggacagcagactggttttggaggtggcccagcatttgggtaagtaggacgttttagaggtgggaaagagcttgttaggcttaaataacacgagatcgtgccatctccattctgtgatgactttaccaaatgactttcgttcttctgagtttgctgaagccacactcaggtgctgagaggggaggcctgtttgcttttgatcacccttcattacatactgttaggttttggtgcttataacgtgttaatgctgattgacaggggagagcacggtcagaactattgctatggatggcactgaaggcttggttagaggccagaaagtactggattcaggggcaccaatcaaaattcctgttggtcctgagaccttgggcagaatcatgaatgtcattggagaacctattgatgagagaggtcctatcaaaaccaaacagtaagtttctctcactgcatttgtgaacatgggaaccttttcttgcagttgtacacatggggtaataactggtagtaaagcaacattttcctacagtactacttccatttctgttgtattcagttattgaaaatgaagatacagaagtttggattgttgaaaacttgctacatagaaccccctattactttttttaaagctgtgttacattatggattctctaaaatttacaggtttttattttcttattgttatataaagaaactttgttatattaagttcagtaaaaggaaaatatcaaaaaagaggattatttgttcttgagacttttttttttggtttttcgagacagggtttctctgtatagccctggctgtcctggaactcactctgtagaccaggctggcctcgaactcagaaatctgcctgcctctgcctcccaagtgctgggatcaaaggcgtgcgccaccacgcccggcgagacaatattttttattgcagagagatgatgttctgtgacagcttaacttgaacaagattagacttgactgtttgtggtggccagtggcttttgagcatggtgcctggttctgaccctttcctccctgaaccttacagatttgctcctattcatgctgaggctcctgagttcatagagatgagtgttgagcaggagattctggtgactgggataaaggttgtggatctgctggccccatacgccaagggtgggaaaatcggtacgttggtttttggtccgtgttttccaaatacagtaaagcatggagacccttttttcttttgagagtgcttgagccttcagtgatgattagcttctgactttcgttcttctgaatttgctgaagccagatgccgttcctgagaaggggaaaatggacagaactgaacatttttgaaggctgtttaatttgggaatgcagagatctgaaatatttcttcttaaactaggactctttggaggtgctggcgttggaaagacagtactgatcatggagctaatcaacaatgtcgccaaagcccatggtggttactctgtatttgctggtgttggtgagaggacccgtgagggcaatgatttataccatgaaatgattgaatctggtgttatcaatctaaaagatgccacttccaaggtgagctccattcagaaaactaatgtgttatgtttgatgtgatgagccccgggttctgtaaacaaaatagttgtcttcccaccaccattttccagaataccagtgtacacttctctggtgtgagatatttctagactttttgatgagtaagtaatccaatttgaaagctgatttaaaaggtgtagaatggaagccactcacatatctcagtcttacttttagtttagaaattatttccagtgttctcaatttcatgaaggttccaaacagaaacattggcatccagtggaagatcccattagtggtgtctctctctctcttcccctctcttctctctgattgggaatcttggatttctctgtggcttccttactactctgctgtcttttctgacttgtgtatgttttacaggtagcgttggtatatggacagatgaacgaaccacctggcgctcgagcccgggtagctctgactggtttgaccgttgctgaatacttcagagaccaggagggccaagatgtcctgctgtttattgacaacatcttccgctttacccaggctggctcagaggtaggggggaagcctcgaggcctggtttgttgagccagttgggcatattagaagaaagatgtagacacctaagaccattattctttacttctgtcttttaggtgtctgccttattgggcagaatcccttctgctgtaggctaccagcccaccctagccaccgacatgggcacaatgcaggaaaggatcaccaccaccaagaagggatcgatcacctcggtgcaggtaatgaaaaaaaccaacctagggagataataacaccatattatacttggggctagagagataattcacagttaagaatgcttttggctcttccggttgcccagtgtccatcaggtggcttaccatctgtaactccagcttaggagacatggcgccctcttttggcttccatgggtacctgcatatacagtaaacatggtctggggcgcggagatgtacaaaaatcatgtgctaggtgaaatggcacttacctttaatcccaacacttagaaggcaggggcaggtggatctctgagattgaggccaacctgctctatgtagagttccaggacagacagtgttgcttcttgaggtcctgagtttgattcccagcaactacatggtggctcaaagccatctgttatgggatcttctggcatgaaggtatatatacagattgagcactcatgtataaaataaaaaataaatttaaaaagattatgtatttgtatgctagattgtaaaggttaaattagaaacaaatgctcattagctgggcgtggtattacatacatatacctgggatcctagcacatgggaaacaggcagaaggatcaggaactcaatgctatttccacctacatagtgaattcctgcctaacttcactatatgacactgtctcacaccagaaaataggacattttttttttttttaaagatttatttattgattatatgtaagtacactgtagctgtcttcagacactcaagagggagtcagatcttgttacggatggttgtgagccaccatgtggttgctgggatttgaactcctgacctttggaagagcagtcgggtgctcttacccactgagccatctcaccagcccccaataggacatttttttaagtaattctaaggtactggggctgaagagatggctcagtagttaaaagtactttctgtaggcaggtggtggtagcccagaggaagcagaggccggcagatctccaagtgtgaggtcagagtggtctaggaccaattccaagataaccagtgctacatagagaaaccctgtctttttttttttaaagatttattttattattatatctaagtacactgtagctgtcttcagacacaccagaagagggcatcaggtcttattaaggatggttgtgagccaccatgtggttgctgggatttgaactcatgacctttggaagagcagtcagtgctcttaccctctgagccatctctccagcccccgaaaccctgtcttaaagaaagaaaaagaaaaagaaaaaaagccatactttttgggattgtattcccagttggagaggatcagtccgactcctcgggtacattctgcaggctcagtcgtgcatatgatacacaatgaaaatattgttgtatggtttttgacattagatctacttgtgtagcttcagctggcctggtactcactttctgttcagctctgtttggcagctcatagcagtcctcctgcctcagtgtcctaagagttgggattatagacaggagctgctacatctagctttcattgttatcttgattgtgtgctgtgtattccgaggcacataataagcaagcaacaagcaacacataagcaagataatgatgataacagaccttaccatgcaccctcgtggtcatatttacttagcattgcagtgcaggaacatcttttaagagcacaacataaataaaagttggtaccatcacaataaagtgttggcatagtatgcagacccagataaagggagtccatagcttaatccagtcccagagatgccaagaaagaaaaaaaaagaccttgattttaagagggaaatgaaaagagcaggcttaagcaggagtggggttactgctgatctcctgggttcttgactctaggctatctatgtgcctgctgatgacctgactgaccctgcccctgcaaccacctttgcccatttggatgctaccactgtgttgtcccgggctattgctgagttgggcatctatccagctgtggatccactggactccacctctcgaattatggatcccaacattgttggcaatgagcattatgacgtcgcccgaggagtgcagaaaatcctgcaggtgagtatctttatcctcagagtcaatggccatcaaattgtaaggaatttgagacctctataaggactagatttttttttccccctagtcatttgtgtgaacaaggaaagttgagaatggattgatactgctgatgaggtgtccccagtttcagggtactctacttcacccttagaatccagttgtcagactggcagtagtggtgcacatctttaatcccagcactcaggaggcagaggccagcctggtctacaaggatagccaaggctacacaaagaaactctttctcaaaaaaataatcagttgttttctaacctagttgaataggcagaataagacactaaccttggttgatggcttcctggaccttctgaaagtgtaggcacttaactctgtccttcctttcatcttgcttgcttttaggactacaaatctctccaggacatcattgccatcttgggtatggatgaactttctgaggaagataaattgactgtgtcccgggcaagaaagatacagcgcttcttgtctcagccattccaagttgctgaggtcttcacgggtcacatggggaagctggtgcccttgaaggagaccattaaaggattccagcagattttagcaggtgaggttttttctttttatcaagcctagccataaaagtgagagaaaacaagcctatcttctcattctaacatgatcaaatgaaatgatacatacctttcttttctttcttaaagatctattatgtgtatgtacactgtagttttcttcagacactccagagacagcgtcagatcccattacagatggttgtgagccaccatgtggttgctgggaattgaactcaggacctttggaagaacagtctatgctcttaacctctgagccatctctagcccccttgtctatacttttcttaaagtataccattaaaggccattaccctgccttccattaactgtcccatgtcactgagttgaaagtgagaattttaactcaggtgctccagattacgggtttttaagtgcttgtgtgtctgagtgttgtatgtgatgtgagtacacgatcccatgaggagttagatcctcccagaacagtcagtggaggttaggagtggtgtctggtcactggaattagaggtgataaagcagtagtcagtgttaaaccaccactcaagccccaaacatattcttgatctactacatcttgtcttaaattacacactttacactttaaaaacaattatacttggaagggggtggatatggtgcacacctttagtgctgggactcctaaatagatctaggggcttgagttccaggtcagccaggaacacacccccaccccccaaaagtaaatttcacgtggaagttgaaaagtttccttgcatgataaggtttcacagtgggctcaagtggtgaggtgtacatgctgcaggaagctgatataactcagcttcttactgtgttttcccctatgtaggtgaatatgaccatctcccagaacaagccttctacatggtgggacccattgaagaagccgtggcaaaggctgataagctggcagaagagcacgggtcgtgagggactccagccaaaggcagcactgcaactgatctctccatatcaagcgagagctcaggtttccttccatgcaggccacacaagagccttgattgaagatgtgatgttctctctgaagagtatttaaagttttcaataaagtatatacccctcatttatgtctgtttatgttgcttctgaaacagcttataattgagctcacagtggtgggccacatttaggaaattgttagaaacaggattattattaaaaagatcaatttattaatgagattctatgggccttgtgtttcataataggctcagctttggtttttgctccaactatcactaaagtgtttttcccctggagaaaatagataaacttattcaagacagggattgcgtttttaggaaatgctgactatctgtcacaattgagggtcttgtctaggtactcattcagaaaattcttaatatattgccagaaatttgaacaagcctagctgtgcatgtttgtgcttgagtcttcagggcaaaaaaaaaaaatggtctcttaagatcccttatgaaaaagttttaaggcttcggtgatgttacaaagagtaatcttgatactgttgccactgggacttttgaaaagcagtacttcctcttcataaaaatgggtaccttagcacacactatgctaggatgtattttgtgccttacaacgtgtttgagcccagccagtggcctcttgtggaagcatttgacactacaagacctgcaatctcaccattttgaaatctatttaaggctatttgcaaggaggtatttctatagtctaatgactatttacaaaccagctggagttggcctggggaggagcctacatctataagtttcaccttgtaaggttgtccacttggggtagagctctggacagctcaactcccaattctgagctctgtgacctaaagggctctgggaaaggttcctggggtggagtagaggcttgagcttccatctgtctatgacgtccttggctccagtccctcctgtgtcaagattaggacagaaggtggcgcccctgagttgcctgttcttggtagtttgctcttggagcttgggttgggggaaatgctgttaccgggtggggacagctccagatcctgactcgagtcggcaaaaagctgataaagacctaagagtacacaggtcacctctttctgctttgtcacccaagtacagacttggaaactgatattttaaaggtcatttccatcccggtgttcgtgttctctaaggtttgtagagaacctttctctctcgctagctgtaactctttgtttccttcatcctttactgtccccttcaaccacagtcctaaagtattaatatagttctaaccttcctccatatttctccggtcggccctgtcctcgcctcctccctctctccacccaatgaaagccccgcccttccctcctccctcccaccccagtctgtcatacagggacatcaccctacagcagttcaggctgtgtcgttcgcaggaagcatacattggcttttttggggtttgcgagttcccagcccatagttggacaggatccaacagtagccttcaattgaagcaagacccaaggacagtgagaatctgggtcctaatcctgagtcctgccagcctgacatgggtaagtatgatagctgcccctgggaaaggcctgagggatgcccagctccctctctggctgactcagcaggggtggggcctaacctttgctcttttgggggagtgaaggaagagaaacggactgtgggggggacacggggcttagctggtgagctgctgagcattggcaagctccagctctaaggaagagcctggggttgtatcttaggttagggcttccttcctcaccctagaaccccccgctccaatttaagtgcagagattcaagtagtattttactgtattcattactagttcagtcttggtcttgtaagagatgcttcccctccccctagtttctctcggtgtttcttcctcccccctttaacccaccaccgggtcggggctgcactgagcagctgcttcctgttgccccagaggttgctgcaagggtggtggtggtggctggggccaaaccgagcaatgaataaagtcgattcttagccctgcatcagcctcacgaccctgttacggatggcctccaccattgacaggacagagagcgttttgcctctgtggtttcctgattccagatttgtacagctgtagtacggatagggccgggagaagcctgtttacctagcagggcgctgtgcgtgaccccgacatgctctcggccttgagttccctctcctgctctcctaggcctccttgaatctttgtggctcccactgtctctccagcctcctttgtgaataagtcttagctgggcgccccgtgccggcaaaaagagctcttcaagtactccagttcagacccaccgctgtccccaactacgccgcagaagtttctgtcttttcctgcatctgggatccttcctggttctggcccctaggagacgccacccgccgtcccctcccccagcggagccttcgcgacagccgtccctgagcgctcgtcctcacccgggtggctcctgcccctttaagcgccgccccccccccctccgccgccggcctcgggctgggggaggaggcgccgccgcccggctcggccacctgcgccgccagccgccgcccggcccggccctgcttcaggtgaggcccggcatccgcctccaggcccggggtccagggcagggcgtccccgcagccgcttcctcccctgggatccaagctctgaccttccctgcgcccgctgcccttgctctctcccccgccctgcctcctcgcccgttcctcccctgtcctctgcgcccgggatccggaggcttctcacgcctctccgccatcctctcccgggaacccctcctattccggccctggatctcccctcccccgcgcctccctcgccagaaagctctcccgcggtctgggtttcgcctcctcttctctggaactagcgctttcccacgccatcctaaccccggagggggggggagataaccgccaccccaacccctctcctggtagtgcggggggcggggggtacgacgcacgttacgggcgctgtccgccctgctccgctcacccttcaagttcagctaagtctcacctaaagcttttcttgccgagtttggggtcggacccgagcaccgccccctgatctcggtgggaagggcgctcggccccgctggagctggcccctccccctagtccgggcgccgggggcagcggcgctgcgggaaccttgtgatactccgcttcagcggctgttgcggcagaacaagactggggctaagtctctaagggattgggggtgctgggtaaggcaaaggaagcccaaccttctctatttcaggttactccagaaaacaaaacaaacaaaaaccccgagatgtcactgtcttatatgcctatcatatgcccagctgtccgttggggaatttggagactaaatccgaggggcgcagacccacttggagaaggggaggggttacaatctttttggcatattatgagagaacctaaccttaccaaaatacggtgagattgtctcctccgaacctgagtgccgaaaaggaaccaatgggaattgctacagggccaagagctgtggctaaggcaagatcggttcagtcatggagtgggaggtctttataattaccctaccttcaataggaaatactctttccatccagctgagccccgagctccttctctagtgcccctgcctccagaattagtagaatgggtgtcagggtttgtcttatactactctgagtcacaactaaaggtgctgggaagggcgcagtgtgtgtgtcctgtagtgcttaaggttggatgcttggagtgtcttgaagaggaaagggaaggtacagctaggatgcataccaccatctcatagccccagccatctggctccagagtggctggcacaatgacagctgacccagagacagggaggtacagcaggaacttggagggtgagaaggcggtggcaggtgtttatcgccacttcacgtctcatcatcctctggcttgttttgtgggaggttcagtctgttccccagacactcttctcacaggttgctaataaaatgaccgttggcccctttctctttggagtagcttcttgaagggaggcttgttggctaaccagccacattgttatggggattgacaaatgtttggggacacatgggatcaagtccgcttttttgcgttcagatttggcatgggggtggggggcaggtcacaagtgttgtatgttaaggcacccggcaaaaagtaaaaagctttggggcgtattccctgcccacctttatccttcagagagtagggaagatcgcagcctaggtgggataaagcgataggagcccttctgtaccagatgaaaaaacgtattatgccctgtttttcctcttctaatatctggtggtcttctatcttacctctttctttactggctcagggcagggtttgggcctaaaagtagccgaggttactaggcctggggctcggaaggggtgggaacagtggggcacaggagtaaccggctcttccggagccagcggtgggtgtgtgtgggtgtgtggtgatgaagcgaaggggcgtggtcacggacgtctgactggcgcaggctcctcctctgcgtgccctgtctcaaactggttagccccgggtgggaagtaggaagagtcatctgccctggaaaaaggagaggacagaaagataccagctttcctctaaatctgtctcttccctctcctgcccttaggtgccagttccaacctaagcttttttttttttttcttggtggtggtggggttacacatttttgtttgtttgttttttgagacagggtttttctgtatagtcctggctgtcctggaactcagaaatccacctgccttcccctcccaagtgctgggatttaaaggcgtgcgccaccacacccggccacactttttttttggcctaagtttacttctcctttctccagggcgtggaggttagtgggcttttggaaagataaggtgtatccccccaggcgacctttgtccttttgtgttttttccagacaaagtctcacaatgaagtcctgactagtctggaactggatttgtagaccgagctggccttgagctcacagggcgatcctctcctctatgcctcttcagtgtaggaatgaattacaggcgtaggttgccgtgactgactttataaactcattttgacaggggagagagattttgttctgtctcctccttcccttagtaatctacttagctctgttgagggagaggaaccatgtgctgagcccacatttttggcttatcttaaagagatcttccttttgaaacctatctgaactttttataatgatgggtgggtaaagcatctcccacactcagaatccctgtctggggtaaagacattggcgttagactgcgggtttggttcaatcagactctgtccacacccagatttccaagctcttgggatcccccagagaaaaatgtatttgttgacccctcaaaaccagccagaatcttgtttctgtgtgtcgctctttctaagtcttcagacttagctttgcgtagtttaggcaattgtttacattctaaaactacatttcattgatttgaatgggaattatgaagccagaagtcttgaattggaaggaaggggaatgcagttcccttctagtcatattttatttactgtgtgactttgaacaggtcggggagcttctgtgggtcttgagttcttcacctagtgagtgagaggtaggaactgaaaagaaaaagctgtaacatacgacactgtttcccatcttgggtccctgcaataacattcagatgaaagctaagccataattcctgtctagacttccagttctccaaagaacacagccatgtagccttgttggaaaaggtttgggagatgggcggtggtggcgcacacctttgatcccagtacttgggaggcagaggcagaggcaggcggatttctgagttcgaggcgagtctatcgagtgagttccaggacaagccagggctacacagagaaaccctgtcttgaaaaaccaaaaaagaaaaagaaaaggtatgggaacagaaaaatatttgggtcagttttttggttatcttactgcttatcttctaccctttggccacatttaggctagattcagatcttgactgtgtggagccagagccaagtctcctttccccatgtgcaggattctctccaacgaccaaggtcctgcagatgacaccaggaaagcagtgatccaggcaggaccaggttgtccctacaggacataggtgagtatactgcttccttttcatccctgtaaaatcgctccctatgtatcaacttccactttttcatcaccaccctgctgaggaaataaacagccccgaaatggtcctagaaatgggttctagccgttatggttaatcctgggatatggctcacctttcaatttgacctgcgtgaagcaagactccaaccctcaaagagatgctggtgaagcagggaactgctgggagggattctgggcgctaggacccagattcggatcggggccgggcactaggacccggcggccgcggcggtggagggcggtgctgccggccccgtttccccgccccctccgtttactcctcccccgccggccatgttggctcagctcaggccccgcggttgaaccgcgacccccttccccctcccagaccccgcaccctgcacccctctcccgcgggagtctcctccctcctggcgcccggagcctggccatgtgaaccgcccgtcccccggggagaagcgagccccgaccgggctggacgcggtcgcctcaggtttgttgggtgtgcggccgggggccgagggtcgggcgcccggtgtccgcgggagttcctcaggcagctggcgcctcaggtgaccgggacttctccccgctgggacgccgccggagctgttgggagaccccggccgggcgcgggtggcggctgacgaggccccctgaggtggcggtgcggtcgggctcggctggggtggagacccatccagtggcggcggaatccccgggagggctccacctcctggggcggcggggtcgcgggcgtgcaggggatggacgcggggcttcccacggtgggctacacctgaggctcgtgcggatgggggtttcggccgcggtgagtgggggtgactccgcggtgactccccggagagcctcgggtttctgttctccgggtcgtggagagggcctggctgtcggtcgtgctggcctggcttggggccctggagccccgggagaatccctgactctagagatgggggttgatacaactcatacttggcgtctggtttgagtagggccgaaaactgaggggaagaataaagagggattccttcccaaggaaatcctctccaaaggggatccccgtttccgtagagagacggtgctctcgcatcatccctttctttcccggcgttcccgacttgcacaagtcaatgccaatagcaggcatcctttgtggagcttacaggaatgagggatttgtatccttcggggggagtggtgttggtgggggcgatagcttccaccacctccatctgtacacaaactgcccctcccccagcctcccgcaggaagtggcctggaaatggcagctgtgcgttcgatgctgcgtctcttgttgttttgaaatgaccattttaatctgatttggtttcattttctgaagccttctgggcaggcttggatctgccaaacgttagactttttccactgtagtattcatttgtcatctagtagtcggtcaactatagttgacccactgatcttggtcctcctttgtacactgtctcttctggaccccactcctgccccaaccaagttagaggtcatagaaaatcaaagtgagttatcacgagcagtgatcactcttcagaacaagcagtgcagattgagtgtagaaagctgccaagagtacttgagatctttatggaattagagtggctttcttgatccttaatatttttaagcatgacagtttttcttttttgcaaatcatcggagcaaataagcttgtggagaaaaggatacttatgagatgtggaagaagggaaagggggaagatgtgtacttatgattagtatatagggatggggactgattattattactaacgagagtgttaagcttgttcctcagtggtgagtttagtccagtcctgcagggaaacctcctcgttgacttttttaccttttacagaacaaattaggggaatttgctatcatgatgtaactttcgtctatacaaggctggctggctggctttctttcttcctttctttcttctttttaaacatttatgtttgtgagtatactgtcagtcttcagaccagaagagggcatcggatcccattacagatggttgtgagccaccatgtggttgctgggaattgaacttaggactttgagcagagagccagtgctcttaaccactaagccatctctccagccccaaaagaatatttcttgaagggtagggttttttctttttccttaaaatttttgttgttgtactttatgtgtatgggtcttttgctgcatgtatgcctgtgcaccaccggtgtgcctggagccagcccatagagacccgatgcagggtttagattgctgggattggggttacaaaatagttgtgaactgtcttgtgaatgtgaagactgaactcctgtcctctggaagaacagcgcttaactgaggagccatctctccatcccaaaataacgtgcttttgttatttttaattgttggtctgcaggggctggagaggtggttcagcagatgagagcactggctgctcttccagagcactggggttcaattctcagctcccacatggcagtttacaactgtctgcagccctatgtaccagttctagaggatctgacaccctcacacaggcctacagatgagcaaaactccaatgcagaaaaaaataaaattaaattttaaaaaaaggggtgtgtgtgtaccaccattgctcagctgagatttttgtttttttcgagacagggtttctctgtatagctctggctgtcctggaactcactttgtagaccaggctggcctcaaactcagaaatccgcctgcctctgcctcccgagtgctgggattaaaggtgtgtgccaccacgcctggcgagattttttttttttttttttttagagctttattttattttatgtattcacattcagacacaccagaagagagcatcagaccccattgcagatggttgtgagtcactatgtggtcactgggaattgaactcaggacctctggaagagagcagtcagtgctcttaatgactgagccatctctccacccccctggttttttgtttgtttgttttgtttttttaaaagatttatttattaattatatgtaagtacactgtagctgtcttcagacactccagaagagggagtcagatctcattacggatggttgtgagccaccatgtggttgctgggacttgaactcctgaccttcggaggagcagtcgggtgctcttacccactgagccatctcaccagccccctttgttttgtttttaacttttgttttgagccagggtcctagaactccctgagtagacatggctggcctcatactcccgagatcacctacctcagccttttgagtgccggacttaaagtctttgtcattgcaacacagagacttgttttttgttttgtttttttcttataccaggatcagactggcctagaactaagcttttgaagtttatgttggctttaagctgggagtaatcctgcttctacctctcagatgttgggattacagaacagactccactctgcctggtctaaccaagagattttttttttttctctaaaggataaagtgatatcactatgatctatatctctccattttgttttttgtttgaaatttcctatccaccaccacccctaagacagtgtctcattagatagccctagctggcctggagttctctatgtagaccaggctggccttgagtttacagagatgtacttgtctctgtttcccacagaatgggattaggtgtgtgccccatgcctggctccatcctgttttgttgtcatttgggtttgcttagggacacgacttgaaatactaagaatggaaatgtgaagatcatttgaagtgccctgcaaacatgcacctgtcattgaaattgtgatttttctttttctttctttcttttttttttaaagatttacttatatgagtatactgtagatgtcatcagacacatcagaagaggaaatcagatcccattacagatggctgtgagccaccatgtggttgctgggaattgaactcaggaccgctggaagagcagtcagtgttcttaaccactgagccatctctccagctccaagattgcaatttttctatcagaaacttgttgtctgcatataagtccatagattgaagatctagggtaggagcaggcttatgtaacttttgtgaaaatggtatctttataagtaagattgaatcattgctcttagtggggtggctgacaatctggaaacagaaacaggtgtgtgggcattgcctctctgatgctgactggcaggttcttctgaccaagaccgtaaagggcatctgagtgatatcagctgtctggttatgtgtgcgtgcgtgtgcgctgggaatttaattcaaggtctcacacatgctatgctttaccgttttcgtatttaaaagatatagtactggtgtagttatgtttgtcacggggtgtgggtagagattaaagaacaactttcaagatttagttctatccaaccatgtagatttgaattcagctttgatagtaggtgcctttaaccattgagtctcctcatcagccccaccacttctcctgtttttagcctgtagaaattgattttccttgttggagttaaaagagggaaaagatgtggaaataagagtttggtggtaaaaacattcttttttgtttatttttttgtttttcaagacatggtttctctgtgtagctctggctgtcctgaaactctgtagaccaggctggctacaaactccccactgggattaaaggcgtgtaccaacacctggttcacctctttttttttttttttttttttttttggtttttcgagacagggtttctctgtatagccctgactatcctggaactcaccctgtagaccaggctggccttgaattcagaaatccgcctgcctctgcctcctgagtgctgggatcaaaggcgtgcgccactactgcccggtggtagtaaccttttttattctcctactcttagagtgatgtaaagttattaattggtatagtgtgtgatcttgtctgtgtgtgaagtgagacagtaaagtgagtttttatattttaggatatagagaggttttctgggtttttcttccccccccccccgcccccttatttcggcagtagggtttcaggtaagtctttctgtgtacccctagctctcctgaaacactccatgtagaccaggctggccttgaatgcagagagatctatctgcctcttacctagtgtgtagagggccttcaggtcagtccacagcaggaatgtagaaatcaagaaatttggggccctttcccctctagggtgataggtcaataaagtgctgtttcgtttgtttgtttgcttgagacataatctcattgtgtgagattctggctagcttaaaattgggaagcatagaccagactgacttttagttcacagagccctacctgcctctgctgtgatttagtcctgggattctttctctttagcacacaagctcaagctggctttcaactcctgtagcccaagtgggcagtccttctgccacggtttcctatttggtgttgtcttgtgttgtctcccctaccttgtacatggtagtatattctatcaaaacactacacaaaactcttcctttggcagtgaagtgtaagaatgtgatatgattcctttagttttgttgttgttgttgtttaaaagaatggttcttatgtaatccagactggtttctaaatagatcatgtatcgaaagatgaccttgaacttgtccttcttgcctcttcccaatttttttaagttttattttttatttgtatgtgaacactgcagctgtcttcagacacacagtagatcccattacagatggttgtgagccaccgtgtggttgctgggaattgaactcaggacctctagcagagcagtcagtgcttttcactgagctatctctccagctcagtttattgagtttttaatattgttagaacttttctattcctttatcttatttacaaggaatacctaacaagtctattaaggatccttgtgtttagttctcagccttgggtttagttcacagcagtatatgaaaggagaagtcaagagatttggggcctttgtttgtttgctttttttttttttttcttttctgagacagggtttctctatgtagccctggctgtcctggatctcactatgcaaaccaagctggacttaaactcagagatatgtcttcctctgcctctgctggaattaaaaggtgtgtatcatcactggccagctactaaaattccttgaactcagaaatctgcctgcttctgtctcccaagtgctgggattaaaggcgtgccaccaccaccgccctgcaaatttttttaggcagtatctcactgtgtggccctggctagcttggaaggctctaggaaatacagaccggaccttcaacttccacctgcttctgctatgactgagtactgggattaaaggcatgagccacccaaatttgatccctagaacccgagtaaaaatgtcaggcaggcatggtgctgtgtgattgtgaacctagcactagggaggcagaactgaaagacccctaaggctcactggccagccagtctagcctaattggtatacttaagatcattgggcaccctgcttcaaaagagatgaatggttttagaagtcctctgatctacacgtgtactgacacatacaagctctggcatgtatatgaaattgggggctgtgatggtggtacagacagaggcaggcagatttctgaggccaacctgatctccatagtgaattctactcttgccagggctatatggtgagacgctctctcaaaaaaagaattaaaaacaaaatagagggctggagagatggctcagcggttaagagcactaactgctcttccaaaggacctgagttcaaatcccagcaaccacatggtagctcacaaccatccataatgagatatgacaccctcttctggtgtgtctaaaggcagctacagtgtacctacatataataataaataaatttaaaagggggggggactggagagagctcatgcatgctgctcttcaagagaacctgagttcagtttctagcaccctagcacccacctcaggcagctcacaatatagtctgtaactctctctgcctccaggggatgggtgcaacacctattggactcttcagatacctctgctcatttgcagaaagaagacatgggttctattcccagcacctacatggtagttcaaaatcatttttttattattttattttttatttatatgaatatactgtagctgtcttcagatacaccagaagagggcattagatcccattacagatagttgtgagccactatgtggttgctgggaattgaactcaggacctctgaaagagcagtcagtgctcttaactgctgagccatttctccagctccctcaaaatcttttttttttttttttttttaagatttacttattatatgtgtcttcagacacaccagacgagggcgtcaaatctcattacagatggttgtgagccatcatgtggttgctgggatttgaactcaggaccttcggaagagcagtcagtgctcttaaccactgagccatctctccacccccctaaaaatcattcttaattttagcagtttcagggcatctgatgtcctctgctgacctacatgggcaccagatgtgcacatggtacaagtataaatttttatctctatgaaaaactggctgtgagtggtagcacacacctttaattccagcacttaagatgaacagataggtggatctctgtgagtttaagtccagcctagtctacatataggctgttccatgacagccagggctaaatagagagcctatctctgaaaaaaaagaaggaaaggaagggagggagggagggaagaaagaaaaaaaaagagagagaatatatttctctgaaaataagcttataccaatcttctagtggtaataacaaaacgctgcgccacacattcagcagtaaatcatttggctctttctctactttagtgttaaattaaattctggaaacatggtggtgagacttaacatccagatgattgtagagaacctgcccggacatgcagttttctttgagtagtactttcctactacctcagtgtaaaatttcatcaccttccttcaacttcacttagggttctagttggaaatagaggttaaagaaaggacattttgcaagagattgagcctcagtcagaacatgttttagttggtctgattctgagttccaaaagaagtttgagtaggttagataagagggcatcctttaatgtgagtttggcacctggaactctaatggaacaagctgactttgggaggatgagttctcaaggtatgaaatttaaaggtcaccactgtctccagtgtcaggaactgggagtatagaaagcttggagcttcccaagatgtgtgggacagaatggggacaacttgtttctcaaccttgatgctctaccttgggtcatttatatcactgtgtcctcaatcgttattgctcttaaagaggacctgggatctattcccagcaccatatggtggctcatagctgtctgtaactccagttccagatatctagctcctcatctgacctaagggcctgtgtgtggtgtacatacacatgcacttaggtgcacacacacatatatatataacattagggtttttttaaatgctgagaagcaagttgacatgtcaatattcacctgtaatcccacattttccagggtctaactattcctagctggcctggaactagctaagtagaccaagttgacctcctcaaactcggagatccatgtgcttgtgccttccaagtactgggattaaaggcatttgctgccatgcctgtcattttcttgtattctttttttttttttttttaagatttatttattgattatatgtaagtacactgtagctgtcttcagacactccagaagagggagtcagatctcgttacgtatggttgtgagccaccatgtggttgctgggatttgaactccagaccttcggaagagcagtcgggtgctcttacccactgagccatctcaccagccctttcttgtattcttatattgtaacatctaggagttaagttgtttttgtccgcccccccccacacacacacaatgtatgtgagtgagtacatggtcactacatttgggcaaaccaggagggcagcatcagatcccattacagatggttgtgagccaccatgtggttgctgggaattgaactcaggacctctggaagagcagtcagggctcctaactgcccaggagttaagttttatatattaagtctggctacatcatctctcttgtatttcccatcatactataagttttaaaaacatgccttttaaaagccaggcttggtggtacatgcctttagtgcctgcactgggaggcagaagcaggtggatggatctcttgcgtttgatgccagcatggtctgcaagaccaggacagtcagggttacactgagaaacccatctcgaaaagcttgtatgtgtgtgttatgtaagtaccttttaagctgggcgtgtgtctcatgcctttgatcccagcagttagaaggcagaggcaaatgggtttctgagtttgaggccagcctggtctacagaataagatctaggacattcaaagctatacagggaaaccctgtttgggggaaaatttttttttaattttatatatttacataaatatataatacatatgcacatatacaaaaagataaacattctttttactctttgtctaataagaaaaactaacatggctgggctttatggacatacctttaatcccaacacttagggtttgtggcaggggacgtctctgaatcctaaggagtctgaattatcaggggctgacactctatcaaacaaactaaacatttaatacaagggcctttatataaagtttcttgtttaactctcacaagttgtagaagtgcataataaatttttttctaagtattttgtccaaagtcaatgaagccagtgtagagctaagatttgaacatggaatctgttcttttgctcattgactgtacagcacatagcaagtatgtaggaatgaaatgagtgggatggctgtgatgagaagatgcacttaatttgtaaagtcggatgtggtattttctcagagtgatagaatggataagtttctttgtatattcaataacaaaacaaaaccaaaaaaaaagaaattaagtgtgacccatctttgagggtatactgttccgagtagattgatatgtgacggcctaaaactgggggaaaaaggaggagtgcgggtcaagtggaattggttccttccaggatttctgaagtgagctattgcatgttctctttgctctgtggcttaagctttgaaagtaatccatcctaaaacaaaaatttagttttattgttttacttattgtttcactcaggattattaatctcttgatacttacttttgtctccatgctctgaagaacgggctttcctgtaacggggacgtcctggatgacggcggtcttttcatgtgtgcttagcagattagagcctactatttactttacactcgatcttagccaaaaagctgagaagtggtgggtgggtggnnnnnnnnnnnnnnnnnnnntgtgcaggcctctctttcaaccatgtgggttccagggattgaactcagctcattaggcttacctgcaaacatctttctttatctgttgagcatcttgccagctcttactgtaattttagaatgaagctggaatattctatatgagatataaattagtacagacaactttcctgagttaggccttgtggcacatgcctgttaacgacatattttctttccttgctgagttgaggctactctaggttgcatgaaacacactcaagaaacaagcaaacacacccattctctccaccttgctgctcacttaaatagaatacaagttgcttttatttcttttagttagaattaaggtactagttgtaatggaattgattaaggtactggtatttaaaactataaaatctcagaatgactatgcagtaatgctacagaaggtttacattttagactcaattgcattctgaaggctgattgagatgttttagtaaagtcttctgctgccaggcctgaggactgagatcaatccctggaacatggtagaaggagaggcctgattttcccaaattatcctgacttctgcacatataccatggcatgtatgcctacacacatataaagcaatttatgtgtatgatgtaagtatatttgcgtgtgcatgcattgtatgtatttatgtagtgtgtacagactgttcatgcatatacctaatgtttaattttcaatatatagcatattcataaactgatttcttgctttgaaacaagatcttactgtgtactccagtctgtccttgagttttgatcctctcgccttggcctcttaagggcatgtgccagtaggtctgactgatacacacacacacacacacacacacacacacacacacacacacacacgtctacatcttagagatgtaggccagtggtcatatattttcataaccaacttatccttttaaacagataattaaaatattacctaggtctgctttattgcttcaactttgggaacttgataaaggaagctttctaattgcccagcatgggtgcatgccttccatcccagcactcatgaggcaaaggcaggtagatctctggagttcaaggctagcctgatctacagagtgagttccaggacagagaaaccctgtctcggggaaaagaaaaaaaagaatgttttctatgtaagtgcttatgccctctaaaagttattaacataacccaaggccttgtttgtttgttttgtgtataaaatcaatctctcacatgctaggttaatatgcattagcacatcacaaatgtccgacaggtcgggctttcccaatagttcttagttctgtttttatcctcttggacagatctttcagtgttaagttcattttcaccaagggcttcatttcctaccattcctagtgcagggcttatagttgagataccatgtttgacttaaagttgggtctctgcccaggtttaggacatattttcttctcttttccacttgcatcttctcatagtacctacattgaagggtatgtaagggagggaggcacacagtctctaggtgatcatagaaccttgtttaaccacagattatttcccccctttctccgtcctacagaaatggaggcaaacgaccattttaactttactggccttcctcctgcaccagctgcctcaggactgaaaccctctccttcctcgggggagggcctctacactaacgggtctcccatgaacttcccccagcaagggaaaagtaagtatgggggccatagatctggggagaggatgggcaccatcagatcaggctggcaaggggagactgaggtctctctcgggctggccaccgcacaactctttggcaggtagtgaccagaagcaatccagagactactacagctagagagaacgcaagctgctgagaagggggcttaaggaagcttttttttttttccctttttctgtcttggatctagattagaaaagatttaaaaagacatacaagcttttccatcttagcttgctcttttgttggcccttttgctggctactggcagaaaaggaggaagctactactgctaaagatgagggtggtgggtctatgacaaggtaaggccctctggaaaggtttttttgtttcgttttgttttttgattttttgagacagggtttctctgtatagccttggctgtcctggaactaattcacgttgtagaccgggctggcctcgaactcagaaatctgcctgcctctgcctcccgagtgctgggattaaaggcatgtgccaccatgcccagcttggaaagttgtttttaggaatgaaaaaacttttggactaggtgaagagggtgggtgaaggtcatggtaaccatgtttttagcttgtgcaggaggagtgctggggctgcctcatgtccttgttcccaagggtaggatggacagggcctcccctagaaatttatcattctacatgaaagtgctgctgttgaggttattttctttttcttttttgttttctttaggggtaattgctttttctgacccaggatggctttgaactggtgacagtcttcctgcctcagttctatcaattaacattctaaatttgtctggatttcaaatcattttgcttaaaagtccaatttcaaatgctttctccttccttgcagtagaacagttctgacttgtacttgctttcctcctgtcagttataggacacttggagataaacacaaacccctctatttcattgggatttccacaaatacatacctacctccctgctgtaggatttccccaaccatacacctgcttgcagcttcttagtatcttagtcccttttatttattgttgttttttgcaaactcaaagataactgtttttagagctagattctttctgcagcactggtcatgcaaagatttttacctactgcatattaccctcctgggcctatggggaggggctaaccccagccttctgagctggaatcttgtcactgtggtgactgcaaattctattcttagctcagtgcaaagtgctggatctgcatgtggcagtgaggtggaggctgtcccttctggtgccactgtagggccaagtaggcactaagcaaagaggtgggtggggactggagaattcagtcagaccctccaaggaaagaattcccataaggaatgagagtggggaagaatgcaagtcattgtaggaaacgtatgtacagcttcatgtagtgaaaagcttgcaggagcaataacagctgctgccaccagctcctgtgccacacctagaccgcagcctcagcaacagctgctaagcgtacacaagagcatccaagtttagtgtccccttgagaggtagaagataaagggagcagaggagtcccccttgcttgtaccttcaacattgtcaatttgaagtttatttggtggcgttatatgtatgttcatagccaaaccttttctgttttttttctgccaggtttgaatggggatgtgaatgttaatggcttatctactgtatctcacactactacttcagggattttgaactctgctccccactcctctagcacctcacacctccatcaccctaacgtggcctacgactgtctttggaactactcacagtacccatctgccaatcctggcaacaacctcaaggacccaccccttctttctcagttccctgggggacaatacccgctcaacggtatccttgggggcaaccgacaaccttcatccccaagtcacaacactaatcttcgagctgggagccaagagttctgggccaatggtacccagagtcccatggggcttaacttcgattcacaggaactgtatgattcttttcctgatcagaattttgaggtgatgcccaatggacccccaagttttttcacctcccctcagacttctccaatgttggggtctagtatccagacctttgcaccttcccaggatgtaagcagtgacatccatcctgatgaagcagcagaaaaggagctgacttcagttgtggcagaaaatggcactggcttggtaggcagcctggagctggaggaagagcagccaggtataactgggtctgtgagctgggagtggagaggggaagtggggttgggggggggtgcacagtagctttttgaagtgaggaaaacttgtctttccagctctctgcagtataggctaatttgcatgttgatgtaagcagagccaaatggctggggttttagtgcagcagcaccagttcaagagtgggaggcaaattatcccaagcttgtcatgcagagctgctggcctggagagggctggtgggtgatgggcaagcctgaagtagccaggcagactccatcagaaatggcttcttgggctaggggtgtatcttagtgggtagcatgcttgtgtagcatgcataaatggggccttggggtccaccataatggcaaatcctgtaatctcagcccttgggaggtggaggtagaaggagtagttcaaggtcaagcccagatacataagacccagtctcaagaaagggtgggacagggttgccctttaaatagatgaaatggctacaacataaacagagcagtgaagccatgaagctatcttagttgaggcaagaataggtgctgcttgaaagagttgcctgaacacctgatccagctacattggaggcatcatcagcttcctccatagtggtgactggcttatgaattcgagaagaaaataatcagagtggatcattgcttatctgttaagctacctccctccccccatcccctccccctctctctttctttctttctttttgtttatattaatatatgacaatcttttatttccctaaagtaaataaaatcttagtctgtagttcatattcagtgtaagggtggctaccctatttaaaaaaaaaaaaaacattttctctgttccagttgttgggaaaactgactagatatatggtagacttcttgtctcaggccttactcttcctctttgcatgatgcataattggttttaggaatatgtctggatacaatctgttcctagcatagagctagaaataaaggttgattgaattgaatgaacatcttatttttaaagcagttagagtttattgagagaatgtttaacagatttgagcaccagtgtggctggaggagggccatttaggacagagcagtccataccatgtacatatgtgagcttcattaaagagttgtctggacacctactgtaacacctaatatagctaaattgaaggtttcagctttgactttccgtctctcctgggattgatgcctagaactaaagatgtgtggctacaatggttctgtctcctctgtggagtctttacaccaagaagtctccgtcctggtccctgatcccacagtgagctgtctagatgatccttcacatcttcctgatcaactggaagacactccaattctcagtgaagactccctggagccctttgactctctggcagcaggtgggctctgcagggggttcccttttgtgctggcctgagccaacctgttacttggaaaagttagaaaaccagggaatgttttaaggaatctggggtattgggcttgttggtgaacctttagtaagccatagtctatgtacactgctgcctgggccaactttactcactttggtccacttcccaggctctttctgtcttctagttggccaagagcccttggctgcaataattcactgaataggctataactaacacacagttggattatttaggttttaactaaatagaaaaatttgccaattaaatataaaaacaaggtctattttatgataaataaatgatgttaggtttctacaaggatctatggggtagatacacagtatctttgccttcattttcacagtctcctgactttgctttaagagggctatatgtttcccctaatttatattaatgtattgcatggtagggtagctgacatagcagagttgtgactttgacatgatcctgaactacatagtgagtttcaagttagtctgaactagagaccctttctttctttgtttttttttcccccaactccccaattcatacactagaaagtagaatatttgggggggccttaggaaaatctgactttctaacttaattcttaatattctgctttttgaattttctttcacccccataagcagagccagtgagtggcagtctttatggtatagatgatgcggagctgatgggtgcagaagacaagttgcctctggagggcaaccctgtgatctctgccctcgattgccctgctctcagtaatgctaatgccttcagtctcctggcagacgacagccagacatcagcctccatctttgtcagccctacctccccacctgtcttaggggagtctgtcttgcaaggtaagtgacgagaggggtaggacatatacatagagttgcaaaaacagtgagagaatgggttccataattaagcccttaaactgggaagtatgaagctgtaccttgctgacagactatgagatggtgtctagtgggaataaaaaggcattgaccatggtactttgccctgtagagaacttgagagacttggaagttgtcaaggaaaaaggccagaggcctttcaagcttcaggagaaggaaagagccagcgctgctttgttaaaacttaattttgggggctggtgagatgactcagtgggtaagagtacccgactgctcttccgaaggtccagagttcaaatcccagcaaccacatggtggacatataataaataaatatttaaaaaagaagaaaaaaaaacttaattttgtttgtatgagtgttcctatgtctgtatatctatgtatcgtgtatgcattggtgtccttggagaccacaagaaggagggtgtctccagctagaccaattgggactggagttccagaaggttgtgagtcacccacttgtgggtgctgacttttctcactaaaagaccttaaaataaccatgtttaccatagtgcaagtttgagtgtttaaattcaattttatttatactgttgtttgcttgtagataacagctttggactgaacagttgcagtgactctgaacaggaagaaatagagacccagtcttcaaacttccaacgtcccctgactgagccagctcctgaccagccacctagtactcaactacatccagcagtttcaccaacagcctccccagcagcctccttgacagcatctgcagaaatctctccagctgtctctccagtagcatcctcgcctgtccctcctgaagtctttgtagcagtctctccagcttcctcacctgctctgccagccatctctttggaagcctctatgacaactccagtaacttctcctcaaggttcccctgaaccttctccagcagctgccttccagactgtctccccagcaaggaaaaatgtcagcagtgctcctaaagcgcgtgctgatcgagaagagacgactggaggagcagttgcagtctctggtagtggtgagtgtccacactctgctcccacctgcctgttctctacagaagcacatgtcacatatggtgcccatccttttgttttttgatacagtgtctcagtatgtagccttgactagcctggaacttgctatgtaaaccaaggtggcttccaattcaaagagatgtgtctgcctctgcctccaagtgctttatcctgtaactttgcttgacttcttatcttgatgtctctggtcttgtcctctaggtgatgtactgaagagacgtattgctaccccagaagaagttcgtcttcccctccagcatgggtaaatgctctagatggctacacacattgacctcaagaagctcacgaatgataggaagagaggagctcctctcttcatcttggtgggagaggactgggctggacaggagtggactacaggacagtatggagggtgcaggactgggcaggacaggagtggactacaggacagtacggagggtgtggaactcctggaagagcagcaaatgctcctaactgcagggttatcgctccagaccagttctctcttcttagggtctgtctctcacattctttgttcatccttggtcttgatcctttttcggactaaggcccaagtatccaaaggagctacatagaactgtttccatagagcgggacagcagttaagggagagaggcttcctaccagtgaactgggtggttctgtggcagtgatttctgttggaatgctctctgtggagttaaggtctaaaacagtaattttggtgaccaacccagctgttgtcagaggcctacattttctaggctacttgatgctaccaagtcttcgtgcaactgcaatatttaagacagaagtaaggctgagttttatactacactgctcagaacatagtcatacgacctcgcctccttagttattccatgatgtcggcctctacgcgcctactcttacacgttgttctgagccagggcagttagtttccagctgctcctttcagtagctttataaaaaggagggtggggaatctttgtacatgtttgccatttagtgcagtgtttcctctgaagtacttgcttcagctcaagcactgtgagcctgtttatcaagcttgtgtgctgtgctgtttctgtatgcaggactgtgtaggactgtctgcatgcagggctagtgagacagctggagggggagtctgctcagtgggcttggctcctgggtggcatgggagtgggtaggggtgtgacctggtggcagggcccatgtgcttctctggcaggtggcgaagagaagtgcgcatcaagaagggcagccatcggtggcagggggagacttggtactatggcccctgtgggaagagaatgaagcaatttccagaagttatcaaggtaatagcaagccttttcttgggtcccaggagaacagggtagcattgtctcctctggggcctgttctgcgtgtgctgttactgccaaagccttggaatgactatgacttactaatgctatttacttttcctctcagtacctgagccgaaatgtggtgcacagtgtccgccgtgagcacttcagcttcagtccccgcatgcctgttggagatttctttgaagaaagagatacaccagaggtgctggcctgaggattaaatagttgggaaaaaattatagcttcctttcgtggagttaggtggctcaaggggtctgggatacttcagagggctttgcaggccactgtcttctcataactcagtgtcgctcttcctttagggcttgcagtgggtccagttatcagcagaggagattccttccagaattcaagcaatcactggcaaacgaggccgacctcgaaacaatgagaaggctaagaacaaggaagttcccaaagtgaagcggggccgaggtcggcctcctaagatcaaaatgcctgagctgttgaataaaacagataaccgacttccaaagaaactggaaacccaaggtacagtgttacttgtagctcagatattgtgctcccttcaggaggtattgctgaattgctgataactgatcttccccggaaggtctgacaaacctaaatccattcttgccccttggaaggcatgagtagaaccccatctctttgtggtttttattttttgttctccaccccccccaaggcattttcttccttttgagttgtgtttactagaaaactaagctgtgggttattctcacatatagtaatggccaaacgagaaggctgccatggtttattttgtctttcagctctttgcatagactgaatttattcatataattcctgtgattttttttattgtagagacttcaaatcacacctgaatcctaaagattgttggagcactattttagtgggatagataaatgggaaaatgtctgattttttaaaataaccctttcttaaaaatgcttgtactatgcagtgtacagaatatgaaatggtctttttaattccattcacacagttttagctctttaatctggttgcatcttttttctcccccatgttggggaccaaccctaggactttgaacattcttctagcaagtcctctacaaatgctaaaaccccaatctcagaatatctcatttttttcaaaaggtttattttatgtatgtaaatgttttgcacataggcaccacgtgggtacctgtgaaggccatatgagggtgtcagaccccctagaactagagttaaagttggttgtgagctgcgagctgaatccaggttctttgcaagagcagtaagagttcttcacagctgagcatctctctagcccctgggtttctctatgtagccctggctgtctcactctgtaggcaggagtaaccttgaactcggatatctgcctgctcctgcctcccaagcattgggattaaaggtgtgtgccaccacaaaatctcttaagtgatttatttgcccatagtattttagaaaatctaaaaatgtatggtgaggctggcgtggtagctcacgcctttaatcccagcactcgggagacagaggcaggcggatttctgagttcgaggccagcctggtctacaaagtgagttccaggacagccagggctacaccagagaaacccctgtctcgaaaacccaaaaaaaaaaaaaaaaaaaaaaggtatggtgatgtttatgtatcagaaatgaaggaataggtactgtcaggtcaaaatgtcagagaactatctgcagatttacactttgattcagatctcccagtacactgatctgtggaagctgagcatgagcactggctctggcagtggtgagcagattgtttggaagagtccattatcttcttagtgcacactaggatgtcagtattataagactgcagtaccctctttccctgacagtgtagattccgggttcttttctcagctctctttgcactaaagtcaggccgtgtgcatcagtccatgcattgctacccttgctgcagagccagggaaagcgacagattataaaggtattctgcagttgtagcttcctttccatcagctggaccatttctaaagccgttgagttgtcgtcagtctgtggctcctgggctggcagtgctgtgtgagcgctgtatacaccgcctcagcagatgcctctcacccatctctcttaatgttttattatgtccactaaaaaaacagccattcaaggagctgcatgagaagccagctttgtcctagacatgtgctgccacgggtgcccagcatggtttctacctgatttctttcaacttccttcttgccttcacagaaatactgagtgaggacgataaagcaaagatgactaaaaacaaaaagaagatgaggcagaaggtccaacggggagaaagtcagactcctgtccaagggcaggtaagggacatcagtgggctgacttttttacaacctgcttcatgttccatttcccacatttccactctcagtatagcagtacacattcactaggtggaattccttaggctagatttagaatggtcttggtcaagagcaatataggcgcctctagagtgagagaatggagccattgccaggtcctcatcgtcccgtctcacctctcctccccagcacccttttctgtttttgaatcccagcccaagcagaggtgctttccaagtcatttgaggagaaatgacttcccttgtggtttacaggccagaaacaagaggaagcaagacaccaagagcttgaagcagaaggacactaagaagaaattgaaggtatgcacacgaatacatgtcccaagtgtaattttattttcccagggtacattatgcatgctagacaagcactcaaccacagagctgagttctgctctcaagtctgtttgtaaagcaccacagaggttctccaagtgcactgtgtcagtgcgacagttagatcttggactcgagtgtgaggtcctaggaccaggcgcggctggacgggtcctcacgcgctgacgtgtgtcttcctctctgggtgggcaggctgagaaagagaagatgaagacaaagcaggaaaagctgaaggaaaaggtaaagcgagaaaagaaagaaaaggtaaaagcgaaggggaaggaagggcccagagccaggccatcctgtagagcagacaagacccttgccacacagaagcggctagaggagcagcagaggcagcaggctatcctggaggagatgaagaagcccacagaggatatgtgtctgtctgaccaccaggtattaagggtcatggaagggccagtgctgaggacatttctcgtgttaccagaaggacttgtgaattctagacagtgcctcttgtgagtctaacaagatacccatgcgcttttctctccccagcccctgcctgacttcacacgcatccctggtttgacactgtccagtagggctttctcagattgcttgaccatcgtggagttccttcacagttttggcaaagtgctaggctttgaccttaccaaagatgttcctagtctaggagtcctgcaggagggactcttatgtcaaggtgacagcttggacaaagtgcaggacctgctggtgcgactgctgaaggctgcactccatgatcctggtctgcccccctactgtcaggtaggtgttcctgggcctgggttacagttttgctctctccttgagaacacgtaaaagcttcccctaaagcaaccacagaagtaagggaaacgtagttgcttcctgtttctagcctttatatgcctttttctttgcaaggcttcatttgttcattttctcttttcttactttgcagtttctctttgtagtctttcacctttttcttttttttttttttttttcgagacagggtttttctgtatagccctggctgtcctggaactcactttgtagaccaggctggcctcgaactcagaaatccgcctgcctctgcctccccagtgctgggactaaaggtgtgcgccaccacacccggcctttcacctttttctagtaactttttcccttaatttttaaattctatttatgtgtagacatgttttgcttgtctgtttgtgtaccacacgtatgcctggtactacactgaccaaaaaatggtgttggatcacctgaaatcaagactcacagacagttgtgagctgtcttacggatgttggcaactcaacccaggtcctatggaaaagcaatcactgctcctaactgctgacccgtctcttcagcccatgtccctgcaactttcattctttttctcctttttccacaaacatttcttagagctggctttggtggtgtacacttttggtctctgggaggtaaaggcaggtgggcctatttgagcctgttccgtatagcaagttccaggccagcccaggctacgtaatgagaccctgtcagaaaagaaggaagggttcaaaatttttttttgttaagatttagttttgttttatgtagacgagtgtttgcctgcatgtacgcatgtgtgtcgtgtgtgtacctggtgcccctgcaggccagaagacaaggctggatccccataactggattgtggatagttgagaacggccttatgggtgttgagaaccagatctgtgtttaaaattatgtttgtttattgtatgtatttgcatgtatgtatgtgttgtggggaatcagttgttcttccatcaagtgggtctgggaattaaaggtatttgtatcagactcaggggcaaattccatgatcatctgagccgtcttgctgacctcatcctttcctcttacagttttaccttaaccctggaactctcccaggctcccccaacttgagttgttcctagttccttctcatttccattgtgcttccttccaaacagtccctgaagatattgggggagaagatgtcagagatcccattgaccagagataatgtgtctgagatactgcgctgcttcctcatggcatatagagtggagccatccttctgtgacagtctgcgtacccagccttttcaggcccagccacctcaacagaaggctgctattctagccttccttgtgcatgagcttaacagctccaccattatcatcaagtgagggcttgggtgggaatggtcaatcctgtgcctgtgtaggggaggggcttagctctccagaagcccctgggtggtgtgggtgttgctcttctctgaggatgctggagtgattgggcatagactcattgtaagccttcctttgtcatccatcctgtttgaactagactgagatccatccctacagctctgtaacacttaatctttcttttctttttgctgccacttttccctcaaaacttcccccatgttcgttcccctgcagtgagattgacaagactctggaaagtgtgtctagctgcaggaagaacaagtggattgttgaaggccgactccggaggtagggacaggacagagtagagcccagagggagggtgaggcatagccagggctctggaaaatgtaaatttcaagtgtttcttttttggtattatattcttcaccagcgtcttagcctaatttctatttcttaagactgaaaactgctctggccaagcgaactgggcggcctgaggttatgatggaaggggcagaagacggcctaggacggaggcgcagttctcggatcatggaggaaaccagtggcatagaagaggaggaagaggaagaaaatacaacagctgtccatggccgcaggggtcgaaaagaaggagaggtacagaccaaagtcaattagaaagttttcatcttttttttggatctggtagctctcctttctcaatgtccgcttgtttctgtgcagattgatgttgcagcatctagcattccagagctagagcgccatatagaaaaactcagtaaggtaccatgtttttaatctcataaaagtcgggaaatgtgggttgcacaagagctgaagcccttgttcaaattatatcagttttgtagggaggttgataggcttcagttctctcatgggtactgaagtccatcatgccatgatggaaatggtttctattccttttccatttcctacccagcgtcagctcttctttagaaaaaagctgcttcactcatcccagatgcttcgggcagtgtccttgggtcaagaccgctatagacgccattactgggtattaccgtatcttgctggtatctttgtggaaggatcggaagggagcacaggtaggtgcaactgtggaagtttggggtgaagtccagacaaaagtgagcacttccttctgcctagtcctcgtgggcttttgactctgtggcgtggtagactaaagagtcaagctactcacctacttctgctgtcacacaccagctataggcttcagtttcttcatctgtagactgtggccatagtgatgtagacatacgtcctaggagagtgagaatggggctagagaggccacagagttaagagcatgcgctgcttttccagaggacctgagttgggctcctagcaccacgtctcacaaccacctgtcacctcaaggatcctgtggcctccacgggcactgcacacacacacacagaatttctttcaaagactacaaaaaattaaaatgttttgtactctttagtgcttaacagaccttagatgtagctccatgccaggtgttaacacaatattctgtggttgatcccagacacagaaaagcaaactttaaaaagcaagcatgttctgtttataggtctcattcttttccattatacaacagtatatcttatgttctttgtttctcttcccagttactgaagatgaaataaagcaagaaactgagtccttgatggaagtagtcacttcaacacccagctctgcccgagcctctgtaaagagagaattaactggctccaatgcctctacttctcctgcccggtcccgaggccgacctcgaaaacctaagcctgggtctctgcagcctcagcaccttcagtccaccattagggaatgtgattcagagcaagcccagactcaagttcacccagaaccccagcctcagcttcaggcccctacccagccccatcttcagccaagtagtgggttcctagagccagaaggttcccctttctctctgggtcagagccagcatgacctcagccagtctgccttcttgtcttggctgagccagactcagagccacaactccctgttgagcagctcagtcctcacgccggacagcagcccagggaaactagactctgctccgtctcagtccttggaggagcccgagcctgatgaggctcagtcctgccctggtcctcaaggtccctggtttaacttctcagcccagataccctgtgatgctgctcctacaccacctcctgcagtctctgaggaccaacctactccctccctccagctgctggcctcctctaaaccagtaagtagccagatcagtctgtacttatcttgccccaggctcccatatctggctgtgaggctgtagcctgaagtaggaaatatgtaaactccttcttgtcttctttgtagatgaatacacccggtgctgccaatccttgttccccagtgcagctctcttccactcacttgcctggagggacccctaagaggctatcaggggactctgaagaaatgtcacagagtcccactgggctggggcaaccaaagcggagggggagaccccctagcaagttcttcaagcaggtggagcagcattacttaacccagctgacagcccagcctatcccccctggtgagcaaacttggctaggatggggcaaacatggaggtaattgcagtttccattgtgggcggtgtgattggagcctggttcccatcccctggcctatatgcataccctctgtacacagagatgtgctcgggctggtggtggatccgagaccctgagacactggatgtcctgctcaaggcactgcatccccgaggcatccgggagaaggcgcttcacaaacatcttagcaagcacaaggactttttgcaggaagtttgtttacagcccttaactggtaagtgagagaccttgacccaacctgacctagagaagctgccatcatttatagaccactctctcttcccagatcccatctttgagcctaatgagctccctgccttggaagaaggcgttatgagctggtcccccaaagagaagacgtacgagacagacctagctgtgctccagtgggtggaggagctggagcagcgggttgtcctctccgatctgcagattcgggtacctggggttggcattggggagggaattgcttagggagggttttggttttggtttggtttatttttatgtattggatgttttgcctgcgtgttgcctgcatgtacatttatatagtatgtactatagtatatagtatgcggtgtcctcagaggctagaagtgtcagatcctctcacattgatcttagagatgattgtgaaccccatgacgtgtgttctgggaattgaacctaggcccctgtctcagccttacaggtgttgggattgcaaacatgagccactacacctggctggggagggtgccaggacaagccttggtgtcttcttcctgagtgacctgccatgacatcatgacatgcagtgtttccctttacaatgcgttctgtttctctttcccactggaagggctggacatgccctaccccagactccaccagagaagacttgacctactgtgagcatctgcctgactccccggaggatatcccttggaggggtcggggcagggaaggaacagtacctcagcggcagaacaacaaccctctggacctcgctgtgatgcgattggctgttctggagcaaaatgtggagcggcggtacttgcgggagcccctctgggcagcccatgaggtggtagtggagaaggccctactgagcacacccaatggtgcccctgatggcacctcaactgagatgtgagtgactcctgctgcctgttccttggcctgggagaggcaagacaaaagcgtattcctcacatgaatcactgctttctctgcagatcctatgagatcacccctcgtgtccgagtttggcggcagacacttgaaaggtgccgtagtgcagcccaagtgtgcttgtgcatgggccagctagaaaggtccatcgcgtgggagaagtctgtcaacaaagtggtaagtctggaaatacttgggagacaaactagtgagagtggggtcgcgatagcagggttaggttaaggactcactctgccttttcacgatggtccagacctgcctggtctgccggaagggcgataatgatgagtttctcctgctgtgtgatgggtgtgaccgaggctgccacatttactgtcatcggcccaagatggaggctgttccagaaggagattggttctgtgctgtctgtctgtcccaggtaaggcttctgctctcccatctccattctcaagcaagactccgagatgtcttcatcttcctttctttaagcaacagtcctcagatgtcctggacggaccctcaggtgctgctcccaggaatgggcctgtgacagcatgtttgggttgagtctgtgtttgaataagccacctacagtctttaagccccagtcatttcctctataaaatagcagttgccatgcattttactgaccctcccattgattgtctgaatgagttcacatgctggcttgtatgtgagcatttgaagccacagtcatgggtaggcaagactgatgagcagagggtgagccgcgccacccacactgctgctcacctgggcctatcctcagcaggtagaggaagagtacactcagaggcctggttttccaaaacgaggtcagaagcggaaaagtagttttccactgaccttcccagaaggtgacagccggcggcggatgttgtcaaggagccgagatagtccagcagtgcctcggtacccagaagacgggctgtctccccccaaaagacggcgacattcgatgagaagtcaccacagtgatctcacattttgcgagtgagttagtggactctaggactaactttctgtctctgtgccagagagactgcaggagtcaatgtgtgctttttgtactaataggattatcctgatggagatggagtcccatgatgcagcctggcctttcctagagcctgtgaaccctcgcttggtgagtggataccgacgtgtcatcaagaaccctatggatttttccaccatgcgagaacgcctgctccgtggagggtaagctgatctctctcttgcttcaccctttctttctctctactcacagtcccatccactctgcccaggtacactagctcagagctgacagctcacagccctgtcttcccctgcccaggtacactagctcagaagagtttgcagctgatgctctgctggtttttgacaactgccagaccttcaatgaggatgactctgaagtgggcaaggctgggcacgtcatgcgacgcttctttgagagccgctgggaggaattttatcagggaaaacaggccaatctgtgaggcaaggaagttgggagtcactttgtggcatcttctccaaccttccaaacaaaaacctgccgttctcacctgctgatggctgccctgggtggactcaagtcagacaatgctgactcttgactctgcccttggcagcacccacatcctcttgttccgaatcccttttctcccttcctcctctggctcctcaaataagagatgcagagatgaggtccttctggatggaaagccaaaaaagaaaaaattttcctgtctctcctcctcctcccccccccccccattaaaatggagagagacaaagaagtcctccttccccttcccagcttcctcccctccctgtccatgcctcagcatcctggggctatttaacaatagcaatagttctagtgaatgtgtgaaactgagaaacactctgtactgtgtgcggacccgcagtgacggccagtaaagtggacttaactcccaagtgtgtcgagccggacaccgggccctgaacatgctgcttccatgttcagtcccctccctgcttctcacttcctctcactcattctgttctaactcctccctatttttaaggttttgtctcacccagtaatgtaaaactatcgtgtacgggttctttaccttccctcccagtctttttcccttatgtggaaaacaaagttgagagctctcctgtctttctgtcctcatcttctgcctcccttctagttaaccctctaaggtgttggctcctcctcacatgctgagtttctgtgagtctctagccttttctgaagctcggtggctggggagcggacaggcaggcagtgccctaggccttccagcctccttcccctgcttcccaaacctccctcttgggaactcctcagggacaactactgctgagtttgagtgctcctccgagatgggggccaggtagcaattgactggcctcagagagaggaggagagagaggtgggtgtgggtgtgtgttttgtgtctgtgtgtgtgcacgtgcacagatgagagttgtgattgtgaccctgtagtgtgatgggactcattgttccccacatgtgtttattcccgccttcccattgtttcacaccatcaaccttttgtctttgggaaaacacaagaacaagggttctctggggacaaggctgtctctcctcatggtcatttcttttccagcctcttcaaactgtgcaatcttttcagcaggaactccctctcccttcactagctttgagtttttgctggtaggggggtagaactggatctttcctaaaccatgagtgtctgggtttagctgtgttttccttccttacaccgacttcatgtcccaggacccctttcttccccagcagcagagaccctggagcacagaatgggcagagaggaggatttgggtctaccactgccctgtgtgtgactgagcccaggttagcccccagcatgagaggacagctgctaactccaagctgtagccatgggccactggcccctgctttcctgctcagccaagcccctcccatcagaaattacgggtacttgcactggggaggtggctgctagctgacctaagcagggagccaaggcatccaagcaatgttccatgggtgggcggaggatgccaggtgaggtgtagcattccttgtactccagcagtactaaagagtggggcagtgcgggttcctgggcagccctgactcctcgacccaccctcaccgcactcccggttgcctgtttctaaagtcgccttttctgtcgatgaacctcaaaacttaattttatttgagaattttttttcttttaaataagaggtggattgaagaatatttgaattgactttatattatgcataaatatttatattttatctaaataactgcgctgtaacaaactttgtgttagtcagatgtttggaactgtttcccctggcataaagtgtactggagtcattcgctactggaggtgcgggaggagggagagtggagcctctgctctgctctgtgctcctctcccagccccacctctgccctcgggaccaggcactcagaaggaggaggtcccagacttgattgtagaaatggggactgaagggattgtgggcaggatgtgatcaaaggggccatttctcacttttctttcctcatcctcactgcccctcaagctaggtggatttttctcttgttgacaaagagtatttggtagggaaagcaggttaaaaataaagacagcccttccctgccctttgtgtccccttcctggtgacagcaagaaaccatcaacaccaacaagtttccacgttccttttacagcaaaagggactttttatataaccaaatgtggtgtcttagtgactttttgataatgtacagttttttgtgaatttaaatttatttctttctatatttttaggaccaatctcatttttaataaggtttaaaaaaaggaaaaaaagtctagagaaaaaaaaataccttgtttttgccatgtgatgttccacaggtgcggctgtagaaaagtgcttgtcattgaataaaaaccacatttgataaaagactcaagattgcatgtttctctcctgaagcataggtcactgtaccttagagaatgagtgtgatgggttgacctgtgctctgggttagtgctctgtgtccgctgtgggggtgggacaggaatagacaaggcaccagcaccctccctacaccatggatgacactagacaggaggcttttgtgttttatttaaaaaagaaaggttcacgtgagcaaaagtaaagctcttccaagtcacaggaaggaaatggaaccagaagtcagccacggagagtgagcgataggtagtgttggcatagacatgggagtatgaaactacaggtttctgggtaaaggggaaatgtacaaaatgcatcttaagtataaattaacttccctccagggtaaggagtgcatctagaagtcatcacccgacccgcccagagggcaggagcagagacgtccattccagctctctcaaactgcacaccaccaccactcaagtccttactctctgcggtcttaagctatgctccaaacctggcatttgactgcacagcatagtccctggcttgtcctacagggactgacccatatggagagttcgctcttgtagggagccaacgtcactggagaagacgatccagaaagagcagttttgggttgtggaactgaggagtttgcatttgttccaaccccacaaagacaagggcagtaaaggatggtgggaggcaagtaggtgcttgtgtgccttgagttgtcagactgaggtagttgagtaatgaggacgagggagtttagggatttgcttggacaggaaatgcttattttgaacattcagagcggtggtcacaagggtgatgagggcatcactgccacatggagaccacctccgggaggtgcagcaaagagtagaggagacaaattggttttagctgctgagggaaggctcctgtagaccctgaatctactactgggatcaaaggcacttttaagaggcaggttacccagaagtagagccaccggcttgctccgaattggtaagaattggtctaacaagcattggttgtatatacctctagactcaccttatcctctgaattcaggtctagaaatggctgggtgagtttgggtctaccacctactcaactgtattgctcttggcgacaaaatgggaggtgcccacttgaccggaagggccagggacaaaaacaaactagtccttccgaaaccctcagcaaataacgcttcacttccaccccattttttattattgagcacttgccctttccaaagccgttttgcttcacaagcttggtccctatcattgttcccacatattcctaagtaatagcaggacctgtctccaaaagtccagtccatctacagtctgacccaatgagatgggataggcctggagcctagtgaagagtcacacgaggtcaggtgtgagctctagtccactctgattgattggaagcaaaaccacaatgtactaaaatgagtacaggtgagatatagagtgcagagccatctatctggcctccatgcaaacaggactcaggagactgttaggagccttgggcaggatgatggagaggaggcttacaactcatccctcatggcttgcatactacttcctgtcttcagtcgctacctttctgagtaatgagctaatgaggaaaagagtggatggaaatcactaagcagaaattacacagtgagtgccattaaccactataaaaacaaaattacaggttgccctcatttcccatgctcacacctgttcaaccagaaacactagaaccctaaccagtatactcaaaagaaaaacctaaaaaggtaatttcaaattttaaaactgtcagttattcaaattgctttagaactacagaaaaaggaacaatttttaataggcagtgaaggagcagcagtggcagcaagactgtcagcagggtttccacaggacagagctctgagtctgtcactgagtgctagagggctagaggtcgataactgggtatgaccttcctgatgttggaagcaccaatgagaaaactggtcattttgtactttatgctgtccattgtcctcagccccttcctcagtctagaacgcacagcagcacagtcaggccaggattcccaattctgtagtgtgcacagctgctgagccagtttctcaccatcaccatgccctgcccttcctctttcacactgacctctggacacacttccccatctccattgctttgtctactggaggtgtacttatgacgtgaagggatgtgatgtaacaagtcacattttgtgctgaaagtcttgcagaagggaatagttaacggcaggcatgtttacaagtccctcctgacctttgagtggccagggagctgtgagtcttgcctttttctatcctagcaccccgtcgtccttccacaagaaggaaaattatttctggtggtctggttccctggggaaggggtccaaacaccagggctgggctgggtatgctgcatagagaaagctcagtccattctcaagcatgcacagtatacacaacagttcttgctttcatcccttcaaactgtgtgcacttggcatgtacatacaaccaagggtgagccctgctaaataagatggctcctgctgaattaagtgattcagccaagtaccacttgagtacagccatgtgcagctggnnnnnnnnnnnnnnnnnnnnnnnnnnnnnnnnnnnnnnnnnnnnnnnnnnnnnnnnnnnnnnncaggaggcaaagtcacagatgtcactgctggccaagtacatgaactaaccaggctccatgtccaaggctggactggggtttagtctacaccaaataactgcccagggaataaggggtggaggagtggggccaggttctgtcaggtgttcaggaccagcacacatgatactccccaggcttggtaatcaaggatgatgatggacaagacagcagcctctcggggacaaaacaacctcctggtaaagtggaaggcagaacttgctcagcaggggcaggggctgtgagacctggggcaggatgaagacccaagaccctccaggaggcagagcaggtatccaggatgctgaagctggatgccacttctcagtggcacttgccaccagagttggttgaaggtggtttccaaaggctgcatggttgtcacatgtctgcttcctgaagtcaaagtctaacccctcctaggccaggagggcagagggaaagcaacctctactgccacacttctctacctgtgcgttgctctcccttcccccaattccacatgaaatttaaatcaaattcataaaattaaaaattgtaaaaaggcaaagtaggcaggctaagctaaatggaaaagaaaaaaagaccattgtggagaagttttaaaaaacaactagccgggcggtggtggcgcacgcctttaatcccagcacttgggaggcagaggcaggtggatttctaagttcgaggctagcttggtctacaaagtgagcgccaggacagccagggctacacagagaaaccctgtcttgaaaaaaaaaaaaccaaaaaaaaaaaaacaactagctaggcatggcggtgcactcagacagagtgggaaggatcgctgagttcaaagccagcctggtctacattgtcagccagccaggactgcactgtgagaccctgccttaaacagtgcgtgggagggaggtgggtgggtgtgtgcaaagtgtgtgttgagagctttgcaaaacaaaagttttaagcctgcatatctaaaacacacattgaaaatagtccctaactgaacctggcaagcagcgccccttcactgacttcacagcactgcgattgttcttaaaccattttaaaagcccaacatacccaaacctctcgaagatgagaagcacctcaactggtgtctttggggtaggagaaaggttcgctgcaattaaatacaaagcaagaaacttcttttgcaaaagaaaaaaaagtctttttgatcttgaatgtagcacattcaaaaaaaaaaaccaacgtgattcctcaggttccatcagccacaggaaggagcccaaggaggactgcataggcttctctccccaggtctggacctgtgagggaatgacagccaggtgttagtgctcagcaggctacagctaggcttgtaacttgctaaaccttctggagtctgtgagcatctccaagagttcctttctgtttaacaaagatggggggaaagaatcctaaaggaggcattagctggagacgatacgaagaggacacgactattaattaacctgtctggctattggcagaacaaagctgcaagcaccatcttccagttcagcatagcatagcagcattccccaccataaagttcttacctcattatttgctgaactggaaaggatagaccccgtggtctgaggggggctccactgccagttgattctgctggccattgctctcctgtatcacagccaaggaaagttactgaagcattcctacacgcacctcccactaaagcctccccaattcagccacacacacacacaccgcccccaacgcatgtgtgcatccaacatccagactgccagaaagcgggcaaagtggtccagctaccttggaaaatacttcagcatttgctcattttcagagtattgaggcagctgaagtcagcatccctgtctaaattgaacagagcaggctggctaaacaccaatgaagccgcctcctgctctcctcacaaccaccagtgaggatgccggcggtaggcagtaccgagagaggagtacacagttcagagatctgcccttgatgtgtcctggcctcactgcaaaacaaaacaaaacgaaccgaaaaagctcctacctcagcagaaacactggaagaaggcacagctgggtactgggagatgtaagccccatgcatagcagcagctgccggcatgaactacaaaaacaaaaacaatggttctcagctagtttaaagccctcaggagcttcagaaaacacagagacctttattgttgtgggtgcttctttaaaatgtccctggagtgcccgaggatgccagctagagacacgttgatgtccctccctcactgcgttccctctcttcctccacaccctcaactcactgccaccagctctcctgcaccagtcagacctaaaagagccttgagcttcatcccttccctttcagtgttctgatgagctcttctaggagatatgcactggcgcctaagcaaattcacaaatgtttaaaccacatttagttccgtgactgggaagcaggtaagaggtaggcaggaaggtatatccccagcttactgattcttttctgtttatcaatggccttgaacttttttttaagatttattattttattttatttatatgagtacattgtagctgtcttcagatacaccagaagaaggcatctgatccccattacagataggttgtgagcaaccatgtggttgctgggaattgaactccaaacctctggaagagttgtcagtgctcttaaccacggagccatctctccagcctggcctggaacttttaagtcttcctgactcagcctcctgagtataaggattagaagcatttactgcagttctgagcctgcctttgctgaccctgacacacttgcgtcctgcgtaaccacaggtaccaaggagcatttcctaggcacttcttattctgcagggttaataaccacagacaatcctttaccgtgcccagactgttgagtgacaggtgacccagttgctgggtaagaggtcccatcatggaggcaggctggagagagagggggtggtccatccctggtgtcagaactgagccctagagaaggcaatgaagggaagggttaagcagcaccctcctgtaaagacacctgagtggcaaggatgccaagcagggccaccagtgttttgtttttgttttgcttgtttgtgtctcttgacaggtttaaccctggctgtcccagaactcactctgtagaccactctggccttgaactcgcagatccacctgctgctgccttccaagtgctgggattaaaggcctgtgtctctacacccagactttgatttgctttttaagaacagtttaagtgcactagaatcaggaagcaaactattcgggaactagagtaccgtctgctgacatttccaagtcctgagaattaacccgagttctacaacaggaacaacagcatcctcacctttagtctgcagggacctacgtctaagactaacaaacccacagaattaaggttactgttggtgcgcctactgcctgagccagagctcacacccacacatcctgccatcaaaaccctttgctttgctttacatcagattgtctctttcccttctgaacactcactgaaggctgcgtgaagtacaactggtattgcatccaagatgggttaggtacttgtagaggagatgtctgagtcactctctaacataagcaaagacaaataaaaatgttaactgcctaggctcaaggaatgagactgttcagcaaagccccccgcaaactgacatgtcccttcagagcacaaaccgcttagccagactgtggtggcacacatctttaatcccagcactcagaaggcaagaggcaggcagatctgtcaatctgaagctagcctggtctacaaagagagttccagatttgccagggctacatagtgagaccctgtctcaaaaactttaaaagagcacactgttaacaaatactagcagcttataactcagataacgcagttaaaaacaggcaaaggggtagatgaaatatctcagcaggtagaggcacttgctaccaaatctaaagacctgaattagatccccaaaacccacgaggtaaatggagagaaccttccataaattgccttctgacctttacacacatacacacatatgcacgcgcgagcacacacacacacacacagcagctaagaccatgttctgctctcccagaagaaacactcatacagataaagtaaaaggactgcttaaaagatgttgtgagaataacaaaatatattaaatgagattacttttttgtttgtttgttttgttttgtttttgtttttcgaaacagggtttctctgtatagccctggctgtcctggaactcactttgtagaccaggctggccttgaactcagaaatctacctgcctctgtctcccaagtgctgggattaaaggtgtgtgccaccatgcccggctataaagtgacatttttannnnnnnnnnnnnnnnnnnnccctgtctcaaaaaacaaaaacaaaaacaaaaccaaaaaacatttttatcaaaacgattcccaaggccccaatatttgagtatctactcacatgaaagtgatctacaatgagggtaaaaagagaagcaggatgatgtggggttttttgtttttttgtttttaaagatttatttatttatttatttatttaatgtaagtacactgtagctgtcttcagacactccagaagcgggagtcagatctcgtgttacggatggttgtggatggttgtgagccaccatgtggttgctgggatttgaactctggacctttggaagagcagtcgggtgctcttacccactgagccatctcaccagcccgatgtgggttttttaaaacagggtctctcttatatagccttggttgtcctggagcttgctatgtagcccaggc

SEQ ID NO: 662 - DNA, 5102 bp, Mus musculus
agcagttcaggctgtgtcgttcgcaggaagcatacattggcttttttggggtttgcgagttcccagcccatagttggacaggatccaacagtagccttcaattgaagcaagacccaaggacagtgagaatctgggtcctaatcctgagtcctgccagcctgacatggaaatggaggcaaacgaccattttaactttactggccttcctcctgcaccagctgcctcaggactgaaaccctctccttcctcgggggagggcctctacactaacgggtctcccatgaacttcccccagcaagggaaaagtttgaatggggatgtgaatgttaatggcttatctactgtatctcacactactacttcagggattttgaactctgctccccactcctctagcacctcacacctccatcaccctaacgtggcctacgactgtctttggaactactcacagtacccatctgccaatcctggcaacaacctcaaggacccaccccttctttctcagttccctgggggacaatacccgctcaacggtatccttgggggcaaccgacaaccttcatccccaagtcacaacactaatcttcgagctgggagccaagagttctgggccaatggtacccagagtcccatggggcttaacttcgattcacaggaactgtatgattcttttcctgatcagaattttgaggtgatgcccaatggacccccaagttttttcacctcccctcagacttctccaatgttggggtctagtatccagacctttgcaccttcccaggatgtaagcagtgacatccatcctgatgaagcagcagaaaaggagctgacttcagttgtggcagaaaatggcactggcttggtaggcagcctggagctggaggaagagcagccagaactaaagatgtgtggctacaatggttctgtctcctctgtggagtctttacaccaagaagtctccgtcctggtccctgatcccacagtgagctgtctagatgatccttcacatcttcctgatcaactggaagacactccaattctcagtgaagactccctggagccctttgactctctggcagcagcagagccagtgagtggcagtctttatggtatagatgatgcggagctgatgggtgcagaagacaagttgcctctggagggcaaccctgtgatctctgccctcgattgccctgctctcagtaatgctaatgccttcagtctcctggcagacgacagccagacatcagcctccatctttgtcagccctacctccccacctgtcttaggggagtctgtcttgcaaggttcccctgaaccttctccagcagctgccttccagactgtctccccagcaaggaaaaatgtcagcagtgctcctaaagcgcgtgctgatcgagaagagacgactggaggagcagttgcagtctctggtagtggtgatgtactgaagagacgtattgctaccccagaagaagttcgtcttcccctccagcatgggtggcgaagagaagtgcgcatcaagaagggcagccatcggtggcagggggagacttggtactatggcccctgtgggaagagaatgaagcaatttccagaagttatcaagtacctgagccgaaatgtggtgcacagtgtccgccgtgagcacttcagcttcagtccccgcatgcctgttggagatttctttgaagaaagagatacaccagagggcttgcagtgggtccagttatcagcagaggagattccttccagaattcaagcaatcactggcaaacgaggccgacctcgaaacaatgagaaggctaagaacaaggaagttcccaaagtgaagcggggccgaggtcggcctcctaagatcaaaatgcctgagctgttgaataaaacagataaccgacttccaaagaaactggaaacccaagaaatactgagtgaggacgataaagcaaagatgactaaaaacaaaaagaagatgaggcagaaggtccaacggggagaaagtcagactcctgtccaagggcaggccagaaacaagaggaagcaagacaccaagagcttgaagcagaaggacactaagaagaaattgaagaagcggctagaggagcagcagaggcagcaggctatcctggaggagatgaagaagcccacagaggatatgtgtctgtctgaccaccagcccctgcctgacttcacacgcatccctggtttgacactgtccagtagggctttctcagattgcttgaccatcgtggagttccttcacagttttggcaaagtgctaggctttgaccttaccaaagatgttcctagtctaggagtcctgcaggagggactcttatgtcaaggtgacagcttggacaaagtgcaggacctgctggtgcgactgctgaaggctgcactccatgatcctggtctgcccccctactgtcagtccctgaagatattgggggagaagatgtcagagatcccattgaccagagataatgtgtctgagatactgcgctgcttcctcatggcatatagagtggagccatccttctgtgacagtctgcgtacccagccttttcaggcccagccacctcaacagaaggctgctattctagccttccttgtgcatgagcttaacagctccaccattatcatcaatgagattgacaagactctggaaagtgtgtctagctgcaggaagaacaagtggattgttgaaggccgactccggagactgaaaactgctctggccaagcgaactgggcggcctgaggttatgatggaaggggcagaagacggcctaggacggaggcgcagttctcggatcatggaggaaaccagtggcatagaagaggaggaagaggaagaaaatacaacagctgtccatggccgcaggggtcgaaaagaaggagagattgatgttgcagcatctagcattccagagctagagcgccatatagaaaaactcagtaagcgtcagctcttctttagaaaaaagctgcttcactcatcccagatgcttcgggcagtgtccttgggtcaagaccgctatagacgccattactgggtattaccgtatcttgctggtatctttgtggaaggatcggaagggagcacaggtccctggtttaacttctcagcccagataccctgtgatgctgctcctacaccacctcctgcagtctctgaggaccaacctactccctccctccagctgctggcctcctctaaaccaatgaatacacccggtgctgccaatccttgttccccagtgcagctctcttccactcacttgcctggagggacccctaagaggctatcaggggactctgaagaaatgtcacagagtcccactgggctggggcaaccaaagcggagggggagaccccctagcaagttcttcaagcaggtggagcagcattacttaacccagctgacagcccagcctatcccccctgagatgtgctcgggctggtggtggatccgagaccctgagacactggatgtcctgctcaaggcactgcatccccgaggcatccgggagaaggcgcttcacaaacatcttagcaagcacaaggactttttgcaggaagtttgtttacagcccttaactgatcccatctttgagcctaatgagctccctgccttggaagaaggcgttatgagctggtcccccaaagagaagacgtacgagacagacctagctgtgctccagtgggtggaggagctggagcagcgggttgtcctctccgatctgcagattcggggctggacatgccctaccccagactccaccagagaagacttgacctactgtgagcatctgcctgactccccggaggatatcccttggaggggtcggggcagggaaggaacagtacctcagcggcagaacaacaaccctctggacctcgctgtgatgcgattggctgttctggagcaaaatgtggagcggcggtacttgcgggagcccctctgggcagcccatgaggtggtagtggagaaggccctactgagcacacccaatggtgcccctgatggcacctcaactgagatatcctatgagatcacccctcgtgtccgagtttggcggcagacacttgaaaggtgccgtagtgcagcccaagtgtgcttgtgcatgggccagctagaaaggtccatcgcgtgggagaagtctgtcaacaaagtgacctgcctggtctgccggaagggcgataatgatgagtttctcctgctgtgtgatgggtgtgaccgaggctgccacatttactgtcatcggcccaagatggaggctgttccagaaggagattggttctgtgctgtctgtctgtcccaggtagaggaagagtacactcagaggcctggttttccaaaacgaggtcagaagcggaaaagtagttttccactgaccttcccagaaggtgacagccggcggcggatgttgtcaaggagccgagatagtccagcagtgcctcggtacccagaagacgggctgtctccccccaaaagacggcgacattcgatgagaagtcaccacagtgatctcacattttgcgagattatcctgatggagatggagtcccatgatgcagcctggcctttcctagagcctgtgaaccctcgcttggtgagtggataccgacgtgtcatcaagaaccctatggatttttccaccatgcgagaacgcctgctccgtggagggtacactagctcagaagagtttgcagctgatgctctgctggtttttgacaactgccagaccttcaatgaggatgactctgaagtgggcaaggctgggcacgtcatgcgacgcttctttgagagccgctgggaggaattttatcagggaaaacaggccaatctgtgaggcaaggaagttgggagtcactttgtggcatcttctccaaccttccaaacaaaaacctgccgttctcacctgctgatggctgccctgggtggactcaagtcagacaatgctgactcttgactctgcccttggcagcacccacatcctcttgttccgaatcccttttctcccttcctcctctggctcctcaaataagagatgcagagatgaggtccttctggatggaaagccaaaaaagaaaaaattt

SEQ ID NO: 663 - protein, 1586 aa, Mus musculus
PSIEARPKDSENLGPNPESCQPDMEMEANDHFNFTGLPPAPAASGLKPSPSSGEGLYTNGSPMNFPQQGKSLNGDVNVNGLSTVSHTTTSGILNSAPHSSSTSHLHHPNVAYDCLWNYSQYPSANPGNNLKDPPLLSQFPGGQYPLNGILGGNRQPSSPSHNTNLRAGSQEFWANGTQSPMGLNFDSQELYDSFPDQNFEVMPNGPPSFFTSPQTSPMLGSSIQTFAPSQDVSSDIHPDEAAEKELTSVVAENGTGLVGSLELEEEQPELKMCGYNGSVSSVESLHQEVSVLVPDPTVSCLDDPSHLPDQLEDTPILSEDSLEPFDSLAAAEPVSGSLYGIDDAELMGAEDKLPLEGNPVISALDCPALSNANAFSLLADDSQTSASIFVSPTSPPVLGESVLQGSPEPSPAAAFQTVSPARKNVSSAPKARADREETTGGAVAVSGSGDVLKRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNNEKAKNKEVPKVKRGRGRPPKIKMPELLNKTDNRLPKKLETQEILSEDDKAKMTKNKKKMRQKVQRGESQTPVQGQARNKRKQDTKSLKQKDTKKKLKKRLEEQQRQQAILEEMKKPTEDMCLSDHQPLPDFTRIPGLTLSSRAFSDCLTIVEFLHSFGKVLGFDLTKDVPSLGVLQEGLLCQGDSLDKVQDLLVRLLKAALHDPGLPPYCQSLKILGEKMSEIPLTRDNVSEILRCFLMAYRVEPSFCDSLRTQPFQAQPPQQKAAILAFLVHELNSSTIIINEIDKTLESVSSCRKNKWIVEGRLRRLKTALAKRTGRPEVMMEGAEDGLGRRRSSRIMEETSGIEEEEEEENTTAVHGRRGRKEGEIDVAASSIPELERHIEKLSKRQLFFRKKLLHSSQMLRAVSLGQDRYRRHYWVLPYLAGIFVEGSEGSTGPWFNFSAQIPCDAAPTPPPAVSEDQPTPSLQLLASSKPMNTPGAANPCSPVQLSSTHLPGGTPKRLSGDSEEMSQSPTGLGQPKRRGRPPSKFFKQVEQHYLTQLTAQPIPPEMCSGWWWIRDPETLDVLLKALHPRGIREKALHKHLSKHKDFLQEVCLQPLTDPIFEPNELPALEEGVMSWSPKEKTYETDLAVLQWVEELEQRVVLSDLQIRGWTCPTPDSTREDLTYCEHLPDSPEDIPWRGRGREGTVPQRQNNNPLDLAVMRLAVLEQNVERRYLREPLWAAHEVVVEKALLSTPNGAPDGTSTEISYEITPRVRVWRQTLERCRSAAQVCLCMGQLERSIAWEKSVNKVTCLVCRKGDNDEFLLLCDGCDRGCHIYCHRPKMEAVPEGDWFCAVCLSQVEEEYTQRPGFPKRGQKRKSSFPLTFPEGDSRRRMLSRSRDSPAVPRYPEDGLSPPKRRRHSMRSHHSDLTFCEIILMEMESHDAAWPFLEPVNPRLVSGYRRVIKNPMDFSTMRERLLRGGYTSSEEFAADALLVFDNCQTFNEDDSEVGKAGHVMRRFFESRWEEFYQGKQANL

SEQ ID NO: 664 - DNA, 59856 bp, Homo sapiens
ccgcccctatggctgtcacctagatcaaggacctatctaaggagaaagcccaaggacaggcaaagacaggccacgcactttcaacaggaactcggcccctttcctaaacgtagttcctctgattaccctgtccaacggacgtcgctatgatccaattaagttttgaggctcagagtgacgccctctaacctcacactgtccaataaaaaaaggagtttcagattagcaccagttttgaccaatggatgagaagatcagcgtgtattaacctgtagaagcagcacagagaatgatgagcagccagttcacccaatggacctgcctactgcagcgtaggcctcgcctcaacggcaggagagcaggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctggtaagtgcttttctctaggagctaacgttccattttgccgccccatgaccttgagccggggaacgatggtagctcgggcctaagggatccgtggtgttaaaaggatgcctggagccgcgtcttgctctctaatggctggagaacaagaatgggacacccataggaggtttcttcgacccagctctgtcccattttgtataaagtcctttgtgtgacggaaaaggtgcgggcaggtgcgttgaccttccggttgaataggggtactgaactctcgaaaaatggggtcttgtgcatgcggatgggaaggctgtgcaggcgctttatcgatcgctgcgcggccttccctcttggacacgcgttccgtacaagcggaaagaggcctgacttcggctgagttttcctctccttgtgtgttaagtcctggcttccgatgacctttaactggcctgaccccagctccttccaatatcttttgtctgttagtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatccccaaaaccaagctgtctgccttctatgatgattttatcaaaatgactttcgttcttctgagtttgctgaagccacatttaggtactgagaaggagtcttggtcgatttaggtcttgataccaatttatccttatgtataaccctgcgatgcctgtatctaacaggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacagtaagttgctcttattgcatctatgcacaaaggaacttctgttatttgcagttttacacattaaggtgacatgttctcctaaagcagaatttttcttctgatacgttcgattattaaaatcacacagtgcagtttcacctgaagaaattaggatgcagaatttctgattgacaaaagcctactacttgaggtttttttttttgagagggagtttcgctctcgactcactgcaacctccacctcctgggttcaagtgattctcctgtctcagcctcctgagtagctgggattacaggtgcatgccatcatgcccggctaatttttgtatttttagtacagatggggtttcaccatgttggccaggctggtctcgaactcctgattttgggtgattccccccccacctcggccccccaaagtgctgggataacaggcatgagccactgcgcctggctagttgagtatttttaagactcggtcttatggcttaggtttaggagtctccaaaacttgtaggtttttgtatttgctattgctatgtgagggaatgctgttaggttaaggctcagtaaaatgaaaaatttatgacagttaaagtcagggaatgggattattgtttcctaagataataattttctttattgcagaaagttgggttagatcctagatgatagtttatctgatttatgtaagaaaggggaggtaagactgtggttcctcaggtaaagggatggacttgagagttgatagggagggatatataagattatcatttgctttcaacaaggtgaatagatactatcctctcttctacctttacagatttgctcccattcatgctgaggctccagagttcatggaaatgagtgttgagcaggaaattctggtgactggtatcaaggttgtcgatctgctagctccctatgccaagggtggcaaaattggtatgttattaaggggtacatattttccaaacctaatatgggaggaaaaactcatacaatgttatgagtggatattgacatctattcctcactgatgagtacgttctgactttcgttcttctgagtttgctgaagccagatgcaatttctgagaaggaataggatggaaggaagcaattactttttttgaagtttgcttatttaggaaagcagaactcttaaatattctttcttttcaacctcttatagggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgacattaaataacatttccaggttttctttttggtagatagtcccatcatttgaaagctaattttgggagggctggattggacgtggtacatatgtttcagttaagcctattttgtacttttcacttaacttgaataggtttttatttcctttctactatagttttgccttactaatataagaagctgtcttttttttttgaactgcatctctaatagggaaaagaaacttgcacacaaaaacgctgacaccttctgagaaaggatctgtggtcgtttctccgatttgggaaccttcagtatgtggcttctctactcctttgtcaggttttacgattatgtatgattactgcaggtagcgctggtatatggtcaaatgaatgaaccacctggtgctcgtgcccgggtagctctgactgggctgactgtggctgaatacttcagagaccaagaaggtcaagatgtactgctatttattgataacatctttcgcttcacccaggctggttcagaggtaagagggaaggcttgagaggacctggttcatctggcctttcttcggatgaggctaaggatgtagacacctaagacctttttttcttttaggtgtctgcattattgggccgaatcccttctgctgtgggctatcagcctaccctggccactgacatgggtactatgcaggaaagaattaccactaccaagaagggatctatcacctctgtacaggtaagaaaaattacatagatgaagatctgatttgtataaaggcagggtgcagtggtgcatctcagctactgaggaggctgaggcaggaagattgcttgagcccaagagatcagcctggggaacaaagctgtatgtatgtagagagatgtataaaactgactgggccaggcgtggtggttcatgcctgtaataccaacactttgggaggctgaggtacgcggatcatgaggtcaggagttaagacaccaccctggccaacgtggtgaaatcccgtctctactaaagatacaaaaaattagctgggcgttgtggcaggcgcctgtaatcccaactactcagaggctgaggcaggagaatcgcttgaatccgggaggcagaggttgcaatgagccaagattggggcactgcactccagcctgggtgacagagtcagactctgcctcaaaaaattaaaaaaaaataaatgaaggtatacatttaaatgtagatcacaaagcaatggtttctagtctgaggggagtccggcgctatatggaaactgagcattaaatatttactgtattagggctgagtgcagtggctcacacttgtaattccagcactttggggccgggcacggtggctcacgcctgtaatcccagcactttgggaggccaaggcaggcggatcatgaggtcaggagatcaagaccatcctgacttaacacagtgaaaccccatctctactaaaaatacaaaaaattagctgggcgtggtggcacctgtctgtagttccagctactcgggaggctgaggcaggagaattgcttgaacctgggaggcggaggttgcaggaggttgtggtgagctgagattgggccactcactccagcctgggcggcagagtgataatccgtctacaaaaaaaaaaaatttactgcattaatgtactatacattttcaaatatatatagatgggatatatagtaaaattacataaattttacatatagtaaaaatgtggctaaactgtaggaacttttcatgattcagtgtaatgaactattgtgcaagaagttttttgttcttgtttttaattcttttttttttttttttgagacggagtttcactcttattgcccaggctggagtgcaatgggtgcgatctgggctcactgcaacctcctcctgggttcaggtgattcctttgtctcagcctcctgagtagctgggattataggtgcccgacaccaggcccggttaatttttgtatttttagtagagacggggtttcaccatgttagtcaggctggtcttgaactcctgacctcaggtgatctgcctgactcagcctcccaaagtgttgggattataggcttgagccactgtgcccagcctcttttttatttttttattttttttaatttttatttttttgagacggagtctgttgcctaggctacagtgtggtagcacagtcttggctcactataacctccacctcctgggttcaagcgattcacctgcttcagcctcctgcatagctgggattacaggcatgcatcaccatgcctggctaatttttgtttccgtttttttttttttttttagtagagacccccgtctctactggtgtcgaactcctgacctcgtgatctgccctccttggcctcccaaagtgctgggattataggcatgagccaccgtgcctggcccccagcctcttgtttttaattctaaaagtgggcattaaaatagttaaaataaaagatgaagaacaaaaagaatgatactaaaaattcttccatcatggctgagagaccagataatctgtcagcttattcagcaggtattaggggtggtaagaagggtcttttgagtgctaagaatatggagtgagatgataaagataggtcagaaagggggatggcttaagtaaaattactttggttcgctgggcgtggtggctcacgcctataatcccaacactttgggaggccaaggcgggtggatcacgaggtcaggagttcaagaccagcctggccaagatagtgaaaccccgtctctactaaaaatacaaaaaaattagccgggtgtggtgatgggcacctgtagtcctagccactcgggaagctgagacagagaattgcttgaatccaggaggcagaggttgcagtgagccgagattgcaccactgcactccagcctgggcgacagagcgagaccctctcaaaaaaaaaaaaaaaaatttactttggttcctgttcttcatgggatctcactttaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggtgagtatattactatgtgggatcagtgtccggaaagtcaaaaagagggcctgtggggactatatgaggactggatctttcttagtgatttgttttggagcaaggaaagttgaggctggcaattgctagtgagagctaatgaggtctcttgagtttccaggtacttaacgctttggaatgcaatatttttctttctttttttttttttttgagatgagtctcactgtgtctcccaagctggagtgcagtggtgccatctcggctcactgcaacctccgcctcccaggttcaagcgattctcctgcctcagcctcctgagtacctgggattacaggtgcgcgccaccatgcctggctactttttgtatttttagtagagaccaggtttcatcagttggtcaggctggtctcgatctcctgacctcatgatccacccaccgtggcctcccaaagtggtgggattacagacgtgagccactgcgcccggcggaatgcaatatttttctaacagcaccaaactaggactatggagaacaagacactgatctttcttggctgagggccctcataacaccaccaccttctctgccccctagcatgtaactttccctttgttagcttgtccaaattaaaggaatgagaatacttaactcagtcttcttttttctcataggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgagattttgagtacaaatcttgaatgtttactgtgctgtggtcccattccaacaaccgtcaagcaatatatgtaatatactatgcttaattatattttttaatttaaaaaacaaacttacccattgattttgtttgaaaatactctacatttaatttgagtgtgatttgttacttgattctctagctcccttttattttatatgtattttttgagactgagtctctgtcgcccaggctggagtacactggtgcaatcttggctcactgcaacctccacctgccgggttcaagtgattctccagcctcaaccatccaagtagctgggattacaggcacacgccaccacgcctggctaatttttgtatttttagtagccatggggtttcaccatgttggctgggcttgtctcgaactcctgaccttaggtgatccgcctgccttggcctcccaaagtgctgggattacaggtgtaagccaccgtgcctggcccatgtgttcttaattcatactgtatcatatcttgtaaatttgatttgtgagggaaatttaagctttctaagatgacatgaattcatcacattctaactgatggcctgaagtggtgaggaatgttacatgatgcagaaagttgatatccctccgcttcttactctttttttttttctcccccatcatacaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaatttgtctgattctcttggttctgacaacatagtcaacactgaagggttatgtatttaattttagttttagagacacggtgtctggctgtgttgccaagactggtctctaactcctgggctcgagatctcccacctcagtctcctgagtagctggggctacaggtgtatgtagtctcacatcaccagcactgttttcaacaattagatttttagagtggctataagaagcagtttcagcatgaagtgggccatgtatgtttgaaattggtccttaaaaatagccattctcttttgttgatggacaaccgtacctcttgtgaggggtttcctgtgggtagtgtgatcttagtagggcctcagttttgggccttttgttcaatacaaattgatttttttttttttttggcctctattccatgtggcacatccctacttcttggttaaaaataggacttttttgaagggcatattgggaaaaactcgttttagaaataacttatttccaggggttaatctgagtttaatgaattaaattttcaagaaatagtgatgaagaatactgatctttgttaaaatggaatcaaaagggttctctacatcttggttaggccttcatgtcttcagaaagtgtacttaactacttcctgacattttgggcaagcctaaataaaagttgcttgtgattccttgaggctatgcagaggcatataataccataaggcctagtccaccctctgtgaagatccccttatgaaagtccagaaaagataatcttacaagggaatagcaattttcagagttgctggcttgggcttctaaactaatgaagttaggttattttcccttcattttagccgactgagaggtgcaggggtagaagatatattttaccatttcaatttaaaagaagcgtgcaaggtcagattgggttcctcttgtgttcttttccgggaccagacccatccgactgccctctcgcggtagcactggagactctgcaagaactctgatcccattttcaaatccatgaaggccatttgctgggatgtggctctcagttaaagactgtttacagaccagctggggcttttgtcctggggaggagcctgtatctataagctccacccgctgagtccatcaagttaggtagaagctgggcggggacaagctgagctccaattcagaggcccctgggggctgaaggttggggagggctttttggcgcggggccaggggtggagtaggggcctctaagcttccttccatctgcctgtgacgtccttggcagcagcctctcccgcagtctctcctgtgtcatgatctggacagaaggtggagcccctgagctgcttgtgctggtagtttgctcccagaaaagctgggatttggggaaatgctgagttatgggggtgtggacacttcctctaggtcctgactctggagtgggtaagaagctggtagaaaaagccctagggtacaggtcagccctttctgctttgttttctcacgtcacccgatacagacctgggaactgaaatcctaaaggtcttttgcatccctccaccccttcccccaacatgttcacgtccttcagcgtttatcgagaaccttctccctctcagtagctgcaactatttgtttccttccccctttgccggcctcttctaccatgccactggagtgtcaacacagctctctaaccttcctccatatttctcctggtctgccctgtcctcgcctcctccctctctccacccagagaaagccccgcccttccctcctccctccccaccccagtctgtcacacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatgggtgagtatggggaccagccccggggaaggcctgagggatgcctactccctccctggctgactcagcaggggtggggcctaacctttgctcatttgggggctgaaggagaggaaacaggactctgggggacggggggcacagggctcagctagcgaggctgccgaccacgggatcctgagtatgggcaagccccagttctaaggaagagcctgagacgcatcttaggccagggctttcccagccccctccccgccgccccgtggaggattgcccctgctcctccccatttaagctgttgagattcaaggaaattttgacagtactcactgctagcccccacaaaagtaaagccggcttttggcagtgctggaaggtctttaaaatgcctcccctccctctcatttttctaaggccttttaagtctgtcttctctcctcccccaccttgacccaccttcaggtgggggctgcactgagcagctgcttcctgttgccccagagactgaagcaagggtggtggtggttgggggaaaactgaaccaaagtcgattctcatggtcccacatcagcctcaccagggctgctattgatggcccccacactacagtcactgagggcactgagtgggacgcaggattgaggttgagaggataggaggtttttgccttcgtggcttcctgattccaaaggccccacagccgtagggatggagccctgaggagctgaaacacggggaaccagttcacctagtagggcgctgcgcgtgacccccagcaggctcggccttgagttccctctcctgcacccctaggcctcctaggagcccatgtagctctttctgccttccccggcctcttttgtgaagcggtctttgctggtgccctgggagcgcgggcagagctctcccaagtccttcctttcggacctaccaccatcccccacttcaccgcagaagtttctgtctctttctgggatccgttctcttcctcccatctgggatccttcctggttctggcccctaggagacgccacccgctatcctctcccccagtggatccttcgcgactgctctcctgagcggttgtcctcacctcggtagttcctgcccctttaagcaccacctcctcccctccgccgccgccggcccagggctgggggaggaggcgcagccgccgcccggctcggccacctgcgcctctgccgccgccgccgccgcctgcggcccggccctgctccaggtgaggcccggcacccacctccagctccggagtcccttggcgggccgttcctgcggtatcctgccccgggatccctgctgccccgggattcgggatctgactctccccctgagggagctgcccttcctctctcccctgaactatctactcgcccattttccccctgtcctccgcgaccggaatccggaggcttctcacgcctctccgccatcgtctcccgagtacctttcctattctgggcccaggatctccccctcccccgcgccttcttcgccagaaaaatctcccgcggtctgggtttcgcctcctcccctctgaactagcgctttcccacgccttcctaaccccaatgggaggggggatacccaccccaactcctctccttccccgtagtaaggggggcgggggagcaacatcgacagcactatctgtccctgctccgctcagccctttaagttcagctaagtcccatctaaaccttttctgtagtcctcaccccaccctacatctccgggagcttggggtccaacctcagcaccgcctactgagcccaggtgggaaggactctcctcctgggcctagggttggtcggtgcagcctaggaaggcccctcccccagaacctgggagctgggggccagggcgctgccggaatcttgtgcttcagggcctcagggacagttgggagagagtgcgtggggagctggggctaaatctctaagggagttggggcgatggggaaggcaagagaagtccagtcttctctgttcagatgcaaaggaagccccccgactccctaggaaataggggctttctctaacttccaggaccaccatagagaatcccattgggaagtttggaaacaagtctgtgtgaatctgaggagccacctgtcgacttaaaggggagaagggggccgggtggagtgtgctcgcctgtaatcccagtactttgggaggccaaggtgggcagatcacttgaggtcaggagttcgaaaccagcttgggcaacatggcaaaaccttgtctctacaaaatatacaaaaattagccagtcgtggtggcgtgtgcctgtaatcccagctactatcgcttgaacctggcaggctggaacctggcaggcgtaggttgcagcgagctgagatcacaacactgcattctggcctgggtgacagagcaagactgtctcaaaacaaaacaaaacaaacaaacaaacaaaagtgggggaagaaggggaggggtgttttccttgtgatgtgttatgggagaatctagccttcccagattgtagagggggtgaagacttttgctttaacctggtgggggggtctagttggaatggttacccggctaagagccatctccctgctagacagatcctgttaacagtatgatccattcagccagtgaggggaaggcaggtctttaataattatcccacctccattagagaattccccctccacccccagtccagctgcgcccctagctatgctctttcatttcccactcctcacttccagaattaggggactggctgccaagatctgcttcagactcttctaagtcatgtttggagggggtgctggggggaggagagggtgttcagcagtggtgtttggggttggatgccaggagtatctggtgggggagagggaaggatgtagagggatgcaaacgaatccccttctctctcttcctcctcccagccctagccatctggctacagagtggagccaggcactgtggcagctgaccccagagtcagggaggtgctgcaggaacacagggagggtgagaaagggggtgcaggtgctaatttgtccctccccattctcttcatgactagtccactggcctggcttgagggaggttcagcctattccctggagactctccttacaagttgctgataaaatgaccatttgccccttcccctttctagtagcttcctgaagggaaatgggtggggaaaagagaggtgggtgggtgatcagccacatctgatgggattgaggagtgtttcgggacatttggggtcagtctgccctctctcgtctggatggggggagaagcacagctgcagcatggggtgacttctagcaagaagtaaacatccagctgttgggcacactgtcaccccaacctcatccttcctcagagcaaggaagatcctgattagatgagatgaggtggggtctcattcaggaatgaggatgattgtagtctttctgcaccagatgggaagaatggatcctacctcattttcttttctaatcccaagtggtcctctcctatccaacacccctcttcctaaccgctcctggctggaatagtcctaaaggttgccctggagactaggcctggggctcggaaggggtgggggcggtcagtggggcacaggagtaaccggctcttccggagcagagtggagccagtggtgggtgtgtgtgggtgtggggaggggcgtggctacacccgtctgacgggcgcaggctcctcccctgcctgcccagtccccgactggccccctttaagattgggagcaggaggtaggaagattctccctcatctgctctggaaaagggcagggaagacaaaaggataccagcttccttacccacacccccatcccgccgcccttgaggcctcagttttatgcctttcttcacctgccttaattttttatttggggatagagaggcatttcttagcagaagtttgccagagccctcctttctccagaaggaaggaaacctctaccctgagtgtgacctctacttactcagggacttgaggtcagcaggctgttggaggagtatttttttttccccaaggtgacctgtaaatctgttgttttgacagggaggagagaagggttttggtttccacctgcctattccctccactggtaatctacttatctcgagagaggaagagaaacccccttagccttctgtgtctgtggcccacacactctgtgagcctttgctaaagctagcttccttcttatcctctctgagccatttgtagtgggggggtggaggggtggagtctttccccaaaattcagggaagagcccacccctctgtggagtaaggaaatccaatgtagactgatggatctcaccccccaactctgcccatttttcagatctctttcctcctcagacccccagaggaaaacgtatttgttgacaccccaacttgccagagtttcatcatccccactctgttgcttttccagaatattcagcagcctgagctttgcacagtttaggcaactgtttctagaactgcattgcattgaattaaatgggaattatcttcaaggctgcaaagtgttgagttgcaaggaaaggaaacctggtttcctttcttgtcatattttatccactgtttgacattgaagaagtcattgaacctctttgggtcttaatttcttcatttgatgaaggagagaaggttgaactagaatttttttttttttttttttttgagatagagtctccctctgtcacccaggctggagtgcaatggcgcgatctcagttcactgcaacctccacctcccaggttcaagcgattctcttgcctcggcctcctgagtagctgagattacaggggcacgccaccacacccagctaatttttgtatttttagtagagaccgggtttcatcatgttggtcaggctggtcttgaactcctgacatcatgatccacctgcctcggcctcccaaagtgctgggattacagccgtgagccaccgcgtccggcctgaactagaaattctctaagctctaacatcatatgacactgttcttcatcctggtgccctgcagtggacattttaggtgacagccaaactctagtcctctgctagattttacttttctgagttttcacacagttatgtagccctgtcagaaaaaaattcccagaaccatagaatgggtggacatttgtggcatctttttgctgattagttttcagcttatcctttacttctctgactgcatttaggctacactcaggtctttgctgtctggttccagagccgaaccttctttcccccacgcacaggaatctttcctttccggtgaccagggccctgcagatgtcgccaggaaagtggtgatccaggcaggaccaggctgcactgaagggacagaggtgagtgggtggctgactcttgcctctccccatccctttactgaatcgcgacctgagtgactaacctttctatttccacgtttccattaccctacctgggaaataactgcccccgaaattcccctgactcttacccctaccagcctgttagagaagtggcacctgcctttgggcctagacgtttggtctagtcttttaagttaaccttgggactgtggcatgcctttcagtttgccctgtgtgaagcaggaccactgcctccatgagatgcgggtgcagagggagctgccaggtgggcaaggtggccagagttgcaggaggcacagcggcgctaggacccaggtccgggtcggaaagatgggctggcgggctttaggaccctgtggcggaggccgcgtggggagactctctcccggccgaggcttctccgccccctccggctccgactcactcctcccccgccggccatgttggctcctctcgggccccgcggttgagccgcgtccccctcccccttcccgaaccccggaccccagaccccctccccagcgggcgtctccacccgttctggcgcccggagcgcggccatgtgaaccgcttgtaccccggggagagacgagccccgagcccggctggacgccgctgcctcaggtttgtggggtctgtggccaggggcctgagggggagggagccccgctttcatccgaggcttccctcggggaacagaagctccagagccggcttgagccttgccggggcgggaagccgacgggagcttatttcctgcgaggatccaacccgaggcgagggtctccttgctctggggtctgggaggagaacagggctggtggggctgctgaggaccccggacggggccgcgggggcaggaggagctgtaggggctcccggcgacagtgaggaggcggagaagccgcctggctggtggagatgactcctgtgggggacttggggtggaatccccgggaggggctccacctcctcgggtgggggtggggattgcctgagcgcgaggggtgggtgagggggttcccttggcgggttaaaacgctccgtttgcggggagctgggcgttttgactgtggtgagtggagggcggaaggggtttccaggggtctgagggtgtctccctcggggagcgcacccattctcttgagcgtggagatcaggagagggccttccttgctgagggtggtgctgcgcttggcttggggccctcgcgtcccgggagaatcgcgcactccggggatggaggttgatagggcttccgctgaggctttccaatttgagctgggctgaggggcagaagggaagaataaagaggaattcctttttccaaggagattcctcactgaggggatccccgcttccgtggcagaaagatgataccgcatcatccctttctttcccggtgttcccagttttcaggagaaggcaatgtcaatagcagttgtcctttgtagggttaattggagtgagagatttgtctgctttgggggacgacggaggggatagctttccacctctatctgtacacaaacagcccctcccccagcctcccgcaggaagtggccgggaaatggcagctgtgcgtttgctgctgcgtgtcttgttgttttgaaatgtccattttaatcagatttggtttcattttctgaagccttctgggcaagcttggatcttgccaaccatgtggcccgagagacctttcgttggactttttttttttttgtaaacttgtcaactggaagtagtcaacttcagttgactcacgtatcccaatcccttctccagaacatctctgtcttcctgtctggtttcgttttgttttccctttagctagaggtcatagagaagcaaactcagttatctaccagcggggtacgctctatgtaagtgatgcaaattccctcagcatagagagctgtcagggagactagagagcttttgtggcacgagtagcttcttggggtcctactttagtatagttattatgacagtttctatattgcagagcacctgagcaagtgagcttgtgaagaagggtagattctaagaaatggacgaagaggaaggggtgaggaagatttaactattagatggatttgtgtgtcgggggtagggactgattaacagactgagattggtgaactcagtccttggtggtgattctagcctaagggcagcccctgtgggaagcttgttatttgactaaggggtgctggagatactaccttctgcagaatcaactaattagaatagtacagtttgttatcatatgacttactctttaatccataaaagaacgtctcccctcttattcttcttggagattggtaagcttttcctctgttccctgcaaagtcgtgcccagattttttttttctttcttttcacttgataatcccaggatatttctcctgtaacatatagtgatggactgtgtgctatgtccccaggcattttgtggcacactggatttggttaggggcaacagttggccacagaattttatttttctttcttttctttttcttttctttttttttctttctgtcttttttttttttttttttttttgagacggagttttgcttttgtcgcccaggctggagtggtgtgatcttgtctcactgcaacctctgcctcccgggttcaagcgagttgcctgtctcagcctcccgagtagctgggattacaggagcccgccaccgcatccagctaattattttatttttagtagagacggcgtttcatcatgttggccaggctggtctcgaattcctgacctcaggtgatctacccacctcggcctcccaaagtgcagggattacaggtgtgagccaccatgcctggtcttctcttcttttcttttttttctcttctctctctcttttcttttctctttctttctttctttttttttttttttgagacagggtctcactccgatgcccaggctggagtgcagtggcgccatcatagctcactgcagccccgacctctttggctcaagtgatcctcccacctcagccccctgagtagctgggaccacagacacgcaccaccacatccagctaattttttgtaatttttgtagaggtggggttttgccagtttgcacaggctggtcttgaactcctgggctcaagtgacctgcctgccttagcctcccaaagtactgagattacaggcatgagccaccatgcccggcctatgaccccaggaccacaggattttagattttgaaagataaagttttgtttttttctttttctttttttttttttttgagatggagtctcgctctgttgcccaggctggagtacggtggcaccatctggactcactgcaaccctcgcctcccaggttcaagcgatcctcctgcctcagccctccagtagctggaattacaggcatgcgccaccatgcctggctaatttttgtatttttagtagagaaggggtttcaccatgttggtcaggctggtctcgaactcgaattgagcctcccaaagtgctggggttacaggcataagccacagggccaagccttgaaagataacattttcagattatttggactattctgaaaactacgtaagcctgtcatttaaatcatcttttcactatttattttccaggcaaaaacccctcccacctagatgaagatccctagattaaagatccagtatgggagcagatagacacttatgattgtgtgaaagtggcatcatcactagtaagatagcagcatcattgctcttctcactggggctgttggggtttttgatattctggaaacagtaaaaacaagtccatctgatgtcagcatcctttttcttgcccctgattagttcctttaagttgctgtctgatggggttgatttgatgctgattttaagttcccctttcttcagcctttgcttacctgaattggcacttgacagaacagcaagttgattttccctgttgggggttaaaagagtaaagaaaggagagataactactcttgagtctttggacttttaaaagaaaagctgattttgagaaaatagtgatttcatttgatacatgattgaattgggagctgaatgaagcaaacctttcatggccttcttataaaatgggtgcatttttctgtcagagaaatatatttcttaatatttcaagcttctcgatgaaagaaaaaatctgaggtgtaaagagagctgtatgggctgaccccagagccagtctagaatgaagggttcatcttgtagtcttgcggctctggaatcaagtattactgggagagaagcaaagcttgttagggttactgacagtgtcttcctgctgttgacctttcttgtcaccactgaagaggtcaagcaccaaactgctatttttactgctgaaacagtatagaagttagtcattgataatgatgtttgaccttgtgtaagatgtatcaagagcagcaataatgccaagtataaaatttgagataattcctggggtaaataaccttcttggtttgtttcttaggatgttggtgtcctcatatgccttatatatagcccaagatgaatagtttctcagtattatctcatgtgggtcagtaggactatttttcaccagcttgttattatcagtctgcctaatttggaaatttaaaaaattgtgcaaaacaaaaaagcccatctttgaagatatctgatactttgaagatactgtcactagcagtaaaagtagcattggcttagtgttttgtcttttctcctctttaaagagaacagttattatgggggcattttgcagactaaaatactgtaatcttgccaaaaatttaccaaagaaaggaagaagttttttgttgttgttttttttttttttttttttttgagacggagtttcgctgtgtcgcccaggctggagtgcagtggcgcgatctcgactcactgcaagctccgcctcccgggttcacgccattctcctgcctcagcctcccgtgtagctgggactacaggcgcgcgccaccatgcccggctaatttattggatttttacattatcagtacttccctattttcaggccttattttcttcaaggaatggctatttaagtacgtcaagatttgaggcctttcttctctcttgaaatttttatctctgtgaagaatgaagctgagttttttttttttttttttgttctctgaaaatagtaagagcaaagcccatgaccttcattggataagtaagctggtagtggcagaaaaggtagatttactcattcatttcttcagtccatggactcaacaaatatttcctttggttcttttgtatacttagcactaaattaggtgctagggatataatggtggaacttatatccaactgatgctgtggaaccgacataatgtagaagaaataaggacagagaacagtcatctttgaattcttctgaacagcctggacgtgacagttttctttgagtagccccctcttagtataatcttccttctttcattatctttgttctgcctcacttggagtcctgactagggaaggtagttaaggagaggatggatattttgagcctcagtcagtatatgatatagtttgtccgagtcagagttcaagggaagcttgttactagggcactcagaatgggttatcgtgattggagaagagggcatatttattctgtggcttggtacttggaattttttttttttttttagtgtagagatagggtctcactgtgttgcgcaggccagtcttgaattcctggcctcaagtgatcctgctgaggttataggcatgagccacctctcccagcctacatggaactcttattggtggaggaacatggcttagccagggagatgaggtttttagatacaaaagccaaagcgtcctcatttgcagtgtcaggaactgggaacagtgaaaacttggaactttcccaaggtgtggggcaggaatgggacagcttttacattagaacagggtttctcagccttggcactattgataacgtgggccagataatatcttcgttgtggggggcgctgtcctgtttgttgaaggacacctagcagcatctttggcttctgcttactagatgccagtagcacataccttcagagattactaaatgtcccctacggggcagaattgcccctgatgagaacctctgtattagagtgtggtgggtaatccagagatgtgtagagttaagaaatatccttcatgatgttcacaattacaaagctaaaatgtagtggtgtgatttttactctagaatttgcctttgctgtttagtcaagataaacatttgaaatctctctcaccccccaaccccatttgtgagattttgatgtactacatgagaagaatgaacccaagagctgcagggaccactgcagtatccagctggagggtgttaatgtgtcttgttgtcctggggggtagcctcagaggctggagggttagaattggtcagggaggacacctgtaacagtgttgcaatatataatatttatttcaacactttgtgcattgtcagcctttttcttttttttttttgagatggagtctcgctctgtcgcccagactggagtgcagtgacgcgatctcggctcactgcaacctccacctcccgggttcacgccattctcctgcctcagcctcccgagtaggtaggactacaggtgcccgccaccacgcctggctaattttttctatttttagtagagacagggtttcaccgtgttagccaggatggtctcgatctcttgacctcgtgatccgctcacctcggcctcccaaagtgctgggattacacgagccactgctcttggtgttgtcagcctttttctattaaaccatgtcacaggcccacagagtagcagctctttgattggaactgggagaaaagcaacctattcggccctgtggggagggctttattgcttcaagcttatagggcaatgtcccttactcttataaatgaaacataggagctcttaaaagatccatttatgtatagctgggactgggctgggtgcttgaatgaatgtacttcctggtatgagagtcatctgctactctaggggttgggcactggctgatttcttttctcatttggtgaaaatcctattagttcaaagggagatgctctcctttgctttactgttcttactagctctggatgggaggacagagtttacctttagggtttattgtgaaaagcatcttgagtaggaaggttaaaatgaaataaacctaggttcattgttgagaggaggtgttcacatgtttttcgtattcccatactgtgacataattaattcccatatttaagtgacatctgaaatcaggagtcaaattgtatataaggaagtctggctggatcatccctagttttaaattatatttattttatatgtagaccgtttagacctgattatcttttttttttggagatagagtgttgctctgtcacccaggctagagtgcaatggtgcgatctcagctcactgcaacctccatctcctggattcaagcaattctcctgcctcagcctcctgagtagctgggattacaggtgcccgccaccacgcccagctaattttttgtaattttaatagagatggggtttcgccatgttggccaggctggtttcgaactcttgacttcaggtgatccacccaccttggcctcccaaagtgctgggattacaggcgtgaaccactgcgcctggccaggcctgatatctttttgaaaactacacagtcttttactgtttgtctaataatagtagctaatgtagtcctggtaaggtggctcacgcctgtaatcccagcactttgggaggtcaaggtgggagaattgcttgaggccaggaatttgagaccatcatgggcaacatagcgagaccctgtgtctacaaaaaaatttaaaaattagccaggtgtggtggtgagcacctgtagtcctagctacttgggaagctgaggcaggaggattactggagcccaggagttccaggctgcagtgagctatgatcatgccactgcacaccactctggatgacagagtgagactctgtctcaagaagaaaaaaaaaaaactaacgtttatggagtgcttgctggatgacagacactgtgctggggctctaatttagattttctcatttcatcctcaccagtccttaaaagtgggtacaaaaattgttacagatgatgaaacttaggcccagcaagtataagtaacttgtccaaggttaaacagctagctagtaaatagtagagttgggatttgaacctagagcccactacattgtgctgaccacattgcatagcacaaagacaattttatgtgtctaggaagcttctcgtaaatgaagtggttgtggttctgatgacagttcagaagagacaggtggagaaactgatctcacatactaaataacttcccattctttttaattctctgatttctgtgagccatcgacatgttgttattaatatttacaaaaacaggatatgctgtgcttttccagagcagcagagaggaggtcacaactttgttcttggattcaaatagagaatggaaaaatgaaccgtgacccatcattgaggaggatatagtccactgcacataggatggaagttgcatgtatcctccacaccaggggaggtgtacaaaaaactggggagaggagaggtgaggatcagatgaaattggccctctaggcatagtatttccaggacttctgaagtgaagagtgtcctccttgctctgtggtataagctttggaaggaacctaactggagactaaggaatgaactttcctttaattcttgcacttaagaaggattattaatctcatgatgcttatctttcagaccccctactgctgaggagtagctgttaactatactagggaaatcctgactgggcgcagtggctcatggctgtaatcccagcacattgggaggccgcggtgggtcgatcacttgaggtcaggaattcaagaccagcctggccaacatggtgtaaccccgtctctactaaaaagataaaaaattatctgggcgtgttggcgggtgcctgtaatcccagctgctggggaggctgaggcaggagaatcgcttgaacctgggaggtggaggttgcagtgagccgagatcacacccttgcaccccagcatgggcaacaagagggaaactctgtctcaaaaaaaaaaaaaggaaatcctggaggaccctgtgtgttttgtttgtttgtttgttttgttttgttttgtttttttgagacagggtttcgctctgtcacccaggctggaatgcagtggcatgatcttggctcactgcaatctctgcttcccaggctcaaacaatcctcctgcctcagcctcccaagtggctgggactgcagctgctcaccatcatgcctggctaacctggggtcttttcactataaagactccattttttcactgatgcatggcaggtttaggtctgctacttaatttagagcaagcttgtccagcccacccaggacaactttgaatctggcccaataccaatttgtaaactttcttaaaagataacatggagattttcttgtgattttttttttttttttaaagctcatcagctctcattagtgtattttatgtgtggcccaagacacttcttccagtgtggtccagggaagccaaaagattggacacccctatttagactaaagatgagatatcctatatgggagataagtaagtcctaaaaactttttcccttaaatcaacaaatgcacattgcttttagtttttagagatggggtcttgctatggtgcataggctggacttgcacttttgggctcaagtaatcttcctgcctcatcctcctgagcaactgagactacaggcaggaaccaccatgctcagctaacttttttattttttgtggagacagagccttgctatgtttcccaagctggtcttgatctcctgacctcaagtgatcttcctgcttcagcctcctggagcactaggattacaggcatgagccaccatgcttggcctatttttatttttaaaatttcagttaaaattgattaagatacagacaattcccacatactatgcagggtttatatatcatgctcagacttatgttatattcacatttatactaatggtgtctaattttagtaatgtagcatatttatgaatgtaactcttgcagactttggccagtgggcatatatattcttttcttttcttttttttttttttttttgagacagggtcatgctctgtcacctaggctggagtgcagtggcatgatcatggttcactgcagcctcgacctcctgggctcaagtgatccttctgccttagcctctcgagtaagctaggaccacaggtgtgccccaccacaccctgctcctttttttttttttgagatgaagtctcgctcttgtcccccaggctggagtgcaatggcatgatctccgctcactgcaacctccgtctcccaggtccaagcaattctcctgcctcagcctcccgagcagctgggattacaggtgcctgccaccacgcccagctaatttttgtattttttagtagaggtagggtttcaccatgttggccaggctggtcttgaactcctgacctcaggtgatccgccagcctcggcctcccaaagtgctgggatttcaggtgtgagccaccgtgcctggccttcacaccctgctacttttaaaatgttttgtagagatcggttctcgccatgttatccagcttggtcttaaactcttagcctcaaatagtcctcctgctttggcttccaaagtattgggattataggtgtgaaccactatgccaggcctcatcatatatgtacttaaccagtgtattcattcttttttttttgagatggagtttcactcttgtcgcccaggctggagtgcaatggcgcaatttcagctcactgcaacctctgccttgcgggttcaagcgattctccttccttagcctcctgagtagctgggattacaggtgcctgccaccacacccagctaatttttgtatttttagtagagacagggtattaccatgttggtcaggctggtctcgaactcctgacctcaggtgagccaccgtacctggcctgaattcttctcttttttaaaatgtagtaacataattcaaggagttgctttttctgtatcaagacagattatgtttctcacatatcaagttggtatgcactaggatgtcacaagaatccgattgatatgttagagtttaccaataattctggcttctgcttgctttctttcctttcctctgtcaaagttaaattcattctgatcaagggcttcttatcattcttagtagtattcagaaagggtgaaaaactttttagccatacctcaatgagccattgcactttacaaatataagtatcttgctattttattttccctgtgaccgtttctttatatttaagccacaaaactaaaacattaggaaataaccataatagacataacagaataatattttttgggataccctcatatttaatcaattttccactgctgacatttttctgacctgtgttcttggggagcataaagagtagaagtattgctggatgattcgaggtttgccattatgatcaccttcctgaaatgtattctccttttcaaatccctttactaatgtaactactatcttgagatatctagggctatggataggataattagaaattatgtttagctcaagtttaataatgaaacaaagagtgtttatcaaatatgcttttctgtcaaaaagatggctttgagaaccttttgtgggcctgggagggagactttaccttggggataaaaacaaaaggatggagaatgttaagtggtacagtagaggctaatatctaatatagaagggtaacctgggctgagtggggcttacacagagggaagactcctccaggtttgtatcttggtttttctcgctaacttgctttgttttttaatctacaaagctggctttaaaagactgttttcataggttcattgctcaggctagaggcatattttctccttctcttttcttattctgtaccttccctcacacagtacttaggtaggagaagggtaagtaggtggaggggaggggtcattgcccctggaagattccaggtgacataaccttgtttaaccgccagtattttttttccctctctctcccctcctgcagaaatggaggcaaacgaccattttaactttactggccttccccctgcacctgctgcctcaggactgaaaccctctccttcctcaggggagggcctctacactaacgggtctcccatgaacttcccccagcaagggaaaagtgagtgtgagggctgcttggcctggggagggaatgggcatcatccctttagggcagattcatggggggatattttgctctactttgctgctggagagaaatcaacttctaagaacaagttctagggttttttggaaacattttttgtattgatttaaggttggaagagattagaaaaacccactggctttttcatcttagcctgttcttctgtcagccctgttcccctggctgctgacagagcagtgaagtggctactgctgctgataacccatgagagagataaagtgctagccttctaagaagctgtttttagaggttagggaagctacactgggccaggactgagagttgaatgaaggttgcagtgtatttattgccttttagtttgtacatcagagaaaggcagatgctagaagtacttattccaccttctgtccttggatggaaggtagggacaagggaaagtttaatgcttacctagttcccccagagagaagttcataattccatatggaggtgttgctgccaggattgggtcttttcctggatttggcttaccagttgctctgtaccatgactcgccaggtacctctgtaatcttgcttgggtttcaagtcctttatacttggaagcagagagaagcccacatgcttccctcctttcttgtagcagaaaaatcctgctacttctccctccgatcctctcgaagagggttgcagatggtagaagctcctttatttcattggattccaccctaccctcaagcttccttaatatcttggttctttttgattgattgtcctccatcccagaggttgccattgatgatgagagctgaattctacagcacacaaagtgccccccctaccccgccagctggcatattaccttccaatgcctatagggaagggccaagcccagccttctgagctgggttcttgtcgctgtggtgactgcaaattctattcttagcccagcacaaagtgctggatctgcatgtgccagtgaggtggaggttgttccttttggtaccactgtggggccaaataggcactggggaaagggggcccctagcgaattcagtcatgcccctccaagggaagaaatcccctagggaatgagagtagggcagaatgcaagtcactgtagggagtctgcaaacagtttcatttaattaaaaacaaaaaaaaaggccaggcgtggtggctcacgcctgtaatcccagcactttgggaggccgaggcaggtggatcacgaggtcaagagatgagaccatcctggccaacacggtaaaaccccgtctctactgaaaatacaaaaattagccgggcgtggtgatgggcgcctgtggtcccagctactcgggaggctgaggcaggagaatcacttgaaccagggaggcagaggttgccgtgggtcgagattgcaccactgcactccagcctggtgacatagcgagattccgtctcaaaacaaacaaacaaaaaataaaccaaaaaaaagccagcagtaagcagcagcaaccagctctgctggtggctctcatggtaggcctggagagctctctagccccctactcagcctcagcagcagttgctaaacctacatccaggagcctctgggcttggtgttctccagagacccaaaaactaaatatagcaggggaggaatcccccttccctttaccatgtctttttctagtcagtgctattactttgagtttgttttggtaaagttgcttgcctacatatctgtaactgaccttttctttctttctctgccaggtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccaggtataactgggttggtgaactgggtggggaaaggaaaaatggagctcgggggggatagtggctttttgaggtgagaaaaacttgtctttccagctctctgcagtggaggctgatttgcatgttggtgattagcaattagcagagccaagtggctggtgtttttgtggcagcagcaccagctcgcgagtgggagtgcaaattatttcaagctcatgcagagcttctggcctggagagggcaggtgggcgagcccgaaacagccccaacagacaccctgcatcaagaaaggcttctttcaaaatatacggagtggttagggtctagcagcgggcattgaggctgttttaactgactgtggcaggatcagactggctgttaaagtcgtctgagcccaatgtagtgattggcatgcgaaggagggaaggaagcaggcagagcatatcattatttgtctactcagtttccttttttttgttgtttagcattagtacacgtgacagcccctctcatcttttccctcaaaatagataaaagcttagcttccagttgattcctggtacaagggtaaccaccactctgtaaaattacaggatgttttctcgtttcccaatggatggaggagatatctgagaacatgatagagatgttgtatcagaccccactctcttttcctctctttgcctgctgtaggattgattttaccagcacatctctgctcagagtatcttgatgtgatcggttcccagcaatgaactggccgcaataaatgttgaatgaatgaacatccttctagcaaagattgactgcctagtatagctaagtgaaccaatataaggcactgattttgacttttggtctctcctgtgatttcctagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccaggtaggtttggaggctatgtccctttaacttatccatgcagagtagccaaactttacctgaaagagacagtaaaatgggaaaagtattaggcaatcaggggcactggggcttccaggtaggcctaaggcagaccacagttacatgccacaggacttggtgccctaactgaattctgagctgaattggttcatgtcccaggttctttcccagtattccttttggccaagagctctgggctgtaataattcactgggtagggacttattatcacacagttgatctttctgggttctgacaaactaggaagaaaacatttgtcagtgagcagttaccttttactccactgaagtacaagaaagacatattttatgataaatcctagaattttgcataggtctctgggtagataataccaccaatgcctttcctttcattttcaccttgtagagatgaggtcttgctatgttgtccaggctggtcttgaactctggcctcaagcaattcttctgcctcggcctcccctcaaacttttatgatccctataatctcatgactactctttcagggagaaggctttacttgttacctaacttaatattaggaagaatcttcacattgtgggaactagaattggatgttttctgaccagtgtttcttaaatcttgctttctgatttttttctcattatcctgctctgatttttctacccttgtaaacagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaaggtaagtgacggtaggtaggacaaagaaagacctttacctgagaaaagatgagagaataagtttcatagttagggccttaagagtgggaaatctggctgggcgcagtggctcacgcctgtaatctcagcacttcgggaggccgaggcgggtggatcacctgagatcaggagtttgagaccacctggccaacatggtgaaaccccgcctctactaaaaatacaaaaattagccaggtgtgttggcacatgcctgtaatcccagctacctgggaggctgaggcaggagaatcgcttggccccaggaggcagaggttgcagtgagccgagattgtgtcgttgcactccaacctgggcaacagagcaagactccatctcaaaaaaaaagtaggaaagcaagagcaccttgctgggagctgaggggctatgggatagtgtatggtggaactaaaagaggtataggctgctatactccgacctgtgccctctgctttgaagaacttgtgagacttggaatttgtagggagaaggaggctagaagctttattggcaccaggtaaaaggtatttcttcacacaatgacatctgtagcaactttaccctttaatcctcatgattggttgggagaaaaagctacttctttttccaaccctagggaagaccccttgaagtaaccctgtttagcttggtccagggttgactgagtagattctcttgttttatgtgatgccttttttttttttaaagcctatcctgtccctttggattctagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgagtatccagattctattctatccctgtctggttccaagaaacttttctgtcccatgttgtagttagcctttccctattggcctattgtttaaatattttgcttgaactcttaacttgggtatcccttcctcccaaggtgatgtcatgaggagacgtattgctaccccagaagaagttcgtcttcccctccaacatgggtaaatgctctagtttgctacatttattgaccttgacaagtttaatgcacaactctagaaagaagggaatgcctcttttcctctgaggtgggggaggaatgggccagacaagagtagattacaggacagttatctgcagtgataatgtttcttggcatgagattcctaggttttccttcttctctcaaggtctgtcttccatcacctattcttttttcatcttgtagtgactcaattttgcccaaggagctccagctattatcttttccaaaccctagggctcacatccaaaccagctggcttgtcctatttctgtggacaagggatagtaatgaatgaggagtgacttagtactaatgaattgaggtggttttgttgttttaatgctcttaggagaggtaagggcaggaacagtacatgaccaaaatgaacaaactagctgacaccagggccttgtggaaataactgccttcctggatcttccccacccctgcccctcaaggctacttgtggtcaccaagtctgagtactgcttaaaattttgagagaaagattagagttagtcttagaactaactctgactaactttgtgttctgctcagaacacagagttcctaactaaaccctggcatattgagtcttttcatggaatcagcagcaaatttatttttctgcttgcctccctgccctttgtcttctgtctttattccccttaggtctttatcctctttactggaaatccagtaactgccctgaatggctcagggaggggtttctggcagcttatctcactgattttgtaaaggagggatggagatctctctgagcttgtgcagtttggtgtagtgcttttctcctaagggccttgatgtatttgctggagctcaagtcagccttctagccaagcttatctctcttggtgcttttgcatctgcatgcagttctagagatacaaatgtggggagggccatctgctcagagggcttcgcgcttaggtggcatgggagtgggtaggggtgtgacctggcggcagggcccatgtgcttctctggcaggtggcggagagaggtgcgcatcaagaagggcagccaccgatggcagggggagacctggtattatggcccctgtgggaagaggatgaagcaatttccagaagtgatcaaggtaatgtagctttttttaaaggactgctttcttgggctcagtggactcctttccactgcccaagactccgttcttgggctcagtgacaacaggctggcattgtctgctctgggcctgttctgcttatgcctttgctggccaaagacatggtaggatccaactttattaatgttactttacttcttcctcttagtacctgagccgcaacgtggtacacagtgtccgccgagagcacttcagcttcagtccccgtatgcctgttggagatttctttgaagaaagagacacgccagaggtgcagacccaagggttaaatatgcttttgtccctgaggaagagttggtggacaagctgcagcttcctctcgtggggtttgaaggttctggggcattgaatggttccgagggcctcgtggcctgcactgattccttactactgtaacagtctcccttgctaccttagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaaggtacagtggtatttcttactttgggattctgctccctccatgaggtatctaaaatgttgatgaattgctaatacctggatttcccaggagtgtaactaacattatctgggaagaatgaatctgaatcagcttctccttggaatccagcatcctagtcccagcgcttgggaatactacttttccagccatggtctttcttgagttgctgttaccagtgaaaccttgggctgcccccaggtgtgtttagcccagaggagaggactttcttgccctttctttccatcttttagctccttatcatatactggttcagttgtacccttttaccttacccatttctactatcatggaggttcagaattcacatctgaattcaaaagataattgggagccaggcatggtggtgtgtgcttaataatcccagttacccaggaggctgaggcaggcagcagaggatcacttgagcccaggagtttggaggctacagtaaacttcagttgtgttattgcattccaacctgggcaacagagcaaggccctgtttctaaaaaaaataataggccgggcacagtgtctcacacctgtaatcccagcacttcggaaggccaaggcgggcggatcgtgaggtcaagagattgagaccatcctggcgaacatggtaaaaccccgtctctactaaaaatacaaaacaaaaaattagctgggcgtggtggtgtgtgcctgtagtcccacctacttgggaggctgaggcaggagaatagcttgaacctgggaggtggaggtttcagtaagctgagattgcgccactgcactccagcttggtgatagagctagactctgtctccaaaaaaaaaaaaaaaaaaaaaaaagccaggcacggtggctcacgcctgtaatcccaccactttgggagactgaggagggcagatcacctgaggtcgggagttcaagaccagcctgaccaacatgaagaaaccctgtctctactataaatacaaaattagccaggcatggtggcgcatgcctgtaatcccagctactcgggaggctgaggcaggagaatggcttgaacccaggaggcagaggttgcagtgagctgagatcacaccattgcactccagcctgggcaacaagagtgaaactccatctcaaaataataataataatataataataataataggcactgttttagtggatggacaggtgagaaatacctacatttttcagtaaatagtgtgtttaccctggtgtagtgtgaagaatgtgaaaaaacttagtcttttgattttcactcagacatctagccgtgtcatgtttcaaccaaatgacctagaacaagtctcattttgtttttttttttttgagacagagtcttactctgtcacccaggatggagtgcagtggcacgatcttggctcactacaagctctgcctcctggattcaccccattctcctgcctcggcctcccgagtagctgggactacaggtgcacgccaccacacctggctaattttttgtatttttagtagagacggggtttcaccatgttagccaggatggtctcgatctcctgacctcgtgatccgcccacctcgacctctcaaagtgctgggattacaggtgtagcccccacgcctggccctttttttttttttttccagatggagttttgctcttgttgcccaggctggagtgcaatggcgcgatcttggctcaccgcaacctcccaggtttaagcgattctcctgcctaagcctccagagtagctgggattacaggcatatgccaccacgcccagctaattttgtatttttagtagagatggggtttctccatgttggtcaggctggtctcgaactcctgacctcaggtgatccgcctgcttcagcctcccaaagtgctgggattacaggtgtgagccactgcacccagctaagtctcatattttaatcaaagccttaggtagttcatctgcccataatatctgtcttagagggttgtcacgtagacatgtggtggcgtttctataccagaaacaaaataataaatattgtcatgtcagggccaggcacggtggctcacggctgtaatcccagctctttgagaggctgagaccagcggatcatgaggtcaggcaatcaagaccgtcatggctaaaacggtgaaactccgcttgtactaaaaatactaaaaattaactgggcgtggtggcacgcgcctgtagtcccagctactggggtggctgaggcaggagaatcgcttgaacctgggaggtggagattgcagtgagccgagattgtgccattgcacttcagcctgggcgacagagtgagactccgtgtcaaaaaatatatatatgtatatatagtcatgtcagaaacatcaattatgaaatactcttgtttgcagaattatacttccacaagtcttcccgaaaggaagaaattcagaacttttagtgaagcaagacatggagctgagcatgatcaataactatgtcagtgattcttttgaggtgtccactgtgtgggccttttttctggcacacccttggttaatcagtgcttctaactactaccctctttccctggcagtttggcttgctgtatcctttctctgctttctgctctaaaatcagtccgtgggtttctgctcttgtcaggtatcctgggagagagattggctccaaggctactctgccattgtggcctcttttctatcagcaggacaccttctaaagcagtctgattggagccaggggctggtgcttctgggcaggagatgtcatttgagttctttgtgccacccccatagcaggtgcctctcctacattttttcccccaatgttttattatgtatacttaaaaaaaaaaaaagctactctagattcttcagggagctgcttgggaggccagctttgagacgggcatgtgttgccctggatgctagagaactgccttcctgcctcacttgtttcatttttctttctgctctcacagaaacattgaatgaggaggataaagcaaagattgctaaaagcaagaagaagatgaggcagaaggttcaacggggagagtgtcagactactatccaagggcaggtgagggacatcagagagatgaaacagtaggttaatttttcctacaacttacttcatcttttattttcatttcccacatccgtcactccctgtgtagcagcatatcttcattaccctgaaatttcttgcacttgatttagagaattgggtttgttcaaaaataacgtgggcatctctagggtgagagaattaatccattgccaacccctcattccatctctcacctctcctccccagcacccttgtctgtttttgaatcctagcccaagcagagatgctttcagagtttgaggagaaatgacttcccttatggtttacaggccagaaataagcggaaacaagagaccaagagcttaaagcagaaggaagctaagaagaaatccaaggtaggtgcatgtacaaacttgccaagtataatttcgaagccactaaactgattttgcaggacatgtacatcagtcttgttttatagtgagatttctgggctgtgaggttgggaggactgggaccagggaaggatagtgactgatatctttatggcagtcttggttcctctcttccttgggtaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccaggtagtgaggagagagtaacagttcctgggtcagctgggaagactttcctttaaaaaaaaaaaaaggacttctgcaatgggagagacatttccattaaagattaaaggaaggccgggtgccatggctcacactgtaatcccagcactttgggaggccgaggcgggcagatcgcttgagcccagcagttcaagaccagcctgggcaacatggcgagacctcatctctacaaaaaatacgaaaattagctgggtgtggtggcatgtacctgtagtcccagctatttgagagactgaggtgggagaattgcttgggcttaggaggtcgaggctgcagtaagcagagatcatgccactgcactccagcttgggtgacagagtgagaccctatctcaaaaaaaaaaaaaaaattacataaaaattaaaggaagaacctcttgtagacatgcaaattgtcatcttctgttatgtttaacagaactctctactcacttttctctctctagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcaggtgagtgcaagtccctcccaaagtaaccaggacaagtaaaggagatgtaactacttagtgtttctcttttccttatatttttccatttctttttcttcctgactcctctccttattttatttttctttattttttccttttcttttgtggtcttctttcgtattctgtcttaacccccatagttctcttctgatgtattttcctcttgcacattcacccaacttggttgtgcatctttccctactcacccccattatgctgtcctccacacagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaagtgagaggctgggagtggggatggtcattgtatcccttgcatcagaatggggtggaggacttgtagccttccagaagtcctcagaaatgtgtgttcactgccatgttctgaagatgctggaatgacttgggactgaattgcagtgccctccctgggagagcctaagccttctgccattcacccaatctgggttctaggctggaactcctttttcagctgcagcccctttacccttgagcctcctttccctttttttgtgctgccacttcatcctattccctattcccctgcagtgagattgacaagactctggagagtatgtccagctacaggaaaaacaagtggattgttgaaggccggctccggaggtagggaccagacagagagtagagcctcagagaggagagaagtggggcgggtgaagcatagccagggttttggcttgaaatgtgatgctttagccccttccctgggtttgggaccttaccagggcccaggatggtttagagtcaaggtatttcttttgtggcactatcatgttcctcaccagtttcccgtaattttttttttttgagatggagtcttcctctgtcgcctaggctggaatgcgatagcgcaatcttggctcactgccacctccgcctcccaggttcaagcgattcttctgcctcagcctcccaagtagctgggattacaggcccatgccaccacacctggctgatttttgtatttttagtagagacagggtttcaccatgttggccaggctggtctcgaactcctgacctcaggtgatccgcctgtcttggcctcccaaagtgctggaattacaggtgtgagccaccacacttggccttcccttaatctttctccatctatttcaaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggtactggcccaagatcaaggaaagtgggagttagaaaataaattcctctttcttgaatctgataacctcctttttcataatgcccatgtgtttctccctaggttgatgccacagcatctagcatcccagagctagagcgccagatagaaaaactcagcaaggtattgtgcttctaacctcccaagagttggagatatgggctgggcaagaattgatcagcttcttttttaaactgaattttaatttttattcttttgagatggggtttctgttacccaggctggagtgcagtggcacgatcatggctcactgcagcctcagcctcctgggcttaggtgattctcccaagtagctgggactacaggcaggagccaccatgcctggctaatttttgtgtttttgtagagacagtttccatatgttaccaaggctggttctgaactcctgggctctagcaatccacctgccttggcctcccaaagtgctgggattacaggcgtgagccaccgctcccaaacttaatcaccttctgaattaggcccagatggcatcacttttatagagggactgagagccattgcctttctctgatatactggatgaattcaccactgtcactctggaaatgtgtttattcatcttcattttcattgtctacccagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttaggtaggtgtgcctgtgggagtgtggattctgagtcctatcaaacaagaattaaataattccttttccttagtagtcttgggcttctttcattttctgataatatagcgtaatggttaagagcacagattttagagtaaagctgcctacccacctgctctgccatttccagctgtatgattctgtttcttcatttgtgaagttgagataataatagtgtatgtacttcataaggctactgagaggattaaaatgagttaagtctcttagaataatacttaacccgtagttgtttcgcaataaatgttagcttatgattgtgctgctgctgctgattacttgggagaatagtgtttcttccccagatactgtgttcattggcatataagctcttcccagtggaatctcaaaaaagggggactaagtccaagagaaaaagaaagtataggtcctaagtttatataccctcttacttttcccttgtatgtcagcatatggcttaactctttacttctctttacagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccagtaagtagccagaattagtagtatgcacttgatttcatcttgccacaggcaccattgcctgggtgtggagctgctgcctgaagttgagggaacctataaacatgaaaacatcctcatttccttatgtctcattttattcacagatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctggtgagtgaccttggagtgagggcatccggtgtgggcagtgcttcacagctggcgccccacatatatctcatctgctcacagagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctggtaaatacattcctacacccagcttgagctgaagagcccaggataagcattgagctgctgctagggacaacagcctgatgggcctctccctctgccacctctcttctcagaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcgggtatgctgggattggcactgtgtaggaaggttggggaaaagcattagtcccttatgccctgttagaaaaaaccctgggtccctacttcacaggtgacctaccttaagtgggtcttgtttttgtttttttttttcctatgccaaattttcctccttttacagtgagttttattcctctctcttaactgaagggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatgtgagtgactcccaccctccattcttggtcttggagagaaagggataagttccctctttagtggatccgctccttctccaaagatcaccactttctccctccagatcatatgagatcacccctcgcattcgtgtctggcgccagaccctcgagcggtgccggagcgcagcccaggtgtgcttgtgcctgggccagctggagaggtccattgcctgggagaagtctgtcaacaaagtggtaagaggctgagagagcctggagaggctgaggggccagccagcaggggcggggtggggtcactggcaggtagaggctggagagctcattctgcctcctcacaaccttggtccagacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcaggtaaggcttctgctctttctttcccacactcaaacagaaatcagagattatcctcaatctctcctctccttggaaagagtcctagactgggtattaggggacctgggttctaagtccttttttggacaagtcacttaaattctatagctttaattgctgtctctataaaatgagaataactataccttcccttttacctacttcattgggttatgtgaataaaccaatgccggcttatgcatgatagtattttgaagccttaaatcatatttaggcagagattgtagtagggcaagcagtgcatctccagctgttgctaatctcacctgtttcctatactaagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagtgagttgagtgaatcctggggggacagttggctctacctctgccagaggaaagggctgggaggggtcagtatatttgcttcctgagatggagccatcattgtccctctaatgataggattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtaagtagatgtgggtgaaccgcccggtctttgctactgctgcaactcctacccagctcacagttttgcccctgccctgtccaggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagacttttgtgttttatttaaaaaaaaaaaagtgtgaagtaagacaaaatggacctctaccaagttgtagggaaggacaaggaaaagaccaggggtagaaaaggagtgtaagttttagaatggtggcattggcatagatgtgggaagagtataaaactagaagaagtctccagataaaaatatgcaaaatatgtctgtttaagtataaacattttctgtccacatgcaaagaggtgtttacccacccaaaaagggtatatgttggagtggggacttcactcgcgctggatatgtattaccctccagcctggaaactttgtcttggtgcaaccccctaaactgtatgttaaggtagaaaaggaacattcgcttccagccttataaaaatgacagactccctctttggtgtttggttaccttcacagctatacgccagccactgagcagctttcttgtcctcttaagttctaaactctgctcctatgctggtgtcctccaaccattacttattaccctaagccgtcactgcacagcctactcccctggcctatcacagcaggacctatctggagagttcacactattctagggcgatcagtgagctaaaaatcccagagaaaacactgtaggaatagaaattcccaagtttaattcccaagagtttaaaaattatgagccttttctagcccccaccttcccaaccctcagagaaggacagtaaagaaatcagtgaatccaggtatttacctgttgttgaattgtgaggttgtgaggtagacgtgtaacaaggacaaggaagtttggggatctgcttggagaatgaaggtttattcaaaacaagtggacaggtcaggggtaacgggtgatgagggcacctggcttttgtaatcatgtggggactgtcccctgggaggtgcagcaaaaatcagaacggagacagaagctcacagtctggttttagctgccaactcctatggaagtccatagctgactcctatggaaggcctaccaaatgaggaaatttcaggaatttgctaatgcgtgggaggattgaaaatgtaggcagcacagaaatagagtagttggtttaaacgggaatcaggaaggattggtataacaaggcacaagatttggaatttaccctttacagactggcttttataacacccaccctcgtctctgaagcctgctgattcagggctagcagagcctaggggcaagtttgggccagatcacccacccagtttattgcccttggctaagaatgcaaagcccctcatgagcgcaatgctgccacttgcccagaaggtggggcatgtgcacaaggcagcagcaatagttcttttctagaagactaatagccactgctactagggattcctaggacattccagcaaggcctctcacagcatcatatgacgcaaagtaacagcccacgggttgacattggagtgacaggcctcaactcccaatgggttgacattggagtgacaggagtaggcactggaggcactaagggagggtgagtgagctgattgtcaagttaggaaaggaaaacgaatggagtggagctgaagtggcccaacccagcgcatggcctgtgaagcagcaaagtctggtcttcatcttcaatatgagtaatgtcctcttaccactccttatctgttactgacaaggtctattaccctttagagccaccaggcttcctggcctgggcaactctacaaattctttagttaaaaacactacaaagggccgggtgcagtggctcacgcctgtaatcccagcactttgggaggccaaggcaggtggatcatttgagcccaggagttcaacaccagcctgggcaatgtggcaaaaccctgtctctactaaaaatacaaaaattagccaggcatggtggcaggcacctgtaatcccagctactcaggaggctgaggcaggagaactgcttgaacccaggagatggaggtttcagtgagccaagatcacgccactgcactccagcctgggcgacagagcgagactccgtctcaaagaaaaaataaaaataaaaaaactgaaaaggccaggtgtggtggctcatgcctataatcccagcactttgggaggccgaggtgggtggatcatttgagcccaggagttcgagacgaggctgggcaacatggcgaaaacctgtctctattaaaaatacaaaaattagctgtttggaggtcaggagttggacactagcctggccaacgtggtaaaaccccatctctactaaaaataaaaaaattagccaggcatggtggcacaagcccatagtcccaggtacttggtggccggggaaggggtggctgaggcaagaggatcacctgagccttgggaggtcgaggctgcagtgagccattatggtgccactgcactccagcctgggccacagagtgagaccctgtctcaaaaaaacaaaacaacaaaaccaaaaaaccaaaaacattaaaaacaacatctcatccaagcatggaggctcacacctgtaatcatagcactttgggaggctgaggtgggaggctcacttgacaggagttcaagaccagtctgggcaacatagtaagacccctgtctctacaaaaacttaaaataacgaactgggcttggtagtatgtgcctgtacttccagctacttgggaggcttaggtgggaagaacccttgggcccaggaattcaagactgtagtagactacgactgcatcactgcactccagcctgggtgacacagcaagaccatctctaaaaaataaaataaaggccgggcgcggtggctcacgcctgtaatcccagcactttgggaggctaaggcgggcagatcacctgaggtcaggagttcgagaccagcctggccaacatggtgaaaccccatctctactaaaaataaaaaaattagccgggcatggtggtgggtgcctgtaatcccagctacatgggaggctgaggcaggagaattgcttgaacctgggaggcggaggttgcagtgagccgagatcgtgccattgcactccagcctgggcgacagagcaagactctgtctgaaaaaataaaataaaataaaaacatctctctccatcatcatctccacatcttcctgacctctctactggcaccctcctccaaaaagtccaatcagtttagggtctgagtatcatctcagagcctgagatgaggagtaataacaccgataggagatggctaggcaggctcagagcctataaaggattatgccatctgaggaaaggactctagtgtgttctagctgactgaaaacagaaaaatgccaagtactaaaatattttaagaatgttatgagcatctgtaatgagtgggggtgagatgtaaagtacaaagagagtaagagctgggctccatgaagacagcattcagaaaacactaggcatagtgtttaagagcccaacccttggctgtgagctggaaggctcccctatgtttccttctgccatcaacccaaccaattagactatttcatgggagaaacagtatccctcctttcttctccctcctttcctccaaacactcacccactgttacaaatgaactaacaattaggagaggaaatgagtgtaaaccaaatgcaccaaaaaagaaattcctcagtgccattagccactgcaaaataacttcaggcccccatcacttcccatgcccaaaccagaaacactcattaatacaatctaacaagtagattcacatgagaagaactccaaaaggtaaattcaaaattcaaaacaaaaaattagagccatttaaacattttaaaatatatatatagagagagaaagaagacagaatcaggagttctgtgaggcagaggagaggggagtggcaatatcaacaatggtttctatgcgtgaaaggcccttcctaaacctcctaccatagcaaagctcccccggtctatcagatgaacagaattctagatttgttttctctttctctcaaaggccactgacaagaaagcagctatggtatattttccttgactgagggctggagactcaaaaacaaaagctatctgcccagccagagccctctagaaggttgctgggcttggggctattttacactggataagcccttcctgagtttggaagcatcaattagaagactgcggcaatttgtcctttacgctttatatcctacccattgccccgcactccctcacccctaggatgtacatagaaagtcgacactaggggcactgggactctcaattctagggtggctgggaagggagggaaagctgggccgagctctacttgtgacaactgatactacagtttcttttcccctgctgtcacccccttcctctccctatggccagcctaatgaacacctgtctctctatcctccattatttgcctttgtctgactgtctagtggagaggcacctggccttgaagtgcaagggagtcaaattctcctttcagtgcataagggagtgactgggagaagacaagagcaggattttatttcctagaagatgggtgaagtctttcttcaatctgtctccatgtgtatagagtcacatcttgcagaaggggacagttaaagaccaagacataggcttttttaaaggactcctgacctcataaagagttggaatttattgctctttgctaccctagctccccgttgtccttccacagaaggaacattatttctgatgtcctggttccctgggcaaagggtccaagcacaccggggcagggcaggttgctctagacagtttagagagctttgtcctttcccaccattgcacagcacacaccagaacaatgcccacctgaatccctctgagtacatgtgtgcattcagcatggagccacagctctttcaagaatcactcttgctatatgcagagttatcaaaagtcaaagtctggggagaattcaaggatcccagtccagtccttccccaacagttgcatgagtgtcaaaaggcactgtttgtccagggttggggtgaaaatttaccctaacccaggaggcagggacaacactgtctatatcagtgtttcccagtcttggcaatattgacccctggagtcagataattcttggctgggggtagtggggactatcctatgcagtgtaggatgtttagcagccactagatgccagtagcacacacatcccacctccaggcgtggcaatcaaaactgtctctagatgttgccaaaggcctgagggacaaaaccacctctgattgagaactcctggtctgtgagtgaagcagcagatcttccaccgtgtggaaggagcctatgtggattcaactaggtcgcagctgcaaaggctctgagcacagcaatgtgtaacagggaagagaggggccatgaagcccaggacagaaaatatcctccaggaggcaagaaagcaggtactcccaaaaagctatacctcagatgctgttggccttggcagtgagaagagttgataaaagtcagtaagtccattcttccggaacttgccagggaagacctagtcttcaaccaagtttggctcaagggtgtgttcccagggctgtggagttgtctctttagtaagcctgggtcacatctgtgctttctgaagccaaagtctagttttttctcccagggtgtggcagggtgggggaaagaacagccacttccatggcctacttagtgttctgccttgttccttgcccagcctgccccccaaccccaaattccacatgaaatttcatttttaaaaatccataaaattaaaagctgtaaaagggcaaagtaggcaggctcagctgtttagaaaagagaaaaagaagaatctggacaagagaaagaaggcataatatgggtgaagaggagatggggtgcatgagctgagagctttacaaaataacatttttagagcctgcatactttttaaaacacatacacacatgcatcaaaaaagtccataactaagctcagtaagtagggctccttcatcgatgttccagcaccacacctttctgttctgttttggtttgtaaagaaataattacaaattgttttaaaagcattcccaaataattccaatacatcgaaaactttttcatatagatgagaagctacgaccaccatgtctcttcaaggtaggggaaaagtacgttgcagttaaaaacaaaaagctttctttgcaaaagaagaaaagtttttttgatctccttgaatgtagcacacaaaaaaagtgatggttcccccaggctccatcagcaatagtaaagggcaggaacgtagagatttctttttccaggcccaggcctgtgaaaaacgatggctaagtgttagtccttagcagggccgacggatggtctccattcctggttaaccctctggaatctgggagcatgagtatctccaagaattcatttctattcagtaaagatggggaggggaatcctaaagaaggcacaagccagagaggagacaagacaaacatgagaacctgtctgacttcaggccgggctgagctgctgtctgccagtgcagccctccctgccccccagcatgtggttcttacccactgttacttgttgaactggaaagaatagaccccatgctctgagggtgcgtccactgccacttggttctgttggccgctgctctcctgtgccatagccaaggaggggggtcatcttgcgcattcctttcctcacctccactacagcagcctgaccaaagcccaccctacatcgagtgccctcccaaacctacccactctccacactcatgtgtgagtgtttccacccacaccaccacttccccaaccttcctacagcctgtcctcttcccaagacgcattagtcaatacaagccagcatcctggtgtcaactactggctggccaaatgtaaggaagggcctcattcatgaactcagaccaagtccttctttcctacatctgctgttgttttttttttaaatatggaacgcttcacaaatttgcatgtcatccttgcacaggggccataatcttctctgtattgttccaattttagtatgcatgctgccgaagcgagcacatccttcctacattcttcgtatacctaccagctatttgtgaacacagaatcagcatcattgtgagagaaagatcttgatcagggggaaacctgcctccgttcattttcctaatctcaatccaaagaaatgataacacccttacctcgactgaaacactggaagaaggcacaggggtgtactgggagatgtaagctccttgcatagctgcagccgtcggcatatactagaaagagaaacatcaacaggcttacagcagtgatttttggctacatttgaagcagctgaggggctttaaaaaaaatactgacacctgtattctaccccagagattctattttaattggtctgagcatttgcatcttaaaagcacttcaggtggttctaaagtacactgttagggagacgtctccctatatgacttattttcctcctctttcctgactttcttctgcttttcctcaacacactcccttctctacccttgagccctttctatgcaaaaaggaatgcagtaggcctaaaagaaacctaatgagcttcctccatccttccaggtactattttgatgaggattcctaggacgtgtgtgtatcttaaactaatatgcagacagaagcactattcacaaggtgcatgagtaggaatcagttaaaaggggtgggctggggagcagaatggctgtattcctggctcatggagcactaccattgtagtttatgtcctgttctgagtgtgccccggatgacactgaagtaattccatcattattcataagttacttacgctgaagagtattacacaggtatgccttgctcagtaggagagtttacaatcagaaatatcctgctttaccgtgcctgtgctgctgagggagagatggcccagttgctgggtaaggggtcccatcatggaggcaggctggagagaaatgggatggtccatccctggtgtcagaactgaaccctagaggcagcaacaaaggacagggttagctgcagcatcctgtgaggctgcctaaagcagtgatcggtggctgtcaggaccactggagacagacatttaagaatcctgggaaatggtaagtgagcagcaacccaactatgcaacaagaataggaactctgcctgtcagtgtggaaggaccctcgtctaagaataacaagcttaggtcttactgctgggttgcacaagggtctgagccagaactcacacccacatctcctggcatcaaaggccttttttttttttttgagacggagtttcactcttattgcccagactggagtgcaatggcacgatctcagctcactgcaacctctgcctcccgaatttaagcaattctcctgtatcagcctcctgagtagctgggattacaggcacccgccactacacctggctaatttttggcatttttagtagagacagggttttgtcatgttggccaggctggtctcgaactcctgacctcaggtgatttgcctgccttggcctcccaaagtgctgggattacaggcgtgagccacagtgcccagccagttttttctttacatcaaattgcctctttggcttctgcccacttctgaatactcactgaaggctgcatgaggtatgaatggtggtgcatccaggatgggttaggtacttgtagaggagatgtctgagtcactctctaaaacaagcaaaaacaaaaatgttaattgcctggaaactattattcagcccacagatctaataatgttcaacaaagctcagaaaagtttgaatgccccactcaaaatagaaacattaagaaaaactgtttttaaaatattagcaattcttaaaactcaataaataatccagtttaaaaaagggcaaaaaggagttcaaaattatagtgagctatgattctgacactgcactccagcctgggcgacagagtgagaccctgtcactaaaaaaattagtaaaaaaaaaaaagggtttggaaagatatctctctaagaagatatacaaatagccaatgagtacatgaaagaggttcaaatgcaaatcaaaaccacaatgggataccacttcatacctattaggatggctacaattattatttctattttttgagacagagtcttgctctgttgcccaggctggagtgcagtagcgggactacaggtgtgcaccaccacacctggctactttttttttttgagacaggatcttgctctgtcacccaagctggagtgcagtggcaggatctcagctcactgcaagctccgcctcccgggttcacaccattctcccacctcagcctcctgagtagctgggactacaggtgcccgccaccatgcccggctaattttgcttttgtattttcagtagagacagggtttcaccgtgttagccaggatggtctcaatctcctgacctcgtgatatgcccgcctcagcctcccaaagtgctgggattacaggcgtgagccaccgtgcccggcccacacctggctactttttgtattttttgtagagacggggtttcgccatgttgcccaggctagtcttgaactcctcagctcaagtgatccgcccacctcagcctcccacagtgctgggattacaggtatgagccacagtgcaaggccagcatgactacaattaaaaggatagaataacaagtgttttacactgccactggtgggaatgtaaaatggtgcagctactctggaaaatgctttggcagttcctcaaaaagttaaatatagagttactatgtagcccagcaattccactcctaggtatatatccaagtgaaatgaaaacatatgtccacacaaaaacttgtatatcaatgtttatagcagtattattcataatgatcaaaaggaaacaacttaaatgatgaccaattgataactggataaacaaaatgtggtatagccatataatggaatattattcagctataaaaaga

SEQ ID NO: 665 - DNA, 8864 bp, Homo sapiens
cacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagacttttgtgttttatttaaaaaaaaa

SEQ ID NO: 666 - protein, 1873 aa, Homo sapiens
MEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 667 - DNA, 102374 bp, Mus musculus
  misc_feature (1)...(102374): n = A,T,C or G
tgtgatctcaagagtagaacccaaatactaaaatttggcatcaggttccacccagctctcccctgtagcagctccctgctcctctatctcccttgcatgctctgcttttctttctttctttctttctttctttctttctttctttctttctttctttctttctttctttctttcttaaaggatttattcatttatttaatgtatatgagtacactgtagctctctctcttcagacacaccagaggagggcctcggatcccattacagatggttgtgagctaccatgtggctgctgggaattgaacttaggaccttcggaagagtagtcaatgctcttaactgccgagccatctctccaacccttctggtgagatcttatttgtgtatgacttccatgtggtggtgatgagacacaaagtcctattaaaatgaaaatcatggggtctggcttagtggcaaggttgttacttaattgacaggaggctcttgttaaatccatggatccattctgattcatgggaattcagagagatgggctaacagaggacgggcctgatatcttctattcagtgtgttttgagacccatgcatgttgttgcatgtggtcctggttcatttacattgtcagacagcattccattacaaagacaggcttttgtttgcttgcctgtgtgtatccatgtgcacagggacagaaagccccggaagtcaacattgtgtcttctctcaaaggcttcatgattagctttggtgttctaagtctacagttactttgtgttagattttgcatttggtgtgaggtgaggcatggggatatacttgttgaaagaaagaaaggggaaaggaagaggaggagaaggaaaaggaggaggaagaagaagaagaggaggaggaggaggaggagagccctttggagtgatgtcagcagattggcacagcaggaagtctcacctttttttttttttttaaattttatttattcattatatgtaagtacactgtagctgtcttcagacactccagaagagggagtcagatcccgttaccgatggttgtgagccaccatgtggttgctgggatttgaactcctgaccttcggaagagcagtcgggtgctcttacccgctgagccatctcaccagccccagaagtctcaccttttatcccttcacagaaacagaattcactaacaaagcacctttacgggagaagcctggaatccagtcaagagacagtggtatccaaaggacagagctgagacagactacactgaacccatcctgcatcacttctgagtctatgactttcagttaataccatcttctgcaaagaagcctccagtactctggtcccagacagatcccagagccaagtgatgtcccagatcaatggagaagaggaattaaagaacggacgttctgccttgctggcattgaggcacacggtagagggacacagggtagggagcagggggctcagtgcagagttggtaaacttgaaggaactgagagaaaccgaatattatctgcttttattatattgaaagatttagagggaattggcagaggctgcgttaaggaaaataataaaatgaaaaccattcctgggatcaaaatgtacaaaaccgtaatcaaaaagtaatgcacgtatatagaattttaattttaaaaatgaaatagcctgtgaagtctatttttgtcccatgaatctgtgaatccctgtagcaggaccacactgccttgagttctgtagcttaccagtccctgtgagattcagcagctttcagcactaagatacaatatgcagccaaatgttgggaatgttatttttaaaaatatattacaagccaggcagtggtggtgcatgcctttaattgcagcacttgagagtccaggctagccttgaactcagagcctttggctccggagtgctgagattaaagggcagacaccactaacaccatgcctggctagccattagtatctttgattccagttcctagtgtctctcttttggttcccttacttaagttttagacaaaaatgaagtcattgcattgctaaatttgtcctttgtgatttgccttcctgatattttctccaccatttcttccactcctgccccccaacatcttactcagctataccaaagtttccattgtcttcttctccttttcctcctcctctccctcctccttcttcgagatttattttatgtatttaagtacactgtcttcatgcacaccagaagaaggcattggatcctattacagatggttgtgagccaccatgtggtttctggaagttgaactcaggtcctttggaagagcagtcagtgctcttaactgctgagccatctctccagccattttactctgttaagcttaaatttcctcgtacccatctttgcctgtctctagtctaaagcacacattcttcaggtcatcgcctgtcatccccttcctcttttgccacttcagctgagaccattagcttcttttatcttgaccccttagctagagctcttatctccccctgattcccatggcctcctctgtgaacttcactgcagacataaaatgtctgagttataatagccagttacctgactgagcatccccactaacctgtaagttctggaaaggcagtgtccttgttcttaacccttgacccgaggggcctatcatcatgctggggcacataagaaatgtttagtaaagaaatggaatctcgccgggcgtggtggcgcacacctttaatcccagcacccgggaggtagaggcagatgggtttctgagttcgaggccagcctggtctacaaaaagtgagttccaggacagccagggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatggttaataatttggtgaaggaggatatcctttcccaaaacagctttttgagagcctatcaccattcttggcagcctggtcatgaacttcagaaaattcttacttgatttttcccgttatagattataattcaattcaaagtgtatgaagaggggccgtcttaaggaaagtggaggagagaagacactgagagacaaagagaaaatgaatagtgaacattgtagtaacaccacagagagaagatgtttataggctcatcctacagagaggatgctcacactcatccttctcctctacccagcagacatccctggtgcagccagtttcctcaccagtcaatcaagagctgaggctgaggaaaaaaaatcctagcacttgggaggcagaggcaggcagatttctgagttcgaggccagactggtgtatagagtgagttctaggacagccagggctacacagagaaaccctgtctcaaaaaccaaacaaacgagctaaggcttggggggtaggcacatgcacatgggaaggggccaggggagcatgggggggcattaaaaagagatgaggaaaaagtctctgctctaaaggagtttatggtctggtggtggacaaaggatccataaaattaagtgctaaactctagattccaagaccatgatgattaccagtgagatttattctgtttaagataggattttaccaggtagcccaggctggtgtggaaagcccccttgtgtccctaaccgtcttcaaacttctgattctcctgcctctgtttcctgaggttttggaaaataggctcgtgccaccatgcctggctctctgagtagctcgggaataacagcagagcttttcagaggaacagagtcacgattggcttggctagagagagataagcattctgccttctcacaaagccaatgtcagctgttcatataccaggacaaactaagcacccagccatcaaggagcttcaggaggttaatatgaaacatggtctgggtctgtacagatagcgtggaatgagctcaaggcaagctaaggtgaagaacgtaagctatgaaaccgtatataccagctcctctgtgactttaaagggtattatttgtaactgtacaccgctaaaacaaacaggcttccttgaagacacttcttcttcttctttttttgtttttgtttttgtttttgtttttgtttttttcgagacagggtttctctgtgtagccctggctgtcctggaactcactctgtagaccaggctggcctccaactcagaaatctgcctcccaagtgctgggattaaaggcgtgcgccaccaccacccagcttgaagacacttctaaggcatattcctagtggtttatctgagggtgaggccagaagtgggagtttaagaagtgacaagtttaactgggcatggtatgacgtacctttagttccagcagtcatgaggcagaagcggaggcatttgggtctctgtgtggtcaaggccagcctggtctacaaagcaagtccaggacagtcaaggctacacagagaaaccttgtctcataaaatcaaaaccaaacaacaacaacaaaacaaaataaaacaaaacaaaacaaaataaaaaacaaggaaagagaagtgacaagtttattttcttatattacaagttttactaataattaagtatcaccattttttgtaatgcaaagttaataaaaataaaaacatggggctagagggatgatggcttagcaggttaatagtccagctactcttccagaagacctgagttcaattcccagcacccacatggagactcacaactgtctgtaactccagttccagggactccagcacccttacacaaatagacatgcaagcaaaataccaatgcataataacaaaaaaaaatcattttaaaaaaagaaagaaaataaattaaaatacattcattggtattcaatagatagcacaggcccagaacagcggccgagggcaggttctggatcgccatggctgacggaagagctcacatttgacccgtcctgttgaatttccattatttctgttacaattccagcctaaactactagtattcccctaccaccaccttttctcatgccccctgtgggtatacacatcttttttttcttatgtaaattggtgtgctgcctgcatgtttgtctgtgagggtgtcagatccctggaagtgaagttacagacagctgtgagctgccaggcgagtgctgggaatggaacccaggccctctggaagagcagccatctctccagccccctcctctaccctcttttgagacagggtctcatgtagcacaggctggtctagctctttctctatagccaaggatggcctctgattctccaccttgctcctttagcctctacctccttggtgctgggtttacaagtgcgtgctactgcatacagtatacagtgctaggctttgagctcagggctttgtgcatgccaggtgagtgctcagtggtctgaactacatcccagtccttggaagaggcttcctaagaggtggcaagggtgctggaggcatggcttggtggttaagaacctgctcttccaggtgacaagagttgtgttcccagcacccaagttaggtggtggtggcgtcagctcaagcaggggacctgatgccttaggtctctacatactcacacatgaatatagttaaaaacaataaaaacaaaaatcttttaaaaattttttttagaggctggagagatggctcagaagttaagggcatttgctgttcgcccagaggttcctgagttcaattcccagcaaccacatggtgtccttataactatctgtaatgtagtctggtgccctcttctggcttgtaggcatatatacaggcagaacattgtataaatatctatctatctatctatctatctatctatctatctatctatctatctatctatttaacctgagtgttctgtctgctcatctacctgcataccagaagagggcatcggatcccattacagatggtctccagccacaatgtggttgctgggaattgaactcagtacctctggaagagctgtcagtgcagtgctcttaaccgctgagccatctctccagcccccaaataaaatagtctttaaaaaaattttttttattcatatctgtgtgtagaagtgtgcacctgtgtgcaggtccccatggaggccacaagaaggcatcagaccctttggagctggagttacaaacagttatgagccaacccaatgtgtgtgctggacacttaggaccttagtaagaacagcaagagctctgagccatctctccagccccacgtctcttttcttttctttctttcttttttctttcttcctttttcttttcttcatttctcttttcttttcttttttaatgtggttgttgttttgaagggtagccactgagacaaagaataaaaggatgagtgttatcggaaatacccaggacaggtccatggaagagacgtgaggtgagaaggcttcaggaagaagattcatctgtgtaagccaagcggcaggctcttagccttctcaggctacaagctgcatggtagctattgatatcttttttttttccctgtcaacgttgcctgaggtcagtttcaaccagattttgcttggaccacaatattgggtggagacctagcagaagcctgtgagcatccactaaaaatatttagtgactccatgcctgggcctggcactgtattaggccatgggaagctggataaaagaataacagaccacccctgctgagagaaaccctgtgctagaaaaaaaaaaaaannnnnnnnnnnnnnnnnnnnaagaggaagaagaagaggaggaggagaaggaaagaaagaggaggaggaaaccttcagtatatttcaaaaggaagaaagacatcaggcctctacttgagcacaggctggaaactggacggaggaaagatggatcctgagagtccagcctgggagactatacagttagcctgtccgtgagccgcataagctctcattgaagaaaggctctcagtcattaatggacaagtctattttctgccagtgacaggctggagtgtgtgtgggggtcactcctgtggagttagtgtactggtccctggtctttaaagttcatctctagccagggatgtcgcctgctgagctttccagaactttcacttcaggtcacagagaaagtcagacactaagggttacagtcttcaaacgtcgcccacaagagggcagtggccggaagcacgttcgccggccctaggaaccgcccgatgctttctggactccagagtaccgttcccaaaccgactgagactggggacaaaggtccggcactcagcacacagccccctaggactggtgtctggtagcggagctctggagtccttcattccaactccctgtagtttggcatctgaaaccctgacttggtgggaggccagtcagaaggtatcaaaaacaaaacaaacaaacaaacaaaaaaatcgagcctgacctctcagggcgaaaggggatggctctaccccaaccccaccctctggtgagtcacctctctccaaaccagagcctgcctctcctgcgccccgtgccaggcgagcagggctgggcgggtactaaggtgggctccatccctgagcccaaggcgggccgacaagctgcagcgtgtccccgcgggtgtccctgtttactctgagccctggagcgaggtgggggcgggtccatgtggccactccttcactccgcctcctgaggacgcaggccccaatcccagaccggttcttacaaagtctccaaatcaaagctcagcctttcccgcaccttcccggcggaccggccacccctgcccccaccctaggctagggaggcactgtctgggtttccccaaggaaatcaggcctccgcctagacagcggctcgggaccccactgaggggatctgaaatcctggggtgtgacatagagttttaaagaggcactagagcgcagctctccttgccccttaccccattcccacccttggctctaccggctctagggagcgctgggatgaggtagacgcagttagaggacagggtgcccggggactcccactctcggaccgcttcccagaactccaaagcttgtagcgcctccgactccccctccccagggcagcgcgccaaatcagcgcatgcgcactgtcaggattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattgtgcatttttgcagccggaggcggctccgagatggggctgtgagcttcgccctgggagggggagaggagcgaggagtaaagcaggggtgaagggttcgaatttgggggcagggggcgcacccgcgtcagcaggcccttcccagggggctcggaactgtaccatttcacctatgcccctggttcgctttgcttaaggaaaggataagaatagaagagtcggggagaggaagataaagggggaccccccaattggggggggggcgaggacaagaagtaacaggaccagagggtgggggctgctgtttgcatcggcccacaccatgctgaccccgccgttgctgctgctgctgccgctgctttcagctctggtctccggggccactatggatggtgagtgagattccggcggcccccatggacccctgggggctcccccctccccaacccccactcctgcgtctggatggggaagggagacgcgggagggggtgccttttgttatcccagtccagctgacacagcagcggcctgactgggggcggggatggggtctgatttgggggatgggagcctgggacaaatgatgcttccagggccccccagctcagacaaagaccagaggcctgggtaggaaaagagggctccccctttttctgatcttgggattaagaggccttctcttcctatctctggtacgggagggcctctgcctcccctacatcctccaccctcccgcccccccacccccatctgaattgtgaaggaatccggatttgctgtgtaccgctgcaaaagggggcggagggccttttgcagtggactctgaaggctggaaggcaaagccggctaggggtgccctgctggccaaagggcaggcaggccgagaaagctgtgggtggggataggcagggccccctgtttgggtgtggaatgagccctgcatcccaggcatggaggcccgggtccagaatcctgggctgcctgcctgggttccgaagtgagcagctccccgctgagggcctcagtcaggagcccggttgagggatggaggggtctggtgacgcttatggctggctttcccttcttaattcctgggagctttaagatgagaggaaaaacgtcagatgtcatcattctggaagagactggagaatggtctggaacgctggggaggggttcagaggaagctctgtctccccgatttcaggcttgatcacagtttgggttggaaggagagttggaggttgggatgggggttatgaccatgcccccaatcctgctcatttagtaaatgtgtaaagcccagccctgtctcacttcatacatacactttgtatattagttaggtttgggctgctgtgttgttttgggggaattgcatgcccctcgtccctatttctgtcagctgtttttcctcttccatgagtccccagttcaagacttgcccaggcttcacgctggggtcatggggttgaattgggctgggtccctaacttgagaaggggtgagattttgtgacttcctgtcaggtttgcctctcactgaggacaacagcttcgtagcatcttacagccctcctctgccttcaagagcttgccaggccgggattgggaaagtttttctctgaaactagattatgtatcctcccccacccctgtctctaacttgtttcagttgtgggaggaggacaagagggtcaggaggcagctgtgcccaggaaaacagtttactcagtggccttcagtcatgtcatgtcggggactgtcttgtctagctgccacccctaattttctgcctgcgatgaggaaagagactttgccctgtcaggcaagcctgtgcagccaccctctgtccttcacatctaacgtcatcccgtgctttcttcttggtctcagagctgggatgggagaagaagggaaactgaggcaaagagctttgggaagaaaatgtattaagcaagaaatggacctgccagaagccctgtggaggagggtggatggaatcaggtagaagggaaagatgcccgtggagatgtgtggctcattcagtgctgggtcctgggaagcagaacccccaagaccctaaatgctgggctaagttgataggtggtcattgaatgaggaactctgacacgttccccttaactgtctctagccgcgtacctctaagtctccagttcatttcagctctgcacacagtttctcagggctgggataaaggtcagtggtagggtatttgtcctagtgcacgggatgccccctgttccatctctggcaagaaatacagtccgagagaaaggactacctcctggggaggaagagagaacctgtagaaaagtagaccccgtgcattctggagctcttagccaggccctctagacactgaacattcgtcttggctttctagagaaggacccttctgcctcgacctacctaacagttctaattgcccttcctgttgctcaggaataactctagggaccgccccatactctcttccctctgtgtctgaaactcatccgggagtcctttgccttatggggtgagaggcttcatttcctcctggtagacacatttggatacatttgtagccaaggaggatggaaaaggcagagaaggatcattgacagccctgctgagatgggacacttcgtggtggaggaacttgacaggcagccagctcagggaagacagctgacttctttccccagctctctcctctccagcgtgagccggcatgttagtagttgctaggaaaggtggacagttgatgtgagttatgaggttgaagtgtcagcctcctgtcttcctggagaacgttccagttctctattccccctgttcagatccaaatcctaaacatcccttcttcaaagccaggcacgtgtaggaaattcattggggctattattttgatgttgggggctacttcacaagacttttttctttttcttgttctctgtgcttttatttgttttattattctctatcacctgcctttactgggccttccaaccttgtcaccccaggcccagccctaagtcagatcctttccaaactcataccctcttcaaaccccttcctggggttgggcacagctcggtgggggacggggtggcagggcacacatagcatgcttaaggccctggattctgtcccctgtaccaacaaaacccaaatcaaccagccatcgcttactattgcaaagaccttccttatccccattttactcttaattgcaaaccaaaaatgtattctctcacacacaccctgaattctcttctgggggtcttccctgccccttggattctttaccctgcctgtgatccaggtctgagcaggagagcttgcttgtccttggggaacctgggctgttgagtgggaccatgcaagggtcccagagttggtggtgacttgtgccagggaacctggtcccgcctcctgtgttctgtcccagatttcagcctggttagcaggatcctgcattgtttggagaaggaagcagttggctctggagtgtttcccgtgctgcgacctcatggcaccagcgcagagcctcccagaaggtgctgaggggcagagagaagggattcttcatcacactcccatgagatgacaatcccatgccctgacttccctggctgaagagtttgacttccatgtgtgttgtgtggggattgggggagacaccctcccactctgttagagacagcagcctctaacctggactcccattagtcaaaatgtttctgatgctgggactttgtctcccaaagccaggatatgtactgccctccactctgtcacagggagagggggtcattttctgggttcaccccaggagagctgtgtcaccctctgggcaacctctgccctgagcccacttcctgtcttttttggctgtctgctttgctgtgtgtctgctctgtgtctctggccctcttggttcctaccctttgcagcctttcagctttgattgttctcagtcactgtcttaatttcttttgtctaagtctgacttctgtgcagtcccctggatcttgaaagctactggtagtggtatttctcctgggctttcctgcctgtcccttaccttcctggacccagatggtcccctccaacttcctctctcctaaccctcctcactgattttgggaagtgtcattagggcacatatttctggaacaacaacaacaaaatgaaaaaaaaattgattttttttttttttgatgttgttgttgtgggctaaaagggaggactggaggtatttcagaaagaaaaaaaggaggtgagacttctagtagaacttcctcctaatggaaaagacctagagaacaggtcaggagcttaggtccttaccaccagtgagcggtgagcgcaggccatgtgggcatgggggagggccaataacggactcagccttgggagaaagaggttgacctccgcaggcattccagtggatctggattttatttgtgggggaaaggaagagacagggtcgtgggtcaggctgatgtcctgctgagtcaatattgactcaggattgaagggtagacccttctcttcccctggcggtccaagccaccctgtctgtccatctgtcccaggccgcagagcagggtttcagactcaggaatgacaaaaatgtgtctgaacctcactgagcaggaaggagccactggtaacacccaaaatacataaaatttggggaaagctctgtgttgggcaggaggccttccctgcctggctctcctcaagtatttgaaagctcagattcctgcagtctgtccccagctctgcttgttctcttagcttagccatgcggtttctcttacagaatgtccccagacctattagagggtgcctagccctctctctaccctgtcactctccaagtggcccagggtcactttcttgctgttccagccttctgtctcctgtccttcaggaagaatgcctggggctcccaggggttgttgaagggcaggcactgcttctttggaaagtctctgtctgagactatactttctcccccttccctagccaagcattctggctcctgccaccaccctaccccaaggtcccagagtgggacagaagagatagccaaggcttgagccaggcagtggggtctgtgttgtgtctggatacacacccaaccccacacctcctggcctgcctggctccagcttggtggccctgggggccttggctgggctgggtgcctggttggggaggggcagggtgttggctaagttagcatggcggtcacatctctaggcaaagctgagaacagacgcccctgtgtccccgtgctccttcagctctctctccctcctccctctctccagcttctcccttaggccccagccctcctctgtcccattcttaccccactcctccatgccctcctccccagaggctacccagtctgaacaatgtctgttgccctccctctgacagggaccgatgttcctacctcttctttctcagggttctctgtaggatagccactggcaagcatctcgtagcctgacagttggaccccagggcttcagatctgtgtatggcacttagtggtcacttttaaagaatgttcattgccatctggtgtgggggacggtgaggggatgggcagggaccagaggttggtcaccaattcctgacccacaaagacaggttttctgagtgtggagttcagatgcacaagactccactaaggacatctaggttggcttggcctttaaagagattatacatttcctcctccatcccactccctcccagctccctcccagcctggaggaagcgtcacttggctgtggagactgccccaaagtaggttatgttatgtgttttccttctccccctgaaggaaatcaaagacaggcttcagccttctcactcaaaattcctagggctttctccaccatggccgacaggaagtcctttcacttatctctctccaatccttctgctatcctggctctcctgagagacccacaacctccccctccaccaccacccccatccaccctctgcccctgggcctaaggagatggtgcaggatagggtctgagccctcctcttcctttctgggagggagggagggagcccatcccccacggccctccacaagagcacatctggtttgcgaatctctcatttcagcttttggagtttgccagctgctgtttcctctgtcaaattcaggccaaaaatgggggtggggggggacagtgggggaaccatgtgagggccaaaggaggggatccatggctgggactgggaagacagaggaggtcagagcgaccagccggtgacctcaggccctggctgtgagttctgccacactgggagtgtcagggcatgggctcagccccaggtgggagagggaagacgtgtcattggcctgggtatcttggggagggggtccgctctgaactccaaacacccccatctgtctctgaatcccactgtggtccctctctcccccctcaggccgcctggctggccaggggaagcgatggtctccagcatgctaactaggttggcagggctgtttccccgggaagacctcacagctggcccagtggggcaatgaactcagcattatccacctcctcaaggggcctttattcccggatcagggtgggagggagggagggggactccaagggggcctggccaggccttccttgatgtgtttcctgaactcagctctgatgctggccaggggcctgggtacagtcccctctgccagagctggggatgagggagagagggacatttcagtgtggccatcagactccctccttcggagccctgacacacttttcttactctcctgtctcagcctgagttagtactgtgtcgtctccccaggaactgtaggtctggaggggtccatggcctttggatccatcacagtgcctagttcagtgcctggcacaaaaccggcctccagttctgtgtcagggaaacagaaccgggctttacccagcgggagaaaaggtgatagaagctgggagaggagattcctgctctggtgtggattgaaagaccccacccccaccccatgcaggacatggtgactggaacagatgggctgcctccccggtgagggctgcactctttaagaacctagagccctggtgctaaagagatgactcagtggttaagagcaccgcttgcttttccagaggtcctgagttcaaatcccaccatgcaaaggcagcttgcacctgtttctaactccacttccaggggatccggtgcctctgtgctctcctcaggcaccaggcaagcgtgctacccagacagcagtgcaggcaaaacacccatacacgtaaaacttaaaaagaaagaaaggaaaaacaaaacaacaaatgcagatttggctgaactgggttgagtaagtcctggtttgtcactttataatcctgggcaggtctggcccagaaactgtgggctagccttccctcatatcaacttgtggggaagactaaataagacggcacacggaaagagctagtttatcactgtctgaggctcccaggactgccagctgtctttggtgtagctcctcactgggggatgaaagggattagaaccaggtggtccctatggatataatcactccataggtgaggggcatcccagttagttcctagagatcaagccagccagcaccctgcctctgatgggtccttcttatccagagaactcccccgaaagctgaagtttctgcccagctgccctctgcagataacatctccaggccacgctgtgtgccaagggcagctccccagttctcatctgggggtccagtggtaaggagtaggagctgggtgatataggtcaagaggccagtagtgtcctgaggtcagaagcagaggttaggaaaggccagctgctggctgtcagtgggaacaagaggaacatggaggaaaggcacagcagagggctctgccctgccccgccatcatccctggcagggtgaggggtgctggtgtctggtgtggtgacaaacagcaaggaggtagagggacatgctgtacagacaacctagaaaacttgggaaggggtgataagatcctcttggctcctccagtgttccagacctactgtatagagaggatggatgctggagaagaacgagccttaggaaaccccagggtccaagagttgacttctgtccttccttgacatctaccctttctttccttgcctccagcccctaaaacttgcagccctaagcagtttgcctgcagagaccaaatcacctgtatctcaaagggctggcggtgtgacggtgaaagagattgccccgacggctctgatgaagcccctgagatctgtgagtaccttcccgggcttgctctctccagataagagcagccatctctagcctagcatggaccttgctctgtgcttgtatttgcccgtgacacagctaaaagtgtagccgcttctccggagtgcctgcagggtgcctggtgtgtgtagcagcagcacctgggatttctcctttggctgctacgtgcccaagactattggggacagtatcctctggggctgcatctctgtctcggggagataaccgcgccaccctttccttcgagcatttcctctggctggtgctcactgagcagcctccaggtcttgccaggtaccctgctgcccttagtcccaggccaaaggccactgccctgtaccagaagccccacccctgtgcccttcccgacaccctcccctcccctgcccccaataagtggtgtaatcagaggcagctgtttaaactgggagaaaggtccccacccagccttcacccatccagtggccaggatggggaatggttcatagggtagaagacttgctgccaagaccctagagtcctggggtctccacccagtgtctcccccacatggccaatcctggccaaggtcttagcatgctcagggcttcatctggctctggtcctatctgtgcccttttcccatacctccaaccatggttatcaagggtaacatgtagggtgggaatgaaggctcctgttttcttccctaccccagtgtcctgccctgggtgagtaggagccggggtattagacctgtagcctcctcctggctaaactacttcctctccacacggttgaccccctgcctgtgtgatggaaggacagaaaaccaaggagaagggctgggtcacactcttgttcattcttctttctgtttcctacaaatctcatcttagataattcccaaataacagaatcacatagccccatctggcccactgacccgacagaggttctgacaggtttatatagcccatgtggatgctcccaagagtggccaaagaaacactctgacagacgcccagacacgtggacacaggggtacacacaaacccaggcagggtcacaaaatggaaactcccttgcccacaagccactccctgcacaagcagtgccagtagggctccacccacacagacacaccctctcctaccttgcctgttgggaccattgtcttaccctctcgtccctccacctggttaccatggtaattaagagggatgtggtcagtaggccacaactttggacctctccagatccttttgtagatctttgctctgggttgcaagtctagaataatactgttgaattgaaatatagtataagtcacatacacggttctaaaatttccaagtagccacactaaaaaaattaatttgagtgcttttaccaaagacacctaaaatattgtttcaatatactaatgctatctgtatgaaattattagagatcgtttgccctcctttgatatatcaaaaactagtatatattttataagcaattttaaagatttacttaattttatttatatgagtatactgtagctgtcttcagacacaccagaagagggcatcagatcccattacagatggttgtgagccaccatgtggttgctgggaatcaaactcaggacctcaggaagagcagccagtgctcttaaccgctgagccatctcttcaacccctataagtagttttaacttaatgcacactcacagcatttgagaaccacatatggccggtgctgtgtacatgagttgactcacttgtagacccagctctgctctctgagaaccatacaaaggtggtttgtgtttgtttatcatttgagctcctttctgccagggactatgtttccttaacgctcatcaaaatctttcacttctgccttctgcctgtctcccgattacaggatgttgaggctggaggttccctaagcgtggtttgggagtaggccctagctctcccctctgcacagccgtccccagatgtgtggctactcttgtgagcagctatatgtagaagggtccgtccagtccctaaacctcttgagatctagaatgtatggctatctgaaatgccaatcttggcttattaaatctatctacccagtacagagacgactagacagccaccccaggcagcctggtcatgccgtcacttctgtttgctcccaggtccacagagtaaagcccagagatgcccgccaaatgagcacagttgtctggggactgagctatgtgtccccatgtctcgtctctgcaacgggatccaggactgcatggatggctcagacgagggtgctcactgccgaggtaagggctccccatactctcctgtgccaacaatacaagatcttttggcttcgtgtctggtgggatgaccagtttgtgatcgaggaccatctttgagctttagtgtgtatgagaccttgttctactctcatgcccaggcttgcccggccctttgggcttggagattgatcaaagagccctaagggcttcagccgtgggcctgactgaccactttcctctggctgtgtgtgcttagataagtcactgcctcttttcaagtccgttctcaactattcagcatttttatactgtttgtttttaattgtggactccttcaaaagctttcctatctgactcctgacagaggattggaggtgctgtgctcagagctggggataggcacagagggagagtttgtgaccctccagaactgcaaatctgggaggggcccggaagccactctgctccttcctttcccggcagcccatacattctcagagctggtggctgggggaggcagttcagtctgaggagggaacactagtgataagtcatacctcttagctgtgtagcagcttgagaggaacccatggtgtgggtagtgacaaagcttcaggcctagctcttagagaaatagtagcctcttttcttctgccctgggctctgggcctggagcaagcaacgtctgacagaccttgaggaagacagtcatgggagtcggggtgcggccagtgtcgtatgtcatacacatgtcagaaaacatctgcctgtgggaggcggcacatctggatcctttcactccggcatggactgtggagcaagggaatttgtgggggatttttcccctcctttctttttggctgatttcatctggagatcctggaaagagatacagaaattaagtttagggataacttcagccccgtgaccaagcttagccaacagtgtgtgcccaggttcaattccttctggaatacctttttagttacagaaacaaacaaacaaaaacttgactttgaacctcccccaatattagagaagtcccccaacccccgccacccagccccaaaccaagacgtcttttctagattttccacagcaggcaatgttttcttccttggcaaaagacagcgaaggcggtacatttgggctttctggtcagagaagggcagaaggagtaaccgaggcccacctccccaccccagctcctcctgccaggcttagcgccttaaacaccttagcttctgagctgttctcttctgtgtggaggagtggggcacttggacaaaggggtctttgtggcttagttgcccagccccaacaagcccttaattgggtcgctggtcttgggggggctgttctcgtacccctccctgccctgcccccgtcttaccccttctgtctcccctgtggaagtgggtcatggcagaaggaagaatccattttactccccctcttcatcctccatctggactctgggtcttccctccgaggcccccagaactcaaagctgacttagaagagtacttttaggccagaagacaaaagcaaccgtgtgtctgtccattcttcaccctcagctggagctgatgtagtaactccctttgggtacaaacacaaggcacacaaaagggacaagattcactgtcccttcctgtggatcccagaacccatcctagggtagacacagatatactgagtgttggggcaggaagaggcgggtgacaagccacagttggctgtgaccctgtacctgccgtgttggccccttctgggctttgcaaaaatactatactgcacttgcttcctcagccccctcgctctcagatacaatggcctttacttcaatgcagtttgtgaagggtgactggaaatggagggggtttgctgtcttgggataactgtgtgtctggggtggttgctgtcctgggatggttgctgtcctggggtggctgtgtgtctggggtggctgtgtgtctggagtggttgctgtcctggagtggctgtgtgtctggggtggttgctgtcctggggtggctgctgtcctggagtggctgtgggtctggggtggttgctgtcctggggtggctgtgagtctgaggtggttgctgtcctggggtggctgtgtgtctggggtggttgctgtcctggggtggctgctgtcctggagtggctgtgggtctggggtggctgctgtcctggggtggctgtgagtctagggtggttgctgtcctggggtggctgtgtgtctggggtagttgctgtctcagggtggcctgagtgtctctcttgtcccgtgcagagctccgagccaactgttctcgaatgggttgtcaacaccattgtgtacctacacccagtgggcccacgtgctactgtaacagcagcttccagctgcaggcagatggcaagacgtgcaaaggtgcgtaaacatgactgtgtgggtagggtgtgtgcatgaggaggctggctgcaaggtgggctggagcagggccgggccgggccggggggggggggggcaacaacaggggatggcgtggtccaagaggcagtcaacacatagtgtggctacaagccctcagcattgctttcagcctacccttaatatacatgcctccaaaagttgtagctagcgcgtgaattttgctgtcaacggtgaaacattagcccgacggcatggcttgcacctgtaactaccatatttggaaagctgaggtgtgtggattcctgtgagttccaggccaacctgggctgcagaaggaaccctttctccaaaaagtagatcacgcacgctttacagataaaaacacaaagctccttcgcaaagtttcttcaattccgatgctgttcccctcttcctggagggcagacctcctagtcatgtgtgtgctgccctactgcaagcctcctctcccgcccccccccacccccaccaaaatctaattggaagtattgcttgtgtgtgtgttctctttccgtaagtgatgccacactgtgggtataacttacagtgtttctctttagcgtgttccagggatttccccgccccccatccctggtagtatgtagagatttatctcattcattaaaaaaaaaaccactgtgacgtgaatctatgaccacagcttacttggccatttccctgttgatgagtaagatgttcccaatgcgaacttttctgttttaaatggccccaagtctgcacaaatctaccttcttgatgcagctactctgacctctctaaatcatactcttgtgacctgcctttctctgcctttctctctctgtctctgtctctctgtctctctgtctctctctctgtgtgtctctgtcttgtctgtctctccgtatgtgtgtcttggtctgtctctctctctctctctctctctctctcacgtgtacgagtgttttacctatatatatgtttgtgtaccataagtatacctaatgtccatggagggtgttggatcccctggaactagcattatgggatggttgtgagctaccatgtgggcactgggaatagaacctgggtctttgacaagggcaccggtgttcttaaaccattgagccatacgtctagaggtctcttctgtatttttttaagatttatttatttttgtatatatgagtgttttgcctacatgtatgtatggtaccacatggagacttggtggctaaagaggtcagaagagggtattggatcccctgaaactagtattccacatggttgtgagtcaccacgtgggtgccgggaacagaacctaaatcctttgaaagagctgtaagtgttcttaaccactgagccatctctgcagcccctgtgacttttattttaatatttatttatttatttatttatttattatatgtaagtacactgtagctgtcttcagacactctagaagagagcatcagattttgttacagatggttgtgagccaccatgtggttgctaggatttgaactcaggacctttggaagagcagtcggtgctcttaaccgctgacccatctcatcagcccccgtgacttttatttttaatgcagatctagggatcaaacccagggccttgcatgtgtcaggcgagcaccctgctgctgctgtatgtaccacagtccttcatttctgttatcccatctcctctaacttaagctttcccttcatcataacaccaaccttccgtttatcaccagaatgcaagtttcatgaagacagtaatgcagctctgttttcaaattcatcattgtattctctacctgccccatctgttatccaagaaatgttttccaaatcactgtcagtgcgcatgacccagaaaatcccaaaactgtttgccgggcagtgggtttgcaccttctgaactgtaatcgattccgccagttgtctgctggtgtctcggggcacctgtgctacactagaatgaacatctcctcttccttttctctctgggcagattttgacgagtgttccgtgtatggcacctgcagccagctttgcaccaacacagatggctccttcacatgtggctgtgttgaaggctacctgctgcaaccggacaaccgctcctgcaaggccaagaatggtgagtgggtctgccagtgaccacagagccggggacctgcaatgcggctccccagtgaatagtcgcctcaacggttacaagtcccaactgccctttctctgtcccatccccagagccagtagatcggccgccagtgctactgattgccaactctcagaacatcctagctacgtacctgagtggggcccaagtgtctaccatcacacccaccagcacccgacaaaccacggccatggacttcagttatgccaatgagactgtatgctgggtgcacgttggggacagtgctgcccagacacagctcaagtgtgcccggatgcctggcctgaagggctttgtggatgagcataccatcaacatctccctcagcctgcaccgtgagtcactcagagggcagggaagcgggggagacgggcagagtctgagaccaggtctgtgctccttgcacacaggagcagattggtggctattcttccttttcactctgagccggctctttcatttctggttcagggctaagggatgcctcagcggagaagtgtcaactgagaaggccacgaatggtcactctccagagaccagggactgtcccgtctttgaaagcagagtgtcattagatgcagaggggctttcccatacagaagcatctgcaggggggctggggaaggacggacgttgttaagtagcagagggcagaggagcctgagcctggcttgctttgggcttccatgtgattttgttaccctcaggagtatggccagaaaggacgtcctgctgttgggtaggtgccaagtccctgagcctacttcctgtctgtggcagtcaatgagacgaagggacgaaccacgggccactggagcatttaggatgtgctggccattcccatgcaggcttctcttctcttccgaggcaactttgctgtctaagcgtgaggaagggtgtcacaggctggactcacgcatggctgggtgcagatcccctctcgtgctgttacacaaacaaacagtaattgcttcagagtcaacagctggccgagtcacattccccgaaaagccacacagggctgccgggaggggtctggcctgtggttggtctgtccccagccctcagacatagatctctgaccttgagtaaaccagagctccccaccacaacttagttccctaaactgcgtaatgggctgttgttactctgtccagatctgataaagtgcaaactggtggtaaagattgccttgctaatgaggctgagggcgatgaactgtggatcctatagcctttggttcttggtttggtttgttttggtttggtgctaagcaggcatcctacggctggctagatccccgctcctgtagtaggtctgtaagctcttcttctaggcctgtgaggctccctcgaagaaagccaaggtcccatgaggttataaaggattcagtttgattgagggtcctttcaggggtgggagagagggcgatggtggaaaacagagcaaatcttcctctctgtggcctcaggatactgctcagacatcaacctctagctctgcagttatcagtgtccaaggttcacctgtgattgggtgtctgtccttctggagcgcacagcagagaactgccagacacctttgggataggtagctcaaggagccctgtgtgctgagactggagacaactaccctgcctgtgtttctagttcaccatcccactcaacaggcgtgcttgggcaaagagggttagcaatggcagccttgcctcggggccagacatgggtataccgggtaggtggctatgatgtgccccctgggaaccttctcaacttctgccctggcctggccattcttccccaaagaagcaggaagtaaccttgggtagcgacacccctcccttggcaaacagatttgccttgcctaccaggcttcaggacttcactgggcctctggggcagagtccaggaactctatctggaagcgaccaaggtgcttggagaaaatcctttcaggaggaatgattgggttccatttgccccagctcccgtccctccctacctcgtccccacccccactcctgacgccagagtgtctggctgtcaccctgaggatggtggtttgctcacatcccacaaactaattatgggccctggcttgaggatgtcggaagtgtctctgtaacaccctcccccacccctggtacatccccttcctcaggaggaggccttccctggggtcagggagctccaggggccccggttacatacctgcacaggggctgctgttctatagttagttctctggagaatgaaggaaaaatccactgccttctgccttccatcctgcagccagatcctcccaaccttccccatgactgggacctctgtgagacccctgggaacatacctaagtcggtagggaagagggtggggagggggtcaggaggttgtcagaaggttggggtgtgtatcttatgactgagaagaggggagccagtgaggacatccgactggtgcggggagatgggggaagcctgcctcagagagacctctgcaaacagaaataaatgtaaagaaggaaggaagctgggaagggggccctgttcacatgggtcctgaagcatggggaccggtctgctcggcatcctgagagccctgtgagctccccagccacccacacaaggcccattacctcctccctcagacagcacagtctgctaattccatagccccatgcgtggccacactggcctagattggtgtgcctgtcttcttctcccacctcagctacagcccagacccaccttctcttctgcctaatgaactgggagacctgaacgggtgaggccagaaaagaaaggggagtgagctgggagagtggctcatggcaggctgtgttccatctccaggactgaaaagggaaaagagactcatggggttgaaggtgaggacagagaagtcactagagcccacatcaaagtacaccaagatccttactcaagaaaaataataaggaaataagtactttctctctttttaagcgtcatcccttctccagagacgtagtgttcatttcagcatgtacaagtttaaaaaaagtgttgctaaaggttattaatttttttatattttattaacttctttactctctgtgtgtttgtgtgtgtgtgtgtattcgtgcacacatgaatcatggtgcgcatgtggaaaccagaagacaacatatgagagcccttcactgcttgggtcctgggggtttaattcagggaatcaggcttagcagtttccccactgagccaactcaccagccctcttaacaggatttgttttgtatttttaaggcaggatcctgtgcggcccaagttgacctctaacttgttacacagccaaggctggccttcaacttctgctccctcctgccttgagtccccagttgtaaagttcagctttgcggttatgttcttacctgatagtctcattagaaatttcctatactatgattgcattattagttttcttggtgcacgttatgtgtgtgtacttgtgtgtagatggcgtgtgtgtacacattcgtgcaaaatccaggagtcaatatcaggtgtcttcctccatacccttctgccttatttttaaattgttattacatatgtatgaatgttttgcctgcatgtatgtatctatgcatgcctagtgcccaaggaggccagaaaagggtagcagatccctcagaagtggagttagatagctgtgaaccaccctctgggtgtagttactgcaaattagcaagtgtctgaatcactgatcccttctttcgcccctgccctcttgccttagtttttgagataaggtctcactaaacctggagcttgccaactgaggtagactggttgaccagcagtaccccagtatcctcctgtttctgcctctctggtactggaattacaagaatgcactactgggttcaccttttaaatatattttagagacaaagttttgctgtatggccttggttggcctggaactcacagagatctgcctgcctctgcttaaaaaggcgtgtgccgccaccgtgtctagcaacgactcgctttttaaagtggatgatgggaatagaacacgggtcctctggcaccgatgccctaacactttgctgactgaaccgcctctccatccctaattagttaatttttttaaaactctatagcccaggctagcctcaagctcacagtagtcctcttccatcagcagccttccaggtgtcaagatcgtaggtgtaagccaccatgaccagcttttcatctgtggtatataaaattgtaaataaatgataccataaactgtgtacacatagacataaatattttgaaagtgattcacacaagactaaagttctgaaactaaatcccaagagggtcaacaggcctgatattcccagagcccagaaatggccctcccatttaaccccttaagtgctccgagcaggacagatggttcagtctgctcaccccacccttcctttcctcagctgaagggctctggcgtgtccccattccttgcctgaggatgtggccattctaaggaggatgaggctttgggaaggtgacactgcaaacagaggcctggaaggaaatgccacttgacgaagttgttttgcgttgtgctgtatgagacgggggagtctggaggggtttacaggtgtcaggggtttccttcttgggacgtcctgcctgggctaggaagacctagaaaaaggactgtctgttgcaggcaccagggttgcaaaacaagtctccatccaagcccagttgaccaactttgcttctcttccctcctctccacctttttgggaggtggagtgagtagatgtgttttaaaaatctcaacaggaaatagggtggtgctttttctagagggcaggcaaatagaagaccctctgtgtctgcgatcaactgaaaggggtgtgggggtgtgtgtgtcctttcccctttctctgcctcatgctgtgtatagaacacttcagaagccgagcttcgtggctcatccctgcagccccaacatgggaggcagaggtagcaagactgttagtccactccaggccagcctgagttacacggcggtactctatccgaacaagaaaactacacaaaacacccaaacggaactgttccagagttcacacacgaaaggcacctccctcctttcgcctttctgactcccacggggtgtcctgatactgtggaggactggccgttctatccgctggcccaggacccctgcaccctagctctttggcttctcatcccctttcggtttcctagtcactaacaccactttcttgcttctcccctcctggcccgcaccagctctgtgtctccgggcccagatccagccttgtcctctcctcccccgctgtctccttgaagttgcctcccaagccagcctaccccagctctgtcctccctgttttcaatccagaggaagtaacttaagcaagacagacatttcagagcccagtgagaatttctcaatcatgcagagaccgtaagtcaggcagagcagaaaccaggatttcatccatgggaattctggctgggtgtataagcaggggcaggaagggtagtcagggaagaagttatgataacttctggacttgctggtagaatgagcaagagctgaagtcaggatttggtagcaaacaggaacacgaggccgtgttatttagtcaaacctgccaggctcgcctcactagccagatccctcagtgggactgcaaactgtcctctgccaatgtcctcggcattccaaggccagggaagagaagggggaaggatgccctggctccaggacaacagagggaggattcggtattcagtaaatatttgttaagccaatcaatacgtgtgcgtagtgtgcgtctggcaccggggaggaaatgtaaagataatgcctgacctgcggcatctgcagtcaggtggaattcataacgccaggagctcctggggtcactggagcctgtaacacggagaggcccctttcagtcggtcaagttccagcacagagagctcctttgtgcaggcaaagctcctttccatagggggaagttcctccatgtagggggaactccttccattgagggaagctccgttctgtggggagagtctctcaacagagtcagtgtgaaataagaacaccagtttcagtgcccacgcccaccccgttggccaccgtaactcgggaggtcacaggtcgaaagggaaggtaggaaagactggggttcgggaagaggtgacacgtatggagtggtcatgggctacatgccccaaatgtaccatcccatttactgatggtttaccagtgctcagaacccagctggacccagggcagagcacagcattggaagtagcatggaagaaataaggaccagaaccaagtgtgttccctggggatgtagctaatgtagaaatggagttctttcgtcttcaagggacgtggtgcgtgttctacaatctttgggtgtgttgatgtatctagagacttgccggtcgtcatggcgcacgcctttaatcccagtgctgggcagatttctgagttcaaggggccagcctggtctacacagcgagttccaggacagccagggctacacagagaaaccctgtctcaaaaacaaaacaaaacaaaacaaaaaacaaaacaaacaaaacaaaacaaaaaaagatatagagactcccttcctgcacccagatctcctgagtttacagaaagtgaccggaaccatgtaactgaacctaggatcttgggagtctgcttgtgtttctgggaaagcagcccactacttaagaaatttctcttgagcaatgtggatgatggagaaggtgagaaggaccggagatggatgtgtgcgcagcatgatgagactggggctgcaagcagagctcagcacttgtaaacactcgccaggtctattctagggcctggaactgaaagtcctttttgaggacgccatcgggctgtggtcttaaccttttgactcatttatccttctcagacccctcccccgctctgctagaggccccgccactctaccaccagaccaccaccacattcctcctccttgggcttatcagagctgctcctgttttagggcttagaacctttgaccagagctcctctggagggcaagtcagccctgggagtgcgggggcacggagggaacctctacccttcaggggttttgctgtattgttttatttaggtttagtttggttgggcggatgtattttgtttgttgtttgtttgatttagatatgtttgttcattttaaaatcatgtgcctatacacgcacctgtgtgagtttatgtgcatcgtgtgtgtgcagatgccatggagctggaggtacatgcaattgtgagccacctgatgtaggtgccaagagctacacccaggtcccctggaagagcagcaggtgttcttaactactgagccatctctccagcctcgagacaaaaattcaagtcaccccagctggccttgaaactcactgtgtgtagtcaaggttggccttaaactcctgaccctcttcccccacctcttaagtgctggcgttacatataaatcttgtcatcaggcccagctttccagtcatgccagttatgcccatagccagtctaggtttgtggagcaggaatatgcagttcctgtaggcaaaagcccagggctccccctgaaccccaggctataagaccaaggcccgtatctcagagactgataggcaatggtgaacgatatcccttctcagtatgcccaagtctctcaacacagctttatagagtagtggcctgtggttggggatggggtgtggggaggaacagaggaagctgaactttaggagagaggaaaataatgtggtggagtgggcttggataacaaaggagttttgcttgagactaataatctccagctgcaaaaataccaaaggggaggccaggctggctagggacgtcatttcttgccaattccttacagtcaggtctgctgaatgggaccctgcctggtctttggggaggtgaggggagcccagccaagggcagacacatgagaacagggactgtcactgccctgctttcccagaagtgggagggaacgcaagccaggagagaggctcccactcaggttccccccatcttgaggcttggcctgagaatggagcagcatctggaagcagggcaccagctctctgcaggcttcttcctctttccctcttgccaagggtggatgggtgagcagggccagggtgttgccagtcctagggctgggcagtgactcagggaagcctgaggaagttggagagaaagccatttgtgccagctggtgctaaggaaaacagatttgacggatgatttttgcacacatgccagtggccccccagacccccgcagcgcccaccaagtaaagggcacagagccctgttgatttcggctgccctgctagctgcccggggccgcaggaaggtccctactttgggacttcagtttcctttggaggtggcccagtgggtttcattttaatctggtttctctatggtgactcgtgtgtgtgtgtgtgtgtgtgtgtgtgtgtgtgtgtgtgtgagagagagagagagagagagcacttgcattgagcttagtgcagctagagagagagtacttgcattgagctttctgcctctatgacccttgtcctcttcatgcttccctgcctgccccccaaaatggaacagtcttgggaacccagaggacagagtagctgggtttgggaatgtgtcagcacttgtaggggtaatacctcatccctatgacctctttctccagttgtctcagggtggggtttaccagaggggacctgaagaggaagccatttatgtgagccttcagtgactacttcccccgctcgctcctctgtcctcagtcctgtgactctgagtcagtcgtcccagccagccaacttccctggatgacatgttcctattccctgcaccccctcccactattaagaaacagctcctggatccctgtggggaggaaggggggttagggaggggttgagcagagttcatcattatacctgtagctgtgtggcagagtcatccctacagggctgagtcctgatagtgtgggccgagcttcagccagaggcaggcagtaaaaagacggctggctacctgctgttgaaacagtgcagataaaagtctctgccttaggaacgttcaggtctgcaagtggcatttcttctgagagtgtatttgaaaggggccagcggggggtgcatggaagcctgggctgtgttgggaaggctgccaacagttgtccttatccccagacttccaacagtccttggcttaccctcctcctgtggcccttcatggcttagaatgactgtggtagctgccatgtaccatcagaagttcctctttctctgtctcctggtttatctccagggtcctattttcgcctcctcttggactctctgtacttcagttctcattccttctgtgcttcctcggggtgtgagggaattaagtactaacatggaagaaacggggacgtgaaggcaagaagaaggagtttggctcatgtgactgattccccagcctcggggccaccagtcttgggtcatgctgtatgaacttcatattttgaaatacttttctcccaagctgagttcatttatgaacattctacttcccagtaattttttttctttaaatttatgcaacatgcacagcttccagccggtacttcttgttagtatgaaataattagacttaccatgtagagcgaatataaatcaggcccaaaccaaagataatgtgccgttttggttagttaggacacccttttctcaagagaaagcaggttaaagagaaaatatcagggtgagttggtaggcctgacctcctgcctcttggcactacaagatagcactttcctgatgaaaactggattagaatcggaagatcctgtcagtcagtcagtcagtcagtcagtcagtcagtcagccagccaatatttacctagtccctcctgcttatgacaatcctgagcctaggatgggggctggggcagggggttgagtctatttggagacttctatttggagagaccagatacttggaaacataaagaatgtcaaagtgtgactgtatccgctgcgaacacccacaagagctccggggaaggtggctgcagctggctgtggctgaggagggttaggtcgcagagaaggcaagctcaccagaggaacggatgcctgtgggtgggcctgtcccacatagctctctccttccttttccagacgtggagcagatggcaatcgactggctgacgggaaacttctactttgtcgacgacattgacgacaggatctttgtctgtaaccgaaacggggacacctgtgtcactctgctggacctggaactctacaaccccaaaggcatcgccttggaccccgccatggggtaagagtgtcgggctggcattctcactctcgaaagaggaggcagaagctgtagtgggaagtgtgtgggggatcccggtccctgcgccccatttatcatgtgtgcacccacaggaaggtgttcttcactgactacgggcagatcccaaaggtggagcgctgtgacatggatggacagaaccgcaccaagctggtggatagcaagatcgtgtttccacacggcatcaccctggacctggtcagccgcctcgtctactgggcggacgcctacctagactacatcgaggtggtagactacgaagggaagggtcggcagaccatcatccaaggcatcctggtgagggggctgctttgtctgaggttattctgaggagaccaaccaccagagcctcctgctgacggggagtcctttgggggacttgatctctagggctcccagtgagtgtggaaagagcagagttaaccagcccatgtcttctggaggggccagcaggaatgtgtcagagaggaaggctatggcttcccattctgatgggagcagtcatttaaagacaccccttttacttccctttttcttatttgaggcttaaaataacccctgggagatgagcaggcagttgacaaaagcggggttcaaagatgtttggtaatttgccagaggttacacaactgggaacaacgctcgaacccagccaggaggtcctgctgctcagtgcagaccgtccactccggagtagcttgcgtgtgcagccatgcccggggctttgagtggaactcttccagtcctaaccttgaaaaatctcacagcagactccttatcttgggcaaatggaaacagctggcccctgtaggcttccttgggacacgagagaaccctcagtccccaaaaaagctgcagtcaagttgagcattctctggggagggaggttagggcccgagtttaactcatctgcaaattctcaaagggtctgcaaggagcttaattctgcgagggacattgttttttcttgtcctcggtggtaggatggtccagtgatcagcacatctggtgtgttagatagcagtgtcaccacagaggcagagtatagaaaggaatagcatctctttgaaaactccagttctttactttgtgaaggacgaataggagatggacaaacagaaatttccagaacacacgagtttagcatcaggttaaacaaaactagcggggaaagttcggacgtaggtgatgggagtctgggtggcaggcggaggccgatgggggatgaagggagcagccttttcatcttgttgaccgacgctgcctgccgtctcagatcgagcacctgtacggcctgaccgtgtttgagaactatctctacgccaccaactcggacaatgccaacacgcagcagaagacgagcgtgatccgagtgaaccggttcaacagtactgagtaccaggtcgtcacccgtgtggacaagggtggtgccctgcatatctaccaccagcgacgccagccccgaggtaagcggtcaacagggcacctccacagtcggcttcaccccaacagcactgtctgctcttctgcatatctctttcaaattgagagtgtttctaggcaccttccccaagctacttctcctcgcctctccacgaccggaatcccttatgcctgggttgtggcaaggcggtgaatactagttctgggcttcaaagtcctaaaatgggacaagagcaaagagcaccccccatctgacccgagcagagccccctgaagggtgctgacagctctctcctctgcccccagtgcggagtcacgcctgtgagaatgaccagtacgggaagccaggtggctgctccgacatctgcctcctggccaacagtcacaaggcaaggacctgcaggtgcaggtctggcttcagcctgggaagtgatgggaagtcttgtaagagtgagtatcagggagagttgggcctgctgggggtaggggtgggtccacagacattcccctgtaacccgctgcctctgcctagatgcagagaaacgaagggcagagacataaggggcccacacccaagagcagcgatatatctagcacacgatcactcattctgcgagtgttcagcaaacacacactgggtgtttgacaccgttcgggcagtgaagggtgtggggggacagaggagttgtcaggacagtcggaggatgtgatatctaagccaagctctctgctgatgaagtgaggcggccaaccgtgtgactgctgagagatcatttatggaggagtgaacttacggttcaaaggccctgaggccagtgtagggtgtggtctgccgagacgctgggtaaggtgtcgtggtgtgagtaaagggaaatgaagggaatttctcactgggatgaggagcttatgaccactgtggaaagaagatgagtgattgggtgcgtcctgtgtacgcttatactgtgctgggcaggagggaagaagccaggtggctatttccatggtgtgggtcagagtgacatggtttaggttaagatggtgacagactggtagaatgaccagataccaacgtgctctgaaagcactccgatttccatgaaaagttgctcgagtcaaatccccatgacacagcggctctaggactagagtggagcatgttatcttgtgtcttctgggagtgactcatagccctgtctgctccagatctcctgacccagcccagccaacgcactatagcacctcagacccagatttcaatttgggtggtgaccatgtgtgcgtgtgaatgtgcgcatacatgtgtgtgcattgtgtgtatgcgtgtgtgtctgtatccatgtgtgtgtgtgtgagtgcatgtgtgtctgtgtgtatatgcatgtgtatctgtgtgtgtgtgtgtgtgtgtaagcgagtgcgtgtgtatctctgtgtgtatgtgagagcaagtgcatgtgtgtctgtgtgtctgcatgtgtgtgtgtgcgcgcgcacgtgtgcgagttcatgtgtgtatgtgtgtgtgcatgtgtgtatgtgagcaagtgcatgtgtgtcctgtgtgtatatgcatgtatgtcctgtgtgtgtatgcatatgtgtgtgtgtgtgcgcgagttcatgtgtgtctgtgtaactttgtgccctttgtacttgccctagaacctgaacatgagctgttcctcgtgtatggcaagggccgaccaggcatcattagaggcatggacatgggggccaaggtcccagatgagcacatgatccccatcgagaaccttatgaatccacgcgctctggacttccacgccgagaccggcttcatctactttgctgacaccaccagctacctcattggccgccagaaaattgatggcacggagagagagactatcctgaaggatggtgagggcgtcagaggtgggcggtgtgtgggaagagctcctgggggatgaggcgcctgagacaggaagacatcagaggcttagattgctccctcacagtatgaagagtccttgctgacaagctggctgggctggttggcatggagatgaggggatagacaggttgacccctgtgtgacccccttcttggctgagccaaaaagagtcggaggatggatggatgtgttaggcagtgagggctgccttggccagcccttgggaaaattcagggtctcgccgccattggctcagagccctggagctgtgtacagcatacagccaggagaggccataggccctgaatcacagccgggcctgccatgtcagacagggctcatccacaagtgtaaatgctcagaatgtatgcagctggatctcatggccacggatatctctacctctctgtggcctgagaactctgtgtctgtctctccctctgacctactttggcagggccactgtgcagtggagccgttccccttgagggcttctgagctgtgtgtgtttttgggggccccaagatctggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtacaggggaaactgctatttaagggacactagtataaagcctttggctaagggaaaattcacttcctaatttactcatttttgtgagtacaggttttttaggcccaggatggtggcgtcatactggagcaaagagccagtgcatatcgccccggctgtccacctaagcacaggcccagacatgccctcatctgagagctccccttagtcacgtagtttcctggctgcctcatgctgtttttcaaaatgtagatgtggcatcgtagatgcagtgtagatgtggcatctgaaagggtcgtctccatcccccacccccacctctgccccaccctccctcccccatctgcccaccattcagggcaccacatgcctcctgctccccctgcctggccaccatctctctctgtgtcatgtgtccttcaagggtcacccccatgcgctctctacaccctcacaggcatccacaatgtggagggcgtagccgtggactggatgggagacaatctttactggactgatgatggccccaagaagaccattagtgtggccaggctggagaaagccgctcagacccggaagactctaattgagggcaagatgacacaccccagggccattgtagtggatccactcaatgggtgagtctgtcccggggcgtggggtggatgcatgtacatctcagaggactggggagggaagcggcaaagccaggggcgtggctgaggcaggcaggctgcagaggcaggaacgggagcctgaaaaaggagcctgaaaagagatcgtgtgtttgtccgtctgtcttgaggagggaaaacaaaaccctggtacgcaaccggaagtctgcttctgccgctccactacagagctctctcctggttccccttggctccgagccgcccttgcctttgggtctgcacagttcttgcttgccaacatctgcacctgccttccttccctcacccaccacttcctgtcccatcctttgctgtctggaactcccggatacctcacatttggtttcttgtcagcgttgggtctcagagaagccccccaccccatccctgttcacccaaacttgctgcctagattctctccgccactcacatttaattttcctcctgattttatcactccgacacgactttcttgaacaacttgtttctcctgggatgttcgctcctaagagatggggaaccttggttttgctgcatcctgggatgccagagccatgctccaattagagtagccattcatggtggcctgagttgctgtgatgtggggtttagagagaaacagctcagagagacccctgggaggaactctggataccacctagataccacctagtgcctagaatcacaacagaagctgttgtgacaagggtgaccatgtggtgctgaccagtcactgcccacaggtggatgtactggacagactgggaggaggaccccaaggacagtcggcgagggcggctcgagagggcttggatggacggctcacaccgagatatctttgtcacctccaagacagtgctttggcccaatgggctaagcctggatatcccagccggacgcctctactgggtggatgccttctatgaccgaattgagaccatactgctcaatggcacagaccggaaggtgggcaggcatgtgtgcattgtttaaccctgtttctatggaaactccatgaggatgtacatgtctgtgtgtgtagggcttcgtgcttcttacaggtctacacatggctactctatgaatgtatgttttcatgttgtgtatattgtcttctttgaggatgtctatctgcatatggctgcccacaagcacacctgtgtgtgcacttctgtgcgtgtgcacatacatacatataacacacttcagggtagtcacgcagcaacatgtaaggtgctaaggggtagcatatatgcatatttgttcactccgttggttcatgagttgtgtttgcctttaggtatatgggccaaactgtcttggtgtgtcaggcccttcacaataaagctctgggcacctctaccatcttgtgtctcctactccccacaactcaacactctatgaacaagctgcactagacagcttgttattccagaacatcataggcctctgctccctaagccttggcttcctgggagtccccctagttcttcttggctctctttctcttgaagattgtgtccaggtccctcttcccacagattacctacatatgccctccataggacaatggtgctcttagtacccatcacagctcagcccataataaatcccagtaaatgttgcttaggtagagaaataaatggctgaatgttggtgtatgtgtgtgcgcaagtgcacatgtgtgttcatacatgtgtgtgtgtgtgtgtgtgtgtgtgtgtgtgtgtgagagagagagagagagagagagagagagagagagaaacacataaatgacatatggaacagccttatgagaggtccgtatggacagtgtcctttctgagtcacctgatggagccagcaccaccagggcccctagttgtcccttgggaatctctatttgccctcctctcctcagaaacatcacctccattcctagattgtatatgagggtcctgaactgaatcatgccttcggcctgtgtcaccatggcaactacctcttttggaccgagtaccggagcggcagcgtctaccgcttggaacggggcgtggcaggcgcaccgcccactgtgacccttctgcgcagcgagagaccgcctatctttgagatccgaatgtacgacgcgcagcagcagcaaggtgctcctttatgggctggggatggcgggtgggtagggtgggacccctggctttaatgtcaaagacttcccagaagcctctgttccccattcacttccatgttgtatccctctctttcaacgcaaccttcctttcccgacttcctctttggtctcctcactttgtgtatttttcctttcctgaccctgcctccccatccttttcctgccctctcctgcagtgggtaccaacaaatgccgggtaaataacggaggctgcagcagcctgtgcctcgccacccccgggagccgccagtgtgcctgtgccgaggaccaggtgttggacacagatggtgtcacctgcttgggtatgaggggcctggcttgcacaagggtgggaaggtagctccagcagaagaatggcagagggcaggggagttctctgtgtttccagtagagattaaggaagcaaagagggggccctgagatgctgacaggaagcaagggatagggttcagagaaggctctggggctaaaggaggattgggggtggggtagttctgagggcacgaagatggggcaagtgaatgaggaacgagacagcgagtaagaaaggaactattcttaactcattttagctttggctatcattacagtaaaataacagtatttcagaacactataggctggaactactccttaacagcagcactcaggaggcagaggcaggtggatgtcagtgaacgtaaggccagaatggtctgcctggagaattccaggtcaacccgagctgcagaataagaccctgtccaaaaaaaaaaaaaaaaaaaaaaaaatcaaaagtaaaactggaaaagttctgtaaattagccgggtaaggtatacatgcctagagtccctgcactgtggaggctgaagcagggggattataagttccagtccagcatggatattctagctcaaaaccaaaaatttaaaaaggaaataaggagaaataaaaaccctgatccaaccagtgaacatgaatatgatgtggtaagtcacacgaggtactttcttccctaggtgggtagttctgttttatacacagccctcatccagtgtgtacatgaatctcctgcctctttcggctcttacccgccacagtattctctgttttatccttactatttatttattgtactgaggatcaacccagtgcctcatatacactagataatcactccaccaacgtgctacaccttcagttccttacattcatgattttattgattagtttttactttttggtgggtattttgcctgcgggtatgtctgtgttccatgtgtatgcagtgcccatagtgggtgggcaaaagggggtgccagattccatggaactaaagttacagagggtggtgagccaccatgtgggttctggggatggaatctgggtcctctggaaatgcagccagtgtgcctaactgcctctccatctctccaggccctaagatcatgatttaaatagccttgatctcctaaacataagaagggttctagggatgctggccttcaggtaaggccttaggtcaaattcccagcaccatacacacaattaaggttaaaataaaagtaggtactcgccgggcgtggtggcacacgcctttaatcccagcactcgggaggcagaggcaggcggatttctgagttcgagggcagcctggtctacagagtgagttccaggacagccagggctacacagaaaaaccctgtcttgaaaaatcaaaaaaaaaaaaaaaagtaggtactcattgtaacaatgtaacaattcattgtaacaatgaataaatgtgctgtgcagaaaaacatcctaccaggccctgatgccattttaggggggactcctccccaatatgtctgtgtgcatttatgtctacataaaagggcattgctgcatgcatgttcttctggcccctgcttccgttgctaagcagcgattttagtggccaaactgtaccgtttagtaaatgttccattgttgactcagctatttctctgctgatgtgtgttggtttttgggttttttttttataaccacagccaacattcactaagcatacattatgtgtggttttaagaatttcccatgtagtagcttacttgtcctctaacacgtctctgtggggacagcatttttttatttacaagggttgaaactgaggtccaagttaacacaggcatcccgatatgaaagtctgaccccatttatttattaacccttttgtattgatcacatacttacactttctcatagctggaataaacttttttatcacagttctgggagtgaactgtatcagtagctggatgtggtggcctacacctttaatctcagcattcaataggaagaggtgcgtggatctttgtgagttccaggccaacctggtctacacagagagttccaagccagtcagggctatataatgaaatctgctctcaaaacagaaatacaaaagggagaaaaaagaaaaaaaaaaaaaaaaaggctcagtagagatcaatgtcctgttgagaacaagacagagggctgggagaagcagagggtgtgaaaggccagggcactggaactgtctttgtgaacactgacatcattaagaatagaggcaaggggctggagagatggctcggtagataagagcactgactgctctcccagtgatcctgagttcaattcccagcaaccacatggtggctcataaccatccttaatgggatctgatgccctcttctggtgtgtctgaagacagctatgtatattcatatacataaaaataaacagctgggtgtggcggcacacgcctttaattccagcacttgggaggcagaggcaggtgaatttctgagttcaaggccagcctggtctacaaagtgagttccaggacagccagggctatacagagaaaccctgtctcaaaatacaaaaaaaaaaaaaaaaattaacaaacaaacagagccaggactggttgtagagaaggtggcagtggaccaggagcagagcatccttagtcttgatgaagcagcctgagcaggtcagcactggtttctagaaaggaagggaaaaacagctaagaagcggctgtgcggaacaaggagcacacataccaccttcaaggccctgtggtccacggagtagaggagagagcgttggtgacccatgggaccctgcagaggttttagaaactgggtgagaaaagcgaatgcaaagctcaggtgactacaccaaaggtctgcttagatgctaaggcagacagtgatggagaggtaccactgcagctgggggtgggaagagtggagcatgcagagatctggggatctgtgtttacttaccaggtggagtcaatggctttgtgaaagaccaagtccaggacaggatcttgggggctcctgagatgacacctaggggccgttcagagtcagcagtggaccaagcacatctctgtgacctgtagaactattttactctcagaccacagggagatacagacattgacagggcagggtgtagtcccccttaccgtattgaaccgaataatctgctcacggagaaaacagtaaatcagaagagaagtacaggggttttagcgcctgtcccgtggcctgggtctgaccttacccctcacactcctgtggtgcccacagcgaacccatcctacgtgcccccaccccagtgccagccgggcgagtttgcctgtgccaacaaccgctgcatccaggagcgctggaagtgtgacggagacaacgactgtctggacaacagcgatgaggccccagcactgtgccgtgagtcactgttcccatcctgggtggccgggcagtgggaccctggatgtgtgccactgcccagtagtgggacactggatgtgcgcctgcacagggcagtgggactctgcatatgtgtccgtgagaacagagagtcggttctcactgacccctgacctctcccccaaaccccagatcaacacacctgtccctcggaccgattcaagtgtgagaacaaccggtgtatccccaaccgctggctctgtgatggggataatgattgtggcaacagcgaggacgaatccaatgccacgtgctcaggtgtggactcgggcacggtagtccaggagccaggcctgggaagacagaagagcccatgaacccagagcaaagggaaagggaccctgggcaggagatgggggtcttccattccctgccaggatggacagacccaacaggactgggtgtacaggggaacagattaactttagatggagatgaggaaaaaccacggatggagccttttcccaaaaaccccaaagatcccttgggatatggggtcaggcggcaccagtgtgattcgggacactagagaataacatctcaaacagaatggggggtgggggggtggtgcataggacgatgggagaggagaggggctagatgatgaacttctgcacctgcccctcccccctagcccgcacctgtccacccaaccagttctcctgtgccagtggccgatgcattcctatctcatggacctgtgatctggatgatgactgtggggaccggtccgatgagtcagcctcatgcggtgaggggcacggcaggcaagaaagtctggccagctggcagaggggaggggcagatcacgggttggggctggaggtgtgtacctggtaggcttgagtaagttgtcactgtggccttgataagttctgtctgcagcaggggataatagcaccaccatcacattgggggggggggcgctcggggtttgtgatgatgcctagcaggggtaaatgagctatttccagtgagcccctctgccccatctgactctgctagaggctcctgcttgtggaagtgtccccttcaccacctgcttctcaatgtgagaacgtgtgactttgagggccccactcgactgtcctttctctttctctctgacagcctaccccacctgcttccccctgactcaatttacctgcaacaatggcagatgtattaacatcaactggcggtgtgacaacggtaagagctaagagcgtacctccctcctcttactgtaattcctaggaaagccagaagccaggcaggcctcagagaaggcaggcaagatcttagactcgagccggggttctctgtggtacactgaaaccctgagagatttactagctaggagaaacaggaaggagacagaaataccatggggcaccaaggtggacagaaggtccctgcggttgtatcacccctgccttagcagagcagagctgcccaccctctggcaggaaagttaagtgagggcagagcgacaaagcccagggcctagcctcttctccctatgccctctgcctcttggggtctttactgcatgccccaggctctgggtctcaggcttggaagcacacctggaggtcagccacggaccaggtgatgtcagccctgagccacagggaccacggtgtgtgtaagcacacatgcaagtggtggttgtgtgtgccgtttcggactctgtcctgtctggtgtgctgctgtgttgtgttgcgatgtgctgccccagggtctccagccctgcttcacatgtgaggatgggttgggtctgtaccatgtctccctcctccgtgccgtgtctcgagtgccaatggttgccctggcggtttctgtgtttcagagaaggattgtggggacggctctgacgaaaagacctgtcctgagcctgccggtcagtgcatagaggcacatgcaccatcaccccagagccccagatggcctcagccttcccagcaccctaggttccctggcccagagctgccagacacacacagacaaaagaggcagaggcaggagagaacttggagggtgttcagaggagagaggtgacagaggtggccccgaggaggctgagacctgggggaagaaagtcaaagccagttaaaagtgggcaggaacacactacactcagagagcactttgagagtgctctgtctttgagagtcctgtcagtatgtgcagagggaagttaccctagggcttaggagccaggatgtccacccagatacctacttcagaagaatagtcctctagcctctgggagcctgcaccctgcaccagtgtcttgcaatgcccaagctcagtgtgtggctgggtaaagatctttccagccagcagtctcgcctacaccccacacccctcatctttcaaaccatcaggaacctctccctagccccccaaagtaggcaatcctgtccccatatcctgctgcaaaggatgtccccacccccaactctctgagactcagggaagggcctcttggagcccacccactgcctcccccaccctgtgggccatggtgcatgctgcagtctatgcagtttctgtttgtcttttctgtctgttattttctcagtggggggtggggcgggctgctggtgggagtgagggggctaagcaggccaagctggggttacagaaaggctgttctgctgaacccatccttggctctccccctcttccctcgcccagacaatgactgtggggacaacagcgacgaagccggctgcagtcactcctgctccagtacccagttcaagtgcaacagcggcagatgcatccccgagcactggacgtgtgatggggacaatgattgtggggactacagcgacgagacacacgccaactgtaccaaccagggtgagcactctggactagcatccagcctgtccagccacccaccccactgttgtcgccatccaagaaccccgagatggctttgttaccaccctgagatctctgatgcttgccccttgtccttgaggaggctccagtcccccaggagaggaaggttgctggcgaatcattggcacgcactgttacgattgaaggcctggctgttgggtggccttagatttcagcttcagctctgcagcttgttatctgagtggcctcggacaagttacctcatctctgtgggcctcttgagttttctcagcaattagcactgacatggtggtggttatcaggacacaggatgtttctgggagctgtggattgacagggagtcaggcatggcggctcacaccaataatcccaccaccgagaggctgaggcaggaggatcgatcactgacagatagtaggtcagcctggcctagggtagaaggccctgtctcagaaagaaagaagaaagagtaccacggacagtacccagtgcccatggggcctcttgggagaggctgagtttcccagagggcacaggtcctctctgagggcgctggtgtcttagctctgcctcgtcactgccgagaaaaaagaggaccagtataagttgggtctggctttaagaaaagacagaaatgcctttttttttccccctgtgaaatgtactgtattctgacactggcatatcagtttgctaacgtttctgtagcatagtgccacaagcgagggacgtagatgacagaaccgtgctccacacagcatgtgaggtagaaaagcaaactgtcctgaattcaaggctggctcctccccagcctgtgaaggaaaacacatccttgtgtcttctgagacctctggtcttcctttgttctggacacactaccctgcccctgccttcatcttcatgtggcttcttccctaaatgtgtctgtccctgggtccacttttttctttttctttttcttttttttaagatttatttatttgttttatgtatatgagaacactgtagctgtacagatggttgtgagccttcatgtggttgttgggaattgaatttttagaacctctgctcactccagtcaactccactcgctcagttcctgcttgctccggcccaaagatttatttattatttttcataagtacactgtagctctcttcagatgcaccagaagagggcatcacatctcatttctggcggttgtgagccaccatatggttgctgggatttgaactcaggatcttcagcagagcagtcagtgtcttacctgttgagccatctcgccagccccctacattttttataggaacattaatactattaattagtgattttaatgtacagagacatatttgccaaacaaggtggcatgcggagttgagcatctttttaggaatcgcacttcagttcatgacaactgatagtttacttatgggtcaaaatatttctgcaagccgtacatggcccatgagcctccagctaggagtccccgcgtcagaattagcatcgtcctgagtgccatgggccactctacgcattcagctgagaggcagtgacaagagggtcacaggaagctcagtcttcaggaccatctctgaaaaggactagggggtttaagaaaggattccttcctagatgggtgaagcaatgcaggccttgcccaacaagccaagtagatctggcttcctctgcatctgggcttcctctgcatctgagtattaggtggagatgggaggggtgggacctggcttgtggacagtgattggcagtgatagttaacctgtggttctgagctggcatgacccagtaccttgaggaggaagtgggcttgcaggtgatttcagtacctgtataggaaagtgtaaggcttcctatgggggtagtgggaggctggttagatggcagatgcctcgtgcagggacaaggaaatggggctactccgaaagcagctgcttccaatagcataatgacagttgggcagaggcttgacctgggaggcactttggaagatgggtggtacatttggaaaacaaccccagaaggaaattaccttacgctgaacttcaggcccccccccccagggaaggaagtcaggttataggcagctgctgagagttgagacatggacacaccctgccaccccagttacccgatcatcaatgctcacactggggggggtggcatttccactatgccactggcctacaggattaggtgagatacaggaagatcccaatgggtcagtgatcttgtgccccgacactgccctcaggcttcacaagctctctgcacacgtgaaaaaggtgctgagacctctgggcccttcacccatctctgatccatgttctgccttctgccccttccctcccaactttgcctctgctgtcccatctggaatcttcccacaggatgctcctctgttggctgtgcagctgcacgtatcttagtggctcactcttcaattcatattcccgctgaggaggtttctgctcaggggcctgctgaggccgtcttgcctgacgtgtcatttcatcaggctggcactgttaaactcctgccattgcctgcaatcatagcctaggtccacccccctccactagactctaagctatgttgaagaaaggatttggtctttgaggcacgtgggagggacggtgtatacagagagtgtgcagggagtgagggaaacacagttaggttgatgtatttgagttctgccctgacagatggaatatgtagctagttactctcataagcttagaggaggggcgttagataagagggtcacccgggtccttgaagatacaacatctgagtctctcgatgagttagagctttctggctatcggcaggctcatgggacacccagggcatccttacttggctcagcatctaggctaagcagaggtagtggcagagatctgtccagggtgcctctccctcctgatgcacaccccaccccccgcccttgtcctccagctacaagacctcctggtggctgccactcggatgagttccagtgccgcctagatggcctgtgcatccccctgaggtggcgctgcgacggggacaccgactgcatggattccagcgatgagaagagctgtgagggcgtgacccatgtttgtgacccgaatgtcaagtttggctgcaaggactccggtgagagggggcagagcagggcggggagcttcatgagtaggaggaggccatcttgaggatgtaacagtggcttggtgttatgtagaggaaagggcaagaaagagccagagtctgtatgaaagaccccgggaacccaaaccctggccagaatcgagcaccggcaccttctgcaggttctgcaccttcttcgttagctgtgtgggtttgacagaaaaggtttcaaggtttacagtgggctcctaagcacttcagtgaagacattcttagctgggtctgggcagggcacagtgagttccactctccaggcctggttcctcattctgtccccatcctggtccctcagcccggtgcatcagcaaggcgtgggtgtgtgatggcgacagcgactgtgaagataactccgacgaggagaactgtgaggccctggcctgcaggccaccctcccatccctgcgccaacaacacctctgtctgcctgcctcctgacaagctgtgcgacggcaaggatgactgtggagacggctcggatgagggcgagctctgtggtgaggcgcccatgcagggcctggggttgcccagcagtggggagaggggaggtcttgtccagggtaggactataggaaatgatctggggcagaggaggcactgacctaggacttgccttggccctgcctgaggtgacaactcctgtaacaattactttacaaagtggcccaggtagacagccactgtctgccaccaactgaggaagaagaagcacagagcccttaaataaactagtccagggccatcccactctgaaggcagggcagggagggagccgttaagactcctgacctgggtcagacaccctcagtcagaccactgaaaagggaggccaggctgggggtgaggcacagggttgaggcatgatttgagctgacttctggaggagggaatttaactgggttcccggaaatgggcaacgtgtgcagaatgagtgaggagggtcgaggagatctgagcaaaccacaccgtcccagaacaaacaagtcatctgacttctgggaaagaggagtgaagggtacagccatctgaggctggcccagaaattgccaccgtggggcgtgttgggaaggtcagggcattcccctctgcaccctgccctgtgtcacacgtgaatcgggagggatcaaagaaagggccctgacctgagtatcctcccaaagaggaggcaaaatgcccaggtcccagccatcgacgtgagggcatcgagagcacacaggggtaaggaaaaaggatgatggtcctgggtgtcaggttctagtgtcccaatcctgatcctaagagagactgggaaggagacagaggctcagcagggctgagctgtggttagggctccggggctcagaacaggataaaaaaaaatgtgaagacctggcagggccatgtcctgcttcctcccagatcttgaccctatctctttcctgtcccccagaccagtgttctctgaataatggtggctgtagtcacaactgctcggtggcccctggtgaaggcatcgtgtgctcttgccctctgggcatggagctgggctctgacaaccacacctgccagatccagagctactgtgccaagcacctcaaatgcagccagaagtgtgaccagaacaagttcagtgtgaagtgctcctgctacgagggctgggtcttggagcctgacggggaaagctgccgcagtctgggtaagacgcagtggggtcaaggtgagccagccaagcaggcctggtcacgcgcctgagctacagtgggctgaaggccagggctagcagggacgctgtatgtatatcccaggacagggtggcacagtgagtggctctaagcccttcgctgacctgaacacttgcctccctccagatcccttcaaaccgttcatcatcttctccaaccgccacgagatcaggcgcattgaccttcacaagggggactacagcgtcctagtgcctggcctgcgcaacactattgccctggacttccacctcagccagagtgccctctactggaccgacgtggtagaggacaagatctaccgtgggaaactcctggacaacggaggtgactctttgggcctgggagagttgccaggattgtacacagatggcacttgggtactcagggtcacgggcccagattcaggtggccccggagctgaggcttcggctgcccatcccccgtgtgccccccctcccccagttaattgggttggattttgctgtgggtctcagagcctgatgccccgtaattatcgtaagcattgctgctgcctgataattaacaaaatgatcaccctttctttggaacggcctgaagcctggttccccagtcttggaattttgggcttagaaggaaaatgccatgtagggatggaccacctctgtctcggggtagcctgagctacacaggctcagtattaagcatctattgcgctggatacagcagtgatcaagacagatagttttaagttgtgtgtcagggagggtccctgagcagaggcaagcaagagacatgttttaatagaggagtttgtgttgtttattataaaagaaacttggaaacatctcaaatgtccgtcctcaggagaatagttacgtaaactgagctgtcgtcacatgacagtttctaaaataataagacacacggacatattagtgtagagtgtcttcaggacattcaatgggtagtttctagcatgttccatcatccttatagtatgtccaaacatgttcccagaagcttccatcagccctgacctccttgcccaggttaccccacctcagaacagtacatactcaaagtggctgacctcaccccctcctccaagagccccctttcccacctacctcccaggaggaaagaggcctgggagaggagagtgggagccaggcccttcagctctctgggcagaggtgtcagggtgaaggtggatcattgagggaccctgagatccatgccttcgccaagccccggcccaggagtctctaaccacctgcaaccttctcttcctagccctgaccagctttgaggtggtgattcagtatggcttggccacaccagagggcctggctgtagattggattgcaggcaacatctactgggtggagagcaacctggaccagatcgaagtggccaagctggacggaaccctccgaaccactctgctggcgggtgacattgagcacccgagggccatcgctctggaccctcgggatgggtaaggactctgccccacccccaccccctacccacccccgctccgtagctctgtgttcagcctggccagggacacctgtcttcttggtactgttgactcccccagcttatctgttgtgtgaccaccccatctttggccctcctcccttcctccctccctccctaggattctgttttggacagactgggatgccagcctgccacgaatcgaggctgcatccatgagtggggctggccgccgaaccatccaccgggagacaggctctgggggctggcccaacgggctcaccgtggattacctggagaagcgcatcctctggattgatgctaggtcagcagcatccgggcaggggagggacaggaccagcatgaagaaagatgaagccaagaggaggatggggggaggggaactgacagatgagaaggagcagggttgtaacctgcagtcatccatctaccctccgctcttctcataccccgtgtcctctgctgagggctctgcctgcccagggcaaagagaaggtgccttttcctaactcaccctggagctccaaacgccaactgtagccctgggaaggaaatctagaagattcccttggggagggcataaggctaggatcccaacccatgcaaccttgctttctctcttcagtcccaggcaggacttgggaaggggagttccctggtgtgttgagttgtgaggatgagggaaggtgggcacctggcagggcaccttgctgagacccccactgacccctccattacaccctcaggtcagatgccatctattcagcccggtatgacggctccggccacatggaggtgcttcggggacacgagttcctgtcacacccattttgccgtgacactgtacgggggggaggtgtactggaccgactggcgaacaaatacactggctannnnnnnnnnnnnnnnnnnncgaacaaatacactggctaaggccaacaagtggactggccacaacgtccaccgtggtacagaggaccaacacccagcccttcgacctgcaggtgtatcacccttcccggcagcccatgggtaaggggccttcaggcgactgaagaggagccaccagcccttggatgggcgtgggggaggtgctgggataatggggtgtgaggaggggatgagacctgggtgagaagggccagggagggatcaacacatcccaggatgctcttgcttcctctctctgggccagctccaaacccatgtgaggccaatggcggccggggcccctgttcccatctgtgcctcatcaactacaaccggaccgtctcctgcgcctgtccccacctcatgaagctgcacaaggacaacaccacctgctatggtaggaagccatctcctcctctaacagttacgggtaaactgaggctgaaggagaggtccctgctgttaagcaaaggaatgactggaaggaggggctctgaaaacttgctagcactggaggaaagagccacaactgccaagatctgacacagtctcttcacagttctcaacctgtgggtctcgacccctttgggggtatcaagtgaccctttcacaggggtcacataccagatatcttactattcataagtatagcaaaactacagttatgaagtagcaatgaaaataattttatggctggaggctacagcatgaggaagggtcacagcgttaggaaggctgaggaccatcatcgtagcaaaaggccaacagcacgcagggggattcaggggagacacctaacctaggtaggtgagaaacttgaaggcgagggactgccttcaatgactttcctgcgtcccacagagtttaagaagttcctgctgtacgcacgtcagatggagatccggggcgtggacctggatgccccgtactacaattatatcatctccttcacggtgcctgatatcgacaatgtcacggtgctggactatgatgcccgagagcagcgagtttactggtctgatgtgcggactcaagccatcaaaagggcatttatcaacggcactggcgtggagaccgttgtctctgcaggttctggccctgccctccaccccaaggctcataccagtcacatcccctgtggtcctgatactccttctccaaatcttatctctagcctacttcttgaccctcactccccaggtagcacactctcctcagcctataccctgcaaataccaaccacggactccctatttgtgcccccagacttgcccaacgcccacgggctggctgtggactgggtctcccgaaatctgttttggacaagttacgacaccaacaagaagcagattaacgtggcccggctggacggctccttcaagaatgcggtggtgcagggcctggagcagccccatggcctggtcgtccacccgcttcgtgggtcagtctgcagccccagggttggggagcacctgtgtgaggaggggaggggaggacccttacccaattcttggttcctttcccagcaagctctactggactgatggggacaacatcagcatggccaacatggatgggagcaaccacactctgctcttcagtggccagaagggccctgtgggtatgcacttgcccttcttgctcctgcaggcatctagctccattaggagatgctcctagtgtctctctggtgccttaggcctcttccagcttccagcttggtgcctactctcactataccttgtcccagagccacaaggttcagggagggctccatggctctgacacccactcttcttccagggttggccattgacttccctgagagcaaactctactggatcagctctgggaaccacacaatcaaccgttgcaatctggatgggagcgagctggaggtcatcgacaccatgcggagccagctgggcaaggccactgccctggccatcatgggtgagggctcgggtggaaggagggatggaaggagagcaggctaggcacagctgaacaggtgatggggggagatcctgaaggccactttccaccccctgcaagcctaatgacttctgcaagagagctgggggggctagagagatggctcagtggttgagagcactgactgctcttccagaggtcctgagttcaattcccagcaaccacatggtggctcacaaccatctgcaattagatccgatgacctcttctggagtgtctgaagacagcaacagtgtacttacatataataaataaatcttaatttaaaaaaaaaatctatatttaaaagaaaaagaggactaggaaagagccttcccaagagtcttattccctcctgttgccccaggggacaagctgtggtgggcagatcaggtgtcagagaagatgggcacgtgcaacaaagccgatggctctgggtccgtggtgctgcggaacagtaccacgttggttatgcacatgaaggtgtatgacgagagcatccagctaggtatgcagtgggcgcacaatgtggtgtgtggagggggtctgcggcgggagggatgaggggtggcagagagactgcagggctgtgaccatgagcagcctccagaacggggggggggtggtgagggcatagagggagggctttttaccttacccccactcgtgtgaaatgtagactcagtctggccagaaggtccagggatctaagaagacatgagacctaagaattgggttgggtgtgaccctgacaggtccagggtgaatccagtgacgttgtcctctctgagcagcccaagcctgtcccccaccaaggctcaccctttcttttcactcctgtgtcctcccgcagagcatgagggcaccaacccctgcagtgtcaacaacggagactgttcccagctctgcctgccaacatcagagacgactcgctcctgtatgtgtacagccggttacagcctccggagcggacagcaggcctgtgagggtcagttcccggcatttcctctctgtccagccttgaccccttctaccctattgctacattatgcgtttgagaaagatggtgttcatcgtgtgttaccaggaggcttctgggctaaatgcttatccagtgcccctttctgggtactgcggacaaaagctggagccagaaagtggggccagcatagtgagaagccggaccacaaagcgctagtgactgttcaggacctgcagtaggttttggtgagatagacaccggcggctgacagaggcaggccagcttggcagaagaggcgtgccctgtgctgtgccctgggtttatagagtgggtagaatctgatgcttggtaccttgaagagagaagttggtggtacaatagggtgtgcttaacatgccctgagccctgacttaaatcccagctatgtgtgcacgccttggagacagacactcatgctacataagaggcaagaaatatagctgagaagtcaagttccagggccgctgagccctgtcgagggcagcgtgggaagactgtgataaggctttgagctagggtggggacctgcgggttctcagccaggagtgcctagaaagtggtgtttggagattaacccaggggcagaaggcttgcagaatggaggagggaggaaccaaggcagtcagaccagttaggagagtattaggagtgtgtgcgtgaggaggcaggcccgaggcctggctactcaactggcttgcaaggaagggatgagacatggaggcacttcccaagagcctgctggtttacaagcttgcccttggacagcacttttccccaaagtgctctgccagaaacctcctgctttgatgtgggtgggtgttacagaaaggaaccctgggccgagcaacatgtaaacattgtgtttttactgtttggctcctcagaaccctgagtacactgagcatattttgggagacttttagtgtctgcacgtggtggtggtggtggtggtggtcgtctcttcttcttcttcttcttcttcttcttcttcttcttcttcttcttcttcttcttcttctttttctccttctccttctccttctcctttctcctttctccttctccttcttcttctcctcctcccccctcctcctcttcctctttttcctcttcttccttctcctcttcctcctcttctttcacagagtttaagcaaccaaggcttaatggagggattcactggggcacacattgtattcaagggatgggagtcagggaggattctgggatgcatagagagcagtgccttctcaaaaacaggaaaactggaaagaagactgacccaggggcaagcaggatgttgagaactttatgttgggaaaggatttggaactgagcagaggcagggcaatgagaaagttaaggtcagaccaagtgccaaactgggaatctagattttggagtcttgctgctctggttgtctgctgcgacctcccctgaggcccttggaaggaagactggggcagggtgctgagaaagaaatgtaagtctctttctgccctcttgtggtgaatagtggttctgcaggtggtctcccagagctggggctctcagaagccagttaggttgccatctcctgtccaaggtccgggcctcacacatggtgtgagcgtttagaggttcaggagatgggtagaagaaactgccaaaggggaagctgagaaaagcagtttgagggtgacaggaacctagctttgtcagcaaggctcatgcttaaagtgtttttgtgttgcaggtgtgggctcttttctcctgtactctgtacatgagggaattcgggggattccactagatcccaatgacaagtcggatgccctggtcccagtgtccggaacttcactggctgtcggaatcgacttccatgccggtgagctattgtcccggggattagtcagcatgccccagtagtttatgggagtgacacattaaagtcctagaagggctgcctgtactgactgtagcagctgcctcactccttcctgctgcctccccacttccaagaaagcacccggcacccacagcccccattcggtgctatcctgaccctcctcgtgatttgaccctttgccttgcctctgcattgaggggcattctcatgtctgcccctctgcttccagaaaatgacactatttattgggtggatatgggcctaagcaccatcagcagggccaagcgtgaccagacatggcgagaggatgtggtgaccaacggtattggccgtgtggagggcatcgcggtggactggatcgcaggtgaaatgaatggtagaaggaaaataggctttgggggaaaggcacaggccatggggacgtaaagtctgaaggtatgggcagaagccaatgggagctacaggggaagatttggatggaaggggaccaggtacaaggctccctaccaatctccctgaaccccaccgactgactccctcctcaggcaacatatactggacggaccagggcttcgatgtcatcgaggttgcccggctcaatggctcttttcgttatgtggtcatttcccagggtctggacaagcctcgggccatcactgtccacccagagaaggggtaaggagctaggcaagctggcttagatctcttgaccacagtatagtctgacaaggcccagcttctaagtgggatggactctcacccccacttccatccctacccacaggtacttgttctggaccgagtggggtcattacccacgtattgagcggtctcgccttgatggcacagagagagtggtgttggttaatgtcagcatcagctggcccaatggcatctcagtagactatcaggtacggatacaccctggagctgatgaaggcgataaccctagttctgagcctttccctatcagtttccctgtggtaaccatcagggttagacgtggaccagggagggtggtggcagcctttaacccatttgtcaccgagaatagtaatctgccctaagacgatggagggtggtcatgctgaagtagagtatgagaaagctgggtgtggtagcatatgcttaacactcaagaggctgagacaggaggattacttcaagtttgaggccatcttggactattcagtaagatcttacctcaaaaatttaagataaatacatagatagatagatacatagatacatagattgatagatagatagatagatagatagatagatagatagatagatagatagatacatgatagatacataatagatatatggtagatgtataaataggtagatgatagattgatagatgacaaatagataggtgatagataaatagatacatatatagatgcatagatgatagatagatagatagatagatagatagatagatagatagattttagataataaacataggtgtaggtaaatagatatatacatagatacatagagatacatagatatacatagatacatagataagaagctaacatgatatttgcctaacatgcttggtcctgggactagtctctaatgctgcaaatgagggcagtaacaataaataaattaaaaagtatagagtgagggtgtgtggtccacacagtaagtgtggttacacatggagccgatccctactggaaagcaggagttagagccccaaggtgagctgggtacatctgtccacagggcggcaagctctactggtgtgatgctcggatggacaagatcgagcgcatcgacctggaaacgggcgagaaccgggaggtggtcctgtccagcaataacatggatatgttctccgtgtccgtgtttgaggacttcatctactggagtgacaggtgaggggggctgggtcctgcttctcccatgggtttctcctttctggctttttagtgacataccctacacacggctttcccttctccagaactcacgccaatggctccatcaagcgcggctgcaaagacaatgctacagactccgtgcctctgaggacaggcattggtgttcagcttaaagacatcaaggtcttcaacagggacaggcagaagggtaaggctgggctctgggccaggccagaaaggtgaacaaggacagctgaaccttggaggaagagggaccaggcaggaaatcagtcagagcctccagggcactttccagtgattcacaagagctgggggcagggagttaggactgagcgggatagatcaagatattagataccatagctaagcagggatcagctgaaatttccaactgatccgaggacagagagaccaaagagcctctctttatgctatacaccatactaccttctgatgctctaccttccgatgttctaccctccgatgctctctgcccccaggtaccaatgtgtgcgcggtagccaacggcgggtgccagcagctctgcttgtatcggggtggcggacagcgagcctgtgcctgtgcccacgggatgctggcagaagacggggcctcatgccgagagtacgctggctacctgctctactcagagcggaccatcctcaagagcatccacctgtcggatgagcgtaacctcaacgcaccggtgcagccctttgaagaccccgagcacatgaaaaatgtcatcgccctggcctttgactaccgagcaggcacctccccggggacccctaaccgcatcttcttcagtgacatccactttgggaacatccagcagatcaatgacgatggctcgggcaggaccaccatcgtggaaagtaagccaagcccgagtcctcccaataaacagtggggcgatgggggactgtcagtgtgtggacacacaggcaccaaccaaacccacatgctgggtgggccccaaggcagggtttcccatatcagaaatacattataattcataacaacagcagcaaaattacagttaggaagtagcaacgggaaaaatgtacagttagggtcaccacagcgcgaggaactaactgtattagaggattgaggcaccaggaaggttgaggaccactgacctacggggctggcaggatccactgccattgtggtaacctgcacattgtcctttacatggagccagaaggaggcctcttccttccttgcactgatttcattccacaccaagatatgcaagcacaggcagcagacacgggcccaggtgcaactctccctgagtgggagtcagcagatccagcgagcttcttaccctgaactcaggagtcagggtctcaggggtgtgcacatgaaagctgagcctggcagccagtggccctgccagagctgtgaaagccacagagctgtcaccagaaagagtctcagcactcagcactgccttttaccacttcaggttttccctttgctgctgctgttgctgctgccgctgctgccgcttcctcctcctcctcctcctcctcctcctccctccttccttcctcctcctcttcctccttctcctcctcctcctccacctcctccctccttccttcttcctcctcctccctccttccttcctcctcctcttcttcttctcctctttcttctccttctcctccttgttcttcttctcctcctcctcctttctccctcttgtttttcttctcctcctcctcatcttcctcttcctcctcctcctcctcctctctccagccccacttcttcccggagcggaaggcttaagatttatttattttatgtatatgagtacaatgtcactctcttcagacacaccaaaagagggcatcaggtctcattctggatggctatgagccaccatgtgatttctggggattgaactcaggacctctggatgagcagtcagtgctcttaaccgctgagccatctcatccccacccccttcttctttacttctttacttcttttttttttttttaagatttatttatttattatacataagtacactgtagctgtcttcagacactccagaagagggtgtcagatctcattacggatggttgtgagccaccatgtagttgctgggaattgaactcaggaccttcagaatagcagtcagttatcttaacctctgagccatctctccagccccactcctttacttttttaagaaacattttgtagccacacataaccttgatttgaacttcatgatcctcctgcctgcacagcactggggtcatctgggattataggtgtgcgccactaccatacccttttttttatgttgtggtaggacttgaacccagagctttgtgcatgctaggtaggtgagcactgtgttacccaaggtctattcccattcctcctttgttcctctcttcatccaggaggtccattcagaccagccaggtgctgactaggtactgcatagaaaagaatagacctgtccctctgtccttctgtctcctggcacactttctctacgacatcctgtctgtgtctaaaaatggagcgtctgagggctggtggagctcgtgctcagcatgtgcaggacgttgggcccagccccagcacctaaactggatactctcaatctcagctccatcaggagagactgggagccagcccctcctatcacgctctctgttgtccgtcctacagtgtgctccgcctctggcagtcacatagacacgccccagggagccccggagcctccgctggctgctgctcacagcactgttcagctctgtctttttagttacatctgctttataaaacattccagctcagcccagcgtgatggcgcacgccttcaatcccagcacttgggaggcagaggcaggtgtatttctaagtttgaggccagcctggtctacagagtgagttcaggacagccagggccacacagagaaaccctgtctcgaccaccccatgctccccctccccccaaaaaattccagttcaaggcctctgcaagcaggaagctttccagtctggccccagaggaatagtagaattcagttagccggaatctcccccatacatgaataaacagaactccacttctgaagagtgtgaccacacataggccgggagtggggggtgggcaagagaagaggaaggaaggtgccacggatcatgacgcaggtggtgtgacgtggctctgtgaggggccctggggccctggcaagtctgaccaaagagccctcggaggaactcccggttcccacaattccaggggagccagtcatgcccttagcacctaccaggctgcccctctgcttctgctggttggcccttctcaacccacagctgttcctgtctcttcacagatgtgggctctgtggaaggcctggcctatcaccgtggctgggacacactgtactggacaagctacaccacatccaccatcacccgccacaccgtggaccagactcgcccaggggccttcgagagggagacagtcatcaccatgtccggagacgaccacccgagagcctttgtgctggatgagtgccagaagtgagctgctgggcctggggggtgggagctatgtcatacgggaacagaaaggggacaggcagggcccaccatttctggcctcagtgagatgcatcacctctcagggcgctgcttaatacaagtgtcagaaatgaagggaggttgagggccgtgggagatgcctctggctttgtgactggcattcatcacacagtaccgtgggactcaaagcttcagcgaaggctcactgaccttgaggatatgggctgggcctgttcaaaccccttgctgagcagaggtcttattacagtgaccaagaggcattgtgaaggcagttgtgagcacaaggccccaaagtgagaaaagcaagaaaaggtcaaacaggacagcaacgggactgcccaccatttgggcaaggctagcctgagcaggcagggagtctggtctacctgtcctgcctaccctgtctttcttcattttgatgtgcaggttactagtgagtcacaccctctgcatagcagtcctggctcacgtctgagcgacctgccctccccagttcagctggaatcagaatgctttctatcagcctcactaggaaactaaagcaatgccacagccttggtgacctcacctgtctgggctggtcctggggcctgtccttcctgggcctagagcctctggggaggggctgtcatgatatttttctgccattctaaaagaggcatcctcggtttcaaccaagtccctcctggctgagcccaggaaagtgctctctctttctctctctctctctagagccccagagccagtggcttcaaaaaaacccaagtacacagagaatggactggttggcagagggtggaggatttcatgactgccaaagacctgccctgtggaagtctgggagaatgtcatcagggaggcagctcaggggtgactagagggctgagattgtcttaggttaggggagagagctggaaggagccagtatgtcaggatagtggttcagccagccagccatactcctcctgatcctcactgaagcattagtgtccttggaaatcagatagttggacaggtagaacgtccactgtatttctagttgctgaccctctgccccaaggaagcctcccctcccccaccccaccatcccacaaagcagctttgccaaactcttaactcagggtacatcccatgtaagtcaatttggtgctccgctgtgagtgtggtctaggctggacttgagagtgtggaaatcactgtaaagccaggctgcacaagccaggaaacagcactcgggccaggcaaggtggtccatgactataatctcagcactggggaggtggatgtaggaacggtgggagttgaggtcattaagctatgtaactagttgaagggtagcctgggatacaacaggccctatctgaagaagggagagagagagagagaaagcatgctacagctgctgccccaggacaggctgaatgggtcgccacctccatccataaagagtcctgtgtgtggtgtgatgcattggggaagcagagcaggcagatctcttgagttcaggggtagcctggtctactgagacagtgccaagacagtcagagctacaggaaactcggtctcataaacaacaacaggccgatcctgtccctgaggaatgggtctccagggcctcaaagagggaggcaagcgttacgctgtggttgagctggaatgtagctcatctggcagacggttagcctggcacacgtatggcagcatgttcccgtaatcctagcacttggaaagcagaggcaggaggatcaggaggtaaagaacctcaagcccaggctggtgatcctagagagagaagagaacgaagggggtaaacagacaagttacaagttcaagttcaaacagacaagttacaagttcatcagtgaggtcagagaagggaggggctgaggcacggtggccaggtctattctgaaactgtttctgttttctttgctgcatctcaaaggaacatgtgcaaagggttcaccaccccaggtcaagtgaatgaatcaagctgtccaagggcgaccctgctgccgctgtgctgtgcttgatcctccccaccccacaccccaggcccttagcaccactccacaaacagtggggcatggcttggccttaagttcacatgtccttatgttgtgaagaaaactttttttgttttttttttttaagattgatttatttattatgtatacagtgttctgcctgcatgtatgcatgcaggccagaagagggcaccagatctcattgtagatggctatgagacaccatgtggttgctgggaattgaactcagggcccttggaagagcagccaatgctcttaacctctgagtcatctcttcagccccagaaaactatttttgagggtacaatccatatgtgcccaaggaaatagtcaatacttagcaagagtttcctgggtagtttgttaaagagccagcttcgatacagagaaagcagttagcagtaaatacatggaaaactctcattgagatgaatacacagtacttagtttttacaacctctgcagcaatattatcccccactaaataatagaaaaataggtcagtcagagtggtcgggcaagttgcctaaagtaggcaacctactactcccccccccccccccagcctacctggctggaaagtggtggagccaggacttggggctgggagctgactcgcttggccacacagcctccagtctcagcaaatgcagatggtcccttcccatactgcagtacgtgactgtgggcacacacagtcagatctagccacatagtgcagtaactcagtgccttggctgggctagtctcaggcaccgaggctatgttggctttcgtggctctcgggttgtgaggctcatcctgggttctagttgactccttaggttcctgatccctttgcccgtttcccatcagcctgatgttctggaccaattggaacgagctccatccaagcatcatgcgggcagccctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagtcagggcagagcaccagccagggagacccaggacacggtgagaggtcccattcgagtccttaactgtgggtagcctttccttcccagacggtctgtgacttcccgcggccctcttgcctcccctctctgtgctgttaagaccgatgaggggctcgaatgcagagacgctggtgcttctgtctcatcaggtgatcctaaagtcggagcccgtccacccctttgggttggcggtgtacggagagcacattttctggactgactgggtgcggcgggctgtgcagcgagccaacaagtatgtgggcagcgacatgaagctgcttcgggtggacattccccagcaacccatgggcatcatcgccgtggccaatgacaccaacagctgtgagtggggctaccacccgcagtgctctcctgatctctgcctgcacacttgtgcacatgagtcttgtctttcctgatctctgtgcctgcacacatgtgcacatgacagtcttgtctctcctgatctctgtgactgcataatacatatatgacagtcttgtctctcccaggatttcttctgtacagacaaatacctttacatacctttggcacccagaaactcctaaggccccaacatttctcaaacccaactccctcaagacacctgtgtacatacatggacttgatatactcaggtccatctcatgcaaaactgcatgcgcgcacacacacacgcacacatgcacatgcattcgtactgttcatggccctaggctcgtccccatcccaggagatcctatcactcagcctaataattccatctacccagagccacccacaccctaaaccttaccttatacccacataccaggtgtagcctatcatcccctcccccagcctgcacatagacatacatacctacacctggccctctcttgtgtgtgtgtgtgtgtgtgtgtgtgtgtgtgcagtgtccacatgccaccccatgcgaggttctccccgctgttgtgaacccccatggctgctggggtcgtgcagagctctggaatgttaggtgggcaatttgggagtgtacagggccagggaaccctcttcagctttcggtccccccactcccacccctgctcaggtgaactctccccctgccgtatcaacaatggaggctgccaggatctgtgtctgctcacccaccaaggccacgtcaactgttcctgtcgagggggccggatcctccaggaggacttcacctgccggggtgaggaagcaagttggagctgggacaggggctgctgtggggtgtcagcacaagagacccttattccagactctagcccaggctacaaggctggactcaggctaggtcgcaactcatgacaccttctccctccgcagctgtgaactcttcttgtcgggcacaagatgagtttgagtgtgccaatggggaatgtatcagcttcagcctcacctgtgatggcgtctcccactgcaaggacaagtccgatgagaagccctcctactgcagtaagggccctgctccagcccctcccccagtcccctgtgccatgtgacccagctccatagcctcagctcatgaagagcagagcttggaccttaggaagggacggtcattggtggggaggggggaaagaagccccttcctatgcctgctgtgaccacgcacaccctcccctcacagactcacgccgctgcaagaagactttccgccagtgtaacaatggccgctgtgtatccaacatgctgtggtgcaatggggtggatgactgtggggatggctctgatgagataccttgcaacagtgagtagattgctacatcccagcctcacccccagtcccctgccacacccctgccttacccctgcctcaccacagccatctgcctcatcactgcctcctgcctcacccctgcctcatcccagcttcaccctagcctcctgccttacccctgcttcactcctgccctcacccctggtttttagtctcagcctgtaccccatcctcactctggctgagcatttgtccccaggcactctgaggacaggcgagaactctgtcctgggcctttctggccctgcagagggacactggcctgatggtactggtgggccctgttctagagactgcctgtggtgtgggtgagttccgctgccgggatgggtcctgcatcgggaactccagtcgctgcaaccagtttgtggattgtgaggatgcctcggatgagatgaattgcagtgagtaacagcctgctcatgactgacagctggcccatgactgatggcctactcatgactgacagtctgctcatgactgacagttggcccatgactgacagcctgcccatgattgacagttggcacatgactgacagcctgcccatgactgacagctggcccatgactgacagcctgctcctgcctactttcctgtccctcctgcctcaggctgttctgccttatttcctctcagcccccctggccccaaatagtagcctctatcctctctgaccttgctttttctccctccatagaggtagtgagtcagtgggcagcaggcaccaaatctgaaaccataagtctaacatggggccagcaattgctcccatagtgtgtcttagaaggagctaggtgtgacccctcacccaccctcaccaccccttctattccatcttccacattggcccctaggtggcgccctgcccttcctcttctctcgtgaccccactgacccaccctccctccaccaggtaccacagactgcagcagctatttccgcctgggcgtgaaaggtgtcctcttccagccgtgcgagcggacatccctgtgctacgcacctagctgggtgtgtgatggcgccaacgactgtggagactacagcgatgaacgtgactgtccaggttggccagcggaagctcgccgggtgaacgggagacccggggctggcagtgtcttcatggctggcagagtcttcacatctcccttctacccccaggtgtgaagcgccctaggtgcccgctcaattactttgcctgccccagcgggcgctgtatccccatgagctggacgtgtgacaaggaggatgactgtgagaacggcgaggacgagacccactgcagtgagtgccctgggaccctacccagctcccacctcacagtccttatggaaagcgccctacacggggagacacctgggttccactgtgtctcatcctctcagactccagaatagagtcacttcttcagtttgtgatgagtcgctcacctgccctgcctttccttgtcttcttattactttctcctctattccagacaagttctgctcagaggcacagttcgagtgccagaaccaccggtgtatctccaagcagtggctgtgtgacggtagcgatgattgcggggatggctccgatgaggcagctcactgtggtaagcagtggcctgaatccggttcagggcggtcagtgtcctaccccctaaagaagggtccatataccagtgggccatgttatcacggctgcctgctctgccctgtcccctcctgagtctctctgtgtctccttgcccctcatgcagaaggcaagacatgtggcccctcctccttctcctgtcccggcacccacgtgtgtgtccctgagcgctggctctgtgatggcgacaaggactgtaccgatggcgcggatgagagtgtcactgctggctgccgtgagtgggagaggccgtgaggaatgggtgggcatcaagcctcgcagccttgctttgcaaacactggcaaatgaggtcaagggtaggaagaacttcagtgggagccgtgcgtttaaggagatcacagatccagacccctcccattctgcccattgctaccactcatgttgcaggaaacttaggattgggggtgggggagtgactatcaacagctagtaagtagggcagggcaggagtagggcaggcctgaggagggactctgcctccatccccagtgtacaacagcacctgtgatgaccgtgagttcatgtgccagaaccgcttgtgtattcccaagcatttcgtgtgcgaccatgaccgtgactgtgctgatggctctgatgaatcccctgagtgtggtgagtcccgtgactggaggagtagccctgcctagccgtgctggaggtccagcctcatcatcccctcccccaccacagagtacccaacctgcggccccaatgaattccgctgtgccaatgggcgttgtctgagctcccgtcagtgggaatgtgatggggagaatgactgtcacgaccacagcgatgaggctcccaagaacccacactgcaccagcccaggtcagcctctaggtggagccctttctccttcctgtgaccccactgacctgttcccaccacccttccatgttggcctctagatggctccctgccccttcctcctcctcttctgtgatcccactggaccagttcccgccaccctccacagagcacaaatgcaatgcctcatcacagttcctgtgcagcagcgggcgctgcgtggctgaggcgttgctctgcaacggccaggacgactgtggggacggttcagacgaacgcgggtgccatgtcaacgagtgtctcagccgcaagctcagtggctgcagtcaggactgcgaggacctcaagataggctttaaggtactcaggggatccgaccagagccctttgttcctccccctcatccctccatcgagtacttattgagaacccactctgccagcagtatactaggctctgaggacatagcagggcagacagaagtccctcttcagttagagcctcagagccagtgggctgtgttcacgggtgagaagagagtgggttgtcaagtagatatgttgctctggagctcaagctaaaggccaggcctggaggaagaattatcaccccagagaggctatttaaacccccgaggaagtgaatagagatgataaaaggccttagccagcactaagctacatcgagggactaggaggctagggaagccaccaagacagaatgacagccacatgaggaaaactcggagggacagggtgcacagattgcagtctgtgtgtcacttgcctcccccagccctcctgagggcctctaggcgtcgttggttcccagaagcatagactccagccgcttcctcagctgcacatcccttaccccccacagtgccgctgtcgcccgggcttccggctaaaggacgatggcaggacctgtgccgacctggatgagtgcagcaccaccttcccctgcagccagctctgcatcaacacccacggaagttacaagtgtctgtgtgtggagggctatgcaccccgtggcggtgacccccacagctgcaaagctgtgaccggtgagacgggcacttggagggtgagatgtatttcaggcagctgtgggattgggcagcaggtggcaggtagggagagggcttgatacaatgtagctggagatagcctggggtaccagggctgctggagatagcctgggggactagaggtgctggagatagcctgggggaccagaggtgctggagatagcctgggggaccagggctgctggagatagcctggggtaccagagctgccagaatatacctaagcttggagctgagccgagaccctcctcctacagatgaggagccatttctcatctttgccaaccggtactacctgcggaagctcaacctggacggctccaactacacactgcttaagcaggtgccaaaaccaagccttctttacacccgttgttgactgcccgggcccagtatggcctccccagttcttcccaccgccaggccatggttgtctccttctccctctccctccagccacatcctgactccagacatccttccccagatacacatgtgcccctgcagcagctgacttccctgtccccatcccaaacccagggcctgaacaatgcggtcgccttggactttgactaccgagagcagatgatctactggacggacgtgaccacccagggcagcatgattcgcaggatgcacctcaacggcagcaacgtgcaggtgaaaacagaaggctgccccgtgtcggctgacaggcacaccagggccccgctgacgagcctcacaccctccccatagtcctttgctgtaaaagagtctccccttctctcacacctgtcaacactgcttcgccctgctcctccctgagccacaggaaacgttctgctcgcttcaccttcccctcctctcaacttcaaaaagtgtgcaagcacagggagactcctcnnnnnnnnnnnnnnnnnnnntatgcaagcacaggagactccttcctgccttcccttgagttctgtgtgctctaggcgtgtgtgggtggccccagagaccccctgcttggagctcctggtgatagccacttacggtcaggagagtggagaagccatgccccggagactgagggtgccaccagctcctccttccctgtgttccttacaggttctgcaccggacgggccttagtaacccagatgggctggctgtggactgggtgggtggcaacctgtactggtgtgacaagggcagagataccattgaggtgtccaagcttaacggggcctatcggacagtgctggtcagctctggcctccgggagcccagagctctggtagtggatgtacagaatgggtgagtggtgggcagaggggttgggggagccctagaaaacacccaagcccggacaacctgcaggctcctggtgggaacagtctctagactcttaggattcactgctccccacctgccaggtacctgtactggacagactggggtgaccactcactgatcggccggattggcatggatggatctggccgcagcatcatcgtggacactaagatcacatggcccaatggcctgaccgtggactacgtcacggaacgcatctactgggctgacgcccgtgaggactacattgagttcgccagcctggatggctccaaccgtcacgttggtccgtatgctagagaggctgcccaaggccagcagacctggggggcagggatctaaagggtttagggtggcaagaaggcaaagtgtgcagaaaccacaacccagaggtcttggggtttcaataccctggcacttctctgggatgggcccagactccaggcctcaatccagctccttagaggaacaagggctatcccctgtgcagctcaggataatggcctgaggggtgggcacatgaggacttcctgaagaacacctgtgcttcacacttcctgagagaagctgtggcctactccagagcagtggtatggctgctggacagctatcgctgttgagccttaggaagtcgtagaagcatcaggacctgggattcattcccatctcagggttgtgatggggtttaaggaagacaagtaggcacagaacctagcctgtactcggtgcccactactgctgtgtctcccatagtgctgagccaagacatcccacacatctttgcgctgaccctatttgaagactacgtctactggacagactgggaaacgaagtccatcaaccgggcccacaagaccacgggtgccaacaaaacactcctcatcagcaccctgcaccggcccatggacttacatgtattccacgccctgcgccagccagatggtaatcgagcagaaaaaggggggagtggcaagcctagtccaagcatgaaaggcctgttctcagccagggtcaggttccctccccggcactgactgagcgttcctgctgggtcccggacttacagaggctataggtcccctagcagcttcagtctgccctgggctcaatgtggggtctctgacagccaggccctaaagtagtagagagcccagagattagtgagtgtggaccaagagcatcagaggaaaccctgaaagcagacatattcagggtaggatagagatgtaccaaggaggccagacatcctttagaaggctggaaaccattcccggcaggacccaccctcacagtcagagaagccagtgggcagccatgacccttcaacctctttctcctggcagtgcccaatcacccctgcaaagtcaacaatggtggctgcagcaacctgtgcctgctgtcccctgggggtggtcataaatgcgcctgccccaccaacttctatctgggtggcgatggccgtacctgtgtgtccaactgcacagcaagccaggtgaagttcctcctaagatgcccatgctgcaacaccccaatcccctgaccccacactcctgtttcccggcacccactaatgcctgcacctctggcatgccgacacccgcacacttcctgcctacctcttgtgtcctcacggcaatccttgtacactgccaccttataaacacctctaatactgatctcaggaggacctagagtcctcgccttcccatgctctccctgtacagacacccccttgtctggctttcctaggtccattgtagccctgctttctgtccagctctgccaccccacaaactcccactatgtccctgaaacgtttccaccccgtgaaagaaagccttctgagttcctcataccctttccaacccctcttgcccacctgtcctccagtttgtgtgcaaaaatgacaagtgcatccccttctggtggaagtgtgacacggaggacgactgtggggatcactcagacgagcctccagactgtcgtgagtgtcctcgacgcccccaagggatggagacctcagtggcctatttgctccctgctctttcttttttagtgtgtgcgtgcatgcatgtgtgtatatctatgtgtgtgtgtgtctgtgtgcatgtgtgtgcctgcatttgtgtgtgtgcctatgtgtctgtgtctgtgtgtgtgtctgtgtacatgtgtgtacctgcatgtgtgtgtgcatgtatgtgcttttgtggatgtgcctacgtgtgcatgtgtgtgtgcacgtatgtctgtgtgaatgtgtgtctgtgtgtatgtgtatatctgtgtgtgcatgtgtatgtgtgtgccgtgtgtgcccatgtgagtgcgtgtctgtgtgtgcctgcatgtatgtgtgtgtgtgtgtgtgtgtgtgtgtgcctgagtgcctgcatgtgtgcagtgtgcatttgccagtgcaggcatgcacatgctgtggtgaaatgtatgacagtccggggaaaactctcagaaattggctttctctttcctcactgggttctgaggatcaggcttaggtggcaacaccatcttgctgaacccatctcctactcctaacactgagtctcctttctcggcagccgagttcaagtgccgcccaggccagttccagtgctccaccggcatctgcaccaaccctgccttcatctgtgatggggacaatgactgccaagacaatagtgacgaggccaattgcggtaaggagctgcctagataccagccattccttccgcagcacttgggggttcagagagtgaggacgtgccagcctgcagcagctttctctctaggctacatttctgggcttaggaccgcagtccacccatcctctacaagggacagggaggcacctgcctgcccgccctgagttccctccttctccctctccctctccttctccctctcccagacattcacgtctgcttgcccagccaattcaagtgcaccaacaccaaccgctgcattcctggcatcttccgttgcaatgggcaggacaactgcggggacggcgaggatgagcgggattgccgtatgtgccgggttctgggaagtgggtgggggacgtagctggcacacaccgttgttgcccactgcttcccatagaggcgctgagttagctctattagcgggggacatcagtcacattggacatttcctggtttgctcgtaaaaacactgtgctcggtatggacagtctgcagatccaggctggggataatctattccttcctgactgagaccagggccaggctttctggggagcgcgtgggggaccaaagctgtgaggagataaagggtaaggtcctcgttctctgttccatcttgcagctgaggtgacctgcgcccccaaccagttccagtgctccatcaccaagcgctgcatccctcgcgtctgggtctgtgacagggataatgactgtgtggacggcagtgatgagcctgccaactgtagtgagttgtccgtcgcccctgggccatccttcctcacggcctctgtggctccattacccaggcagacagacccctccctcggctgccgtacccttgcccagtggctctctggtggggacgactcctcctcacccatgccgatgccttgcagcccaaatgacctgtggagtggatgagttccgctgcaaggattctggccgctgcatccccgcgcgctggaagtgtgacggagaagatgactgtggggatggttcagatgagcccaaggaagagtgtggtaagcccagccatcttgagaggatgggtgtttggggttctgggtagaaagaagttcagtggttgacctctctgggcggagcctcgacgtgacccagcgtggggctcttgtggaccccatagagctgacacgggaaggaagcttcccctgcagtgcccaccacctctgaatcctgctcctctccctctctgcccctcagaagagaactgtgcagaatctctaccctcctgttcacctgtcccacccccccaaatcagctgccttccccaaacactttgctggccttccccagaacctcctgtagataccacacggcaattatcactgcctgagccccagagcaatctctttcggggggcaataaccaccttctctctgccgccggtctcacttgtctaccctagactctaacatctgccgcccactccacccctgaccgccccaatatctgcctccacatcttgcctcccccagatgagcgcacctgtgagccataccagttccgctgcaaaaacaaccgctgtgtcccaggccgttggcaatgtgactacgacaacgactgcggagataactcggacgaggagagctgcagtatgtcctacgccttaccctgccccatcatttcctttcccaggccttggcatctccctcctcagcacctcaccccttctaacccccaccccgcgcaagagggtggcctccaagggcaaggggtcaggcacccctcagccgcgctctaccctactctatgtccttgtacttgagcttgtgacatttcatctcatctcatgtttctctccattttcacactgtcctcttggggttgcagaggtaggtgtctctggtgtacccctgttcctgccagctctgcctctgcctggagccccgcccatccctgtgctgtgcttttctgcccaccgtccttaactggcctcttccccagacctggcgcttgtctcggtggtcttgttctcccctccctcccctaagtgatctgtcctaaggacaggaccagggacccgtgccctctcccatgtgtctgtacctaataggataagtgtgagtaccctcctgacccagccagtctcgtgaggacagccagttaaacactgtccgccattggttgagtgtctcaatcattacaccagtcggctgtggcctcttcacagacggacgtagggatgagccttgtgcttgggagttagtatttctgagggctggagatgccctgtgcccaccctgctgggacctgtctctcctcagcacctcggccctgctctgagagtgagttttcctgtgccaatggccgctgcatcgctgggcgctggaagtgtgatggggaccatgactgtgccgacggctcagacgaggtgaggagagctcgaggaaaggggtggtctcggaagaattagggcaggaccccaagggtctgattgggctgctggtccccatgcccacagaaagactgcaccccccgctgtgatatggaccagttccagtgcaagagtggccactgcatccccctgcgctggcgctgtgacgcggatgctgactgtatggacggcagtgacgaggaagcctgtggcactgggggtgagtgagccccttcatcctggtgcctccaccctccctgccttccccagcccactgtgtggcccagtttaatcttttaattcagccatttgttggtactgcaacaaacccttattaagcatatactgcaagccaggcatagacctagtgttggagcagtagacaagactcaggctcactccgtgtgcattttatgcaggttttaccctgttgtactaattcttttcatcttcactgggggtttctaccctcctttaatcactcagttcccagataaaagacacaaaacttttatatttatagcaagccaataacataccagagctaggcagatatccaccctctaagctatttagaatctacttccccatcaataaccctgagatacaacttgccatgttccatctgagcagctcttaactccaattggtgagccctcttggacatgttttcatgactcacctaccccatggcatcttctccctctcctggtggtccctgcctcagacccccagcctgggaattgaaaccccacctatttctcttttgtccagctataggctgtaggcatctttattcaccaatcagggataacttgagggacaaggttacattagcatcacttgggtccctgtgaaaatctcctgctccctgggggcaaccaggaccagtatttagcaatatgatacatagtgatacaatacaatacaatacaaagtgatacagtacagtacaatgtaacagatttaacatcagcggtgctctaaccttgctaaggaggctagctaggtagagatcatgcagacgcctgtagtccaggtccacccatgccttttccacctcccacccagttgcctgtgttaagaggccagttcctactcatcttccttccctggggcaggcggtgagtcaggggctgctctagccaaacatgcctgggctcagccactggaggggtcagtggacacctgtcagaagagaagcaggggtctcacctgcaaggcagccttctggttctgccccatgggctgatggtagcaaccaaagctaagtctccaaactgccgcacatctgtgcctgccacagactatactagactcgggtgtcccacctcacctactcaaggagaacatcctaaacccctgtcaacactgccccaagtagcctctcctccccctaaataccagaggaagcacattgcccctctgcccactgggcagaaaatgaagacgactgagtttgattcagtgacagtttctgtgatgacccccgggcctcagtcccacccacggtgcaagtgacagacagcatcctgcagccgcagttgcattcattcttacccctctgttcaccctgcacccagtgaggacctgcccattggatgagtttcaatgtaacaacaccttgtgcaagccgctggcctggaagtgtgatggagaggacgactgtggggacaactcagatgagaaccccgaggaatgcggtgagatgtagggaggcggggggctggagagatggcttggaggttggaggttaagcgcactggccgctcttccaaagatcctgagttcaattcccagcaactgcatggtggctcatgacaatctggaatgggatctggtgccctcttctggtgtatctgaagacagcaacagtgtactcatacaaataaattagatagatttaagattaggggtcatccacagcaaggatgctggagacctggcttctatactccccagtggccagctcttccctaccacttgcccccaacactgattgtggctctgtctcctggcttctacagcccggttcatctgccctcccaaccggcctttccgctgcaagaatgaccgagtctgcctgtggattgggcgccagtgtgatggcgtggacaactgtggagatgggactgacgaggaggactgtggtgagctgagggcaatgagccggggctgaggggacctgcatctggggagcagactgctataaggctttcaatctggcaagagtggagcccttgggaaaggtatgggtggcctcctggagccctgagtctgcaaggtcagcacacacaccctcagcttggcgagcagccaggacacacctgtgttcatgaagtctctgtggatgtacgggtagtgtgctctgtatccagagcctaaagcctctcccctccccagagccccccacggcccagaacccccactgcaaagacaagaaggagttcctgtgccgaaaccagcgctgtctatcatcctccctgcgctgtaacatgttcgatgactgcggcgatggctccgatgaagaagattgcagcatcggtaggaccagacctgagagcagagggtgggtgggcaccagggggtgtggctcaggggaaaaccagagggcagggctcaggggaaaaccagggggccgggctcaggggaaggactccaccatctgtcctccacagaccccaagctgaccagctgtgccaccaatgccagcatgtgtggggacgaagctcgttgtgtgcgcactgagaaagctgcctactgtgcctgccgctcgggcttccatactgtgccgggccagcccggatgccagggtaggagagccggatgggagatggggcaggaaccccagctcctagactcccccatgacgcccagtgtaacccccagacatcaacgagtgcctgcgctttggtacctgctctcagctctgcaacaacaccaagggaggccacctctgcagctgtgcccgcaacttcatgaagacacacaacacctgcaaagctgaaggtgctagaggccggaagggccagaagggcctgaaggggcagggccagaaggaagggtggaagggcctgaaggggcagggccagaaggaagggtgggcagggtcgggccacaccagctataaaatggagctggcctggagtggaacattcccaatggcacttcgttgctcagacttggatgcccagactcaaggtacaccgggatgccatcccgagcaaagcaaagcacaggaaaggtagaaggtaccgcctggctttctggggaagttctatgagagcaacactcctgtgtggcacacagtgtcccctcccctctcctagattgagagtatagtccgactcacagtcacatgcacccacctgcatgttccctccatgccctgacacagcactgcacctttcatatgtcctcacaccgtacatgtacatggtatgcatatacacactcccatgtatacatacatttctcatgccttgcacatatcctccacatctctgtaccgcttcagcacttatcagagtctgtagcagacctacatgctaaccagagaccacaagatagaattcttggaactatcaggaagcaggtaagagaagaacagatttctgaagggtctggtcagtctggatcagcttggggcacaggttagagcccttggatctgccattggctccacccacaccggaaacatccccttctgtctaaaacaaatggtctggttagatcggaggctactgtagtgtgacagggtcttggtcaaatgtgtcccagggatggaactcgggccctgggttctcacctctacctttcaagcccatctgataggtggtctctctcactccggcaggctccgagtaccaggtgctatacatcgcggatgacaacgagatccgcagcttgttcccgggccacccccactcagcctacgagcagacattccagggcgatgagagtgtccgcatagatgccatggatgtccatgtcaaggccggccgtgtctactggactaactggcacacgggcacaatctcctacaggagcctgccccctgccgcccctcctaccacttccaaccgccaccggaggcagatcgaccggggtgtcacccacctcaatgtaagcatccagcctgtcagagatggggtggaagagctccgcaggacagagtgtaggggctgagagggcagaaaactagaagacaggagtggtcaggtcagcctgctaggcacagctaacagccagagcaataagtagtatttggggctggagagattgctcagtggttaggaacaataactgctcttccaaaggtcctgagttcaatttccagcaaccacgtggtggctcacaaccatctgcaatgggatacgatgccctctggcactcagcagcatagcctactctgatacctctgagtcagtactggccaacttgcttaatgcgtgggctttactttattgacaaaatgaataatagctctcctgggcttaagtagagttcagaggtggaatgtgtgaaaccctaggcttgatcctcagcaacaatgaagatataataatacctagtcttctaagcttctttatagatctggctgcttgggtttttttgttttgttttttttgttgttgttgttgttttgttttgttttgtgctaaatttgaactaaagacttcatggatgctagccaactgctttagcaatgaactacactcccagcttcagactgctttttttttgtttttttttttaatacattgagtgtgtgtgtgtgtgtgtgtgtgtgtgtgtgtgtgtgtgtgtgaatcacatgtacataccacggcacacatgtagaagtcagaggacaacttgaagtttgttctttgttcctaccaggagtcccagggattggaacttaggtcctcaagcttggcagcaagcacctttacccactgagccacttcactgcccccaccactttttaaaagtgagaattaactagaaaaccatgaaaatgtgcctggcatggtggcgcatgcctgtaactccagctgtattcatagcagaggaaggaagagcaagagaaaagggtcagtctaggctacacagtgagttccagatcagcctgggctatgagagagacctattcaaaagcaaaagaacctagaaactgtggtcacgtcagtgtggggtgacagacaagaacaggtgggcagaccaaggagaatgggggtgacaatcagggagacagaagatggcagtcgctgaacatatgaccccacttagatttcagggctgaagatgccgaggggtatcgctatcgactgggtggccgggaatgtgtactggaccgattccggccgagacgtgattgaggtggcgcaaatgaagggcgagaaccgcaagacgctcatctcgggcatgattgatgagccccatgccatcgtggtggaccctctgagggggtgggcacgggtcctgggggggaggtatctgggctggtgtccctcaagacaggtggtaggctcgacatccacaggcagggggcagagacctcaggctgctaggcttctccagtcctggccctcctaaagcctctgtcggggactcccagttgaatagctttactggcagccaagatctgggaccccctgcaggcatagccctgcccattcagatgctattggcttagcacattgtagttagagcagatgatgctagcatgggtcggcagctgtctcctggggctcattgaaggggacagggtgtttcctcacaatacccaggagcgtccacaccaggccaggtgccctctcttccatctcactctgtctccttggccctgggatccaacccactctcatttctcccttcccagcaccatgtactggtcagactgggggaaccaccccaagattgaaacagcagcgatggatggcacccttcgggagactctcgtgcaagacaacattcagtggcctacaggtccctggggcaggggtagggtgtggaaggggcagactctgatcatggctgcttcagaagtcacccctgcgtgcagtggggcgggcaatctccagcagatcaggccgagggccatgggagtgcttcccggatgggcggctgggagagatcctatgagccgggtaggatacatgccgtggataccagacagagtcagctctgttctctgcgcccagcctggcgtgacagaagctgatctctgacagacagcattctctcaccccagggctggctgtggactatcacaatgaacggctctactgggcagatgccaagctttcggtcatcggcagcatccggctcaacggcactgaccccattgtggctgctgacagcaaacgaggtgagggtgctggcaggcttggtccccaacatggtccccaacatcatcagcaggcttctcactgagctcaaggatgtcacttcagaagcctggcacccggccagcccgtgagcctgcgcctacctgaccattttattcactctaccaacaagtatcaagttgtgtggggtcagcagggtaaatgaagggagagagagctaaagtcccccatggccccagaaatcttgggggtgatgaggcaatttgccagtggcagggatagttctagatatgttaggtctgagacgcctacactgacaggtgtcttaaagactgggtccagggcccaggcgcctgtagtgacttaacctggctgtccctgcaccccaggcctaagtcaccccttcagcatcgatgtgtttgaagactacatctacggagtcacttacatcaataatcgtgtcttcaagatccacaagtttggacacagccccttgatcaacctaactgggggcctgagccatgcctctgatgtagtcctttaccatcaacacaagcagcctgaaggtgcatcagagggaaaacccggggtgtggcagggtgggtcagtgataaggagggtgccgggcagtggtggcgcatgcctttaatcccagcacttggaaggcagaggcaggcagatttttgagtttgaggccagcctggtctacagagtgagttccaaggcagacagggctacacagagaaaccatgtctctggaaaaaaaaaaaaaaaaaaggaaaatgttctaagtccacactgctcaacatcgaccccttccaacacccacagtgaccaacccctgtgaccgcaagaaatgtgaatggctgtgtctgctgagccccagcgggcctgtctgcacctgtcccaatggaaagaggctggataatggcacctgtgtgcctgtgccctctccaacaccccctccagatggtatgcatgcccttttcccgggtacctgaggatcccttacctatagcctctggctccccttacccttgacccccttccccttcccatgctctgatgagctcttactgcagcccctaggcctggaacctgcactctgcagtgcttcaatggtggtagttgtttcctcaacgctcggaggcagcccaagtgccgttgccagccccgttacacaggcgataagtgtgagctggatcagtgctgggaatactgtcacaacggaggcacctgtgcggcttccccatctggtatgcccccaaccagggatggtcctctcccatcatcctcacctggccccttctatcgcctccagcatccacttcaaccccatctgttcgtcaaggtgcctaggatccctgctataggcccaggtggtccccagtgccatggtcccactcacagatcctctcccaccaggcatgcccacgtgccgctgtcccactggcttcacgggccccaaatgcaccgcacaggtgtgtgcaggctactgctctaacaacagcacctgcaccgtcaaccagggcaaccagccccagtgccgatgtctacctggcttcctgggcgaccgttgccagtaccgtgagtattcacctcaaccccagggaaggaagaggggagccagaaagaacccaaaggagcaggttgagaggatggaagacgtacgcagatgagccaagcccaggctgtgggtgctgcctctcatgttggcgcatctgcctaagcctccaggcattcaacacaaggaatgcttagggtcatcctagtgttctggggtctgtgacagggcattaggaggctcaggagtgggtgggagttattcataagtcctggaccctgcataaggtacttcctctccactcccaaccacagggcagtgctctggcttctgtgagaactttggcacctgtcagatggctgctgatggctcccgacaatgtcgctgcaccgtctactttgagggaccaaggtgtgaggtgaacaagtgtagtcgctgtctccaaggcgcctgtgtggtcaataagcagaccggagatgtcacatgcaagtgagtggggggtcttgcctccacattctgctctgtcttctggccccgccccatcctgcccctcctgggcccgccccctctccgggcccttccggccccgcccctatcttgcccctcctggcccggttcctgttctagcatcccagatacccttctgcaagccccagctccagattttgattcctttccacagctgcactgatggccgggtagcccccagttgtctgacctgcatcgatcactgtagcaatggtggctcctgcaccatgaacagcaagatgatgcctgagtgccagtgagttggccccgccccatcaaatctgagcaaaggaacaatatgacctatgacctcctagttcctgcagctaaaatggtcgtggaggtgatgcccacccactgagttttgctttcttgcctgcaggtgcccgccccatatgacaggaccccggtgcgaggagcaggttgttagtcagcaacagcctgggcgtaagtggtggggagggcagggctgccacgacatagagcaagaagagccttacacctcccatctccctaggcttcagactcagtttcccgacttctctctccagatatggcctccatcctgatccctctgctgctgcttctcctgctgcttctggtggctggcgtggtgttctggtataagcggcgagtccgagggtgagccactgggagtctgagaaattctggctgttattttacaatccgataaccttaccaacatcacggttcggttccctgactcctgcctctccccagggctaagggcttccagcaccagcggatgaccaatggggccatgaatgtggaaattggaaaccctacctacaagatgtatgaaggtggagagcccgatgatgtcgggggcctactggatgctgattttgcccttgaccctgacaaggtatgccagaggccatcgaaggggcttctggaacaggatcaaaggccggaggggtggggttggggtgatcaaggcaaccagaggtgttacacagaagtgggagctggggtattctaatcatatgaacctttttttttcccagcctaccaacttcaccaacccagtgtatgccacgctctacatggggggccacggcagccgccattccctggccagcacggacgagaagcgagaactgctgggccggggacctgaagacgagataggagatcccttggcatagggccctgccccgacggatgtccccagaaagccccctgccacatgagtctttcaatgaaccccctccccagccggcccttctccggccctgccgggtgtacaaatgtaaaaatgaaggaattactttttatatgtgagcgagcaagcgagcaagcacagtattatctctttgcatttccttcctgcctgctcctcagtatcccccccatgctgccttgagggggcggggagggctttgtggctcaaaggtatgaaggagtccacatgttccctaccgagcatacccctggaagctggcggcacggcctccccaccacgcctgtgcaagacactcaacggggctccgtgtcccagctttcctttccttggctctctggggttagttcaggggaggtggagtcctctgctgaccctgtctggaagatttggctctagctgaggaaggagtcttttagttgagggaagtcaccccaaaccccagctcccactttcaggggcacctctcagatggccatgctcagtatcccttccagacaggccctcccctctctagcgccccctctgtggctcctagggctgaacacattctttggtaactgtcccccaagcctcccatccccctgagggccaggaagagtcggggcacaccaaggaagggcaagcgggcagccccattttggggacgtgaacgttttaataatttttgctgaattcctttacaactaaataacacagatattgttataaataaaattgtaaaaaaggaaaaaaaaaagaaaagaaaagaaaaaaaacccactgtgtctgcatgctaatgtgagaatttgggagctggggctgtgcttgcctgttccagccaccagagggagcattgctgcatgctggaggctggcctgagaatcctaaggtccacgtctccagccccactccatcctcctgtcttgctatggcagggaagagctgttttgctcagtgtatgaccttgagccttatgatgtgactggtaggatctggtgtcacccggccccagtgcattgactcagacatgtgcttcactgttctcctgccctacactggccccacagtgagatgccaccctagaaaaaagcacactgggtaatgaaggcctttaggaaggtctgctccatgctccttttgaaatgttgacatctcactctatgacctatgagtaaaaccctggctgttgggccagcagaatggctgggtgggcaaaacacttgactttgcaagcctggtagcctgcgtttgctcttggaacccatgtaagagtgggcaagaccaccgggcagtggtggcgaacgcctttaatccctgcacttaggaggcagaggcaggcggatttctgagttccaggacagccagagctacacagagaaaccctgtctcgaaaaacaacaacaacaacagcaaaaaaaaaaaaaaaaaaaaatgggcaggaccagctctgtaaaattattccctgacctccatatgtacgctttggcaaacacagaattttttttttaattaaatacctgcattaggggatgagatagaggggaggagagccagcaaggctcagtttgcccatcagcttccgacatatgcctctctctcaacaaacattgcagacattccaggagttgaccaggaaaggacttacactatcttagttgttccagatctccttgaacctctttcaaaggggaatgaaccccttgcggaagactatgcagctttacactgtccaggactgggggagggttagaaccctgctcttctaacagcagcaaacaatgcctcccaaaggagctgtccagcttttcatctctgaccctcccagggtatttctcctttgaatcctcccctcggggaagcttatgggtagatgaacatccaaagacaagaccctccttttctatcatcaattttatctccaacctcatccctgaagcccggctatgagatcttccttgctcctccagactccttatgactctgggatgagcgatcctgctgggaataaaatgggggtgggggtgggggttgggggggggtcattgttgatccttaaatgttgacttgtggctctttctggccaccaggtggcgtctacactgctgtaacactgcttatcctaaagctccccacactaattatgcacctgctgccgaggaccctagcccagcctctcacttccttccctggggctattttgcgctgacccttctaccctctgtcagccatcttccttccctcccccagagtctgctcattccccaccaccagtaatcccaccctctccaccccttccttctgccagcctgcatctgtagccccccccccccccgagccactgattctctgcctgtcacctcaagatctcgggtagaacaagacaggcccccaactgctgctttagaaagcctaccccttcgttagcaccctccctctctggccaggaccagaagggtgcactatcttcaaccaagccaaatgcaagggagtctcaaaaaccaaaaaggacactgactgattcagatcagattgaaaagcagatattcttagatggaaagagtcagggacagaggcaaagacccagagataagtactgtgcacatgtgtgtatgtgtgcatgcacttgtaatctctgagagaattggacggcctgagattagctaaaacgatggtgatggggagggtcaggtctcctacagatagatactttggccgtgggcttctaggcacccaggatgtgtgaccaccctttgccttcacccagaactaaagcagctcctttgcttagggtcagccctggccagccatttggccttgtccctgacactttgtctcatcctgcctttattcgttcagccctgactgcaccccaaatcgctgctccctggtttttgtctccttgagtgtcaccaagtacacccctgtcctttccctgaccctcttttcagtgtctgtcacttcctgtgtgtctgttattttcatatccctaggcttgtctttcagattgcctgtgtgtgtgtgtgtgtgtgtgtgtgtgtgtgtgtgtgtgtgtccctgtaggtatttgcctctgtcaaggcaagaggtactttgggtacctagctgtttctgtatatcactgtatgctactgtgtgtataaatcatgtgtgtccgtctctgtgtgcttatgtgcctctgtgtatgctggtctgtatgtgaagtggcctcactgctacagtgtagcagggtactattacagtggggtaagcctggagacacaccttgggatgtgtgtctgtctcttcatctctttgcatggtcctatctcttgctgtctaggtgttggtcatactacctactcagcctcagacacagcgcatagcaacagctgacagctgaagactccctgggtaggggagagagagaaagaccagtgggaggaggaaacacgaagaaacagccctgaggatgagaacagagaccgtgctggagctggggacagagagagacaaggacagagatagacagggaaggggacgggatgagaagagctgagagtggaagatgggattgtgggagagaaagcacagggctcgtaccaagaggggcagaaggcactgaggacttcctgcctagcaccaaacaagggtgctctggatcaggccagggtcaacagtgcggatcaggggctaacttaaaagagccggtttagccaaggggtccgggggccgcagaggtgccgcggggcggggacagggcggcgggcgccgtttgtcagccctattgacagacgtgatggggtttccgtccgtgatcaatgattctcatctccaggccgaatgagccgcggggcgcccatccatccccgtcagcgccgcgctcagtgctagtcgcccgaggccccgcccgccctcacctcggtccctgtccggatcactgccctagacctacctctgccaggattatagaaacaccccccacccatccacctcgggcattacaggacagggtcctgctgcgttccctagcctgtgtatgggaactcatgctccgcgacgaccccttcccgctcacagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgcccgcgccccgcccccagcgccttgctccgctccgcgctcagtccgcgggccgagccgcccgctcccgctgctcgcgccgccgccctctgcccggcgtccctcaccctgagcccagtcctgccggactcgggacccgccctgcccgacccgctcgaccgctcgggaagatgcggctgctcccggaatggctcctcttgctctttggtccttggctccttaggaaggtaagggtggcagagccaaggtgcggggtccgggacacgaagaacactgcatgccagggggctccgcgcgtccgccccgcccccagcactaagcgtcccaactttgtgcgtcgtgggggacgtggacagacagactgcccgctttaggactggcatgcacccagcaagttggctgagggttagaagaaggtgcagggtggaggcccggctccagtcggattcaggcgcgacggggggaggggacgaagcgcgacccgcgagtgcgccagacagagaaggagtgcgagacagacagacaagccagcgggtgttagcctagccttctttccgcacctacctcgcttgcctccctctgtctgtctgtctgtccttccacctctcaccctccaccttcccattcctcttctccttgtcacaatgccaggtaagctctgcgatccgagcatacattatccaggcacacgcgcttacacggacccacaccagcagggctgaacttggctacaatcttccatcccatttcccgcggagacaccatctcccctgcataacctcacagacacacccccctctcacgcctggtggttgttgtctgggaggggagtctctccttacatctccttcctgcccccacccttctcactgtctcttttcctggggtttctgggtgaagacccaaaggctaaaagggcccagagctcatcctgcccgactcttgccttgagatcttcagcccatatgggctcacagtgcggacatggagtgtatgggttaaaaccagcccttgtatgcatgtgtccagggaatccaggcactgggacccaaggtgaatgtctatgttggcatgccatggtggagacattgtctttgcatggttgattgtgcctgcttcaaagcactgccatctatttgtgccctgaagtgtgacccacaagggtagtttagactctgcccccaacttcctttctcaactatgacctacccagtttaagggcaaccagttggctccacaagccctcactcttggacctcaatccccagtctttaagagaaaccagtaattctcctccaaaacgcttggaccccaggcctggtgtggtgtcctcataacaacaatagggtagacactgccccagtgagccagttagtagagcccttggattctcccaagcctatctgcctagtgaccttgagagaacggaaactgggcaataaataaataaataaataagaaagaatgaacgaatggatggatggatggatggatggatggatggatggaaaaaaaagaaagaaaagaaaatagccccctagtgtgaaaaatgctgcctttggcaagagctttctttgaacctgaggcctggtttgtacccagggagactgcaggagaaggtccagccccaaacaaaccacagtatgtgaaggcctggggtcacagaggaaggaaggatacattgccctgatccttccctccacccccaccagccttctccactctcttcgcatcaaattaactcccctgtggacagatctggtttaatttcctttgccccctgaagaggaaggaaacatctggtagagccttgagggagagtaagcatgaggatgataggagagatgggaatctgtcttcctgtgagaaggctgcagctgtggggtggctatgtcggaatcagcagggaagtgcctatctggcatttggtccagcctgtggacatgtgagggtctatgtttatgtttggtttctgaatacctgttactttgcatagggtcatgtaaggaaatctgttctccaatggacttaggagaaaaacagtggggcgtgtgcacatgcacagaacccccacccccggggtctctgatgtatttgcatgctggaacacatctgtttttttgcctgtgaatctgggtctgggagtgtgctcatagcttcaagtgccagcaatcacggattgtgagcctcagaagggctcacctgattgtgaacgcatacgtgcactcctgagtgtgcctgcgtccagggatatcttgatgccagaattgggagtgagcatgagataaagctgacactgggttgagcttttgatgggcacagctcttgagatggctcttggggaaatcttgaccatcgatgctgcccgccctgccttcccgaggacttctctgcttcttcctctactttccagctcctgagactcctcacacgttctggttcccctggtttccattgcatctagggctctgacttctggactgaactggctgctcaggatctttccaatacaatcttcaacctcctttccctccgtatctctgtcttccttgccccttgccaaagcagctgcctactgggaaaaacagcaggcgatcaatagtcactaatcactaatcactaattactaattagctgggggagggcaggggcgggggtcctgtgggacttttcagctctatcctgcctcagggaaggattacagctacacctctctctctctctctctctctctctctctctctctctctctctctctctctctctctctctctcggtctagaccagccacaacccttgtgccaaccaccacctcctacctccttaccctcctcaagccccctaactaatctctggctgggccacttaggcacgcacagcctgggcttggtcccagcgctgctggctgggatttgggggtaatcaggggcggcagctgggccagggatactggaggatggggtctaaagtgacagcccccttgggccagagcttgcagctaaacctcacatcctgaatgggaggggcgccactggaaaggagaatttccagggggtcatggttgggctgggtgaggagctagatagagctctagaaggaggcgatggtgaagatgtttgataagaaagcagacagcaggtaaagaggagtcactggggtcagggacccatggtcagagagtggcaagataaaccttgataagccagcaggtaggtgaagggacccttggaggggtcaataaggattaattggcaaggcgatagggaacttcgaatagggagaaccctgtaaccaaggataggcgtgggcaaggggacaaggttaacagagaaagggtcaggttgtgatgagaggttttctggttcaagctcaaaggggctcccaagtatgtacagtagaaaaagcgaaccgggatagggagctgggagtgcggccttgagcactggaaattggcgagtctccccttctcccctgcccgcccctcctccacctctaccccgcccactccccctacggctcaggcttcgggaaattacatccccgctccgcggctcccccccccccccaccgcgccctggagccggcgcctttataggcacatttattgcaataataaagtgaggcgcggggcggggggcggggggcagccattcccggggggaccgcgccggctctaggaagcaaggaaataaaataaaataaaataaaatcaaaattcagataacggtgagccttgcgcagcaggccgcgggcaggcgagagggtggggctgcggaggagagggcgattggcccaaggacagagcccacctcaccagcaggccctcacccctgctctgtagaagaggtctttgcctccacttgcctgaccccctcccaaacttgatgttgaagctggccttctgccttttcctgtctcctccaaatacctgtcctcaagctcctgtctgtttccatactgcctgtcactttcctggttcccgagatttcccatgccagccccccccccccagtggctccccctaccctatctcctgggtctctatccatcagcatcctgttttcttcttaaaagccatcttccttcctccctttctgctttattccatcctgcccccatgactgtctccccaaaccatcttcaatgccagccagtctccagagtccatttgtcattgaccatgactgccccacttcagctcctagcctccatcttctggtcccctgaccagaggccttctaggtctctgcctaatacctggtcatcatttccaatctctccactcttgtccccaggtctatccttgtgggagcctcatcctcatatcctatgctcctacccaaccctagccccagaccatctctgccctaatgctcacctcagcccgtcctgtcttgtccacccacaccctgacatacacgccagctttattcccagctcccagccagacgtcaccccaccctgacctgactgcagagatgactctcaacttgcagggactctgtattctattgcttgcttccccaaccagggcctaaactattgtcttcctctgatgaattgtaagttctttctgacccaaagggaaaaagagaagcaacggattagtctggaggcccctggggagtgcaccctgcaatgcggctaagggggcctgacagcacgatcctctctctctctatccccaaagagccttcatggagtttgtttagcatcaggaggtggcctcaactccccctcaggtgcgtgggcctgctgccttggggcaaagtgttcctggctgagttccttccgaataggcctgaaggagtctgctggaagcccccctaaccaccaccacacacctccacctcctaccccagctgacagccagcatgctagcctctcccctctgcaaatgtcactgcgcccaattagtttaattaaactagctttcaagtgggggggtcccccttggtcaacacccagctcaggccctcagtcattgcggggtgggctctggcaaaaaggagctcccacaccaccttgagttttcctgtgccctcccccatatccattactggaaactgacaaccagaaagacagacagaaagagagaaaaggggggtgcttccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccacccaccccacccccaggtaatccaggcacaaatatacaatggacaggcagccactgagagcagatgggacccacacagcctcctcaggct

SEQ ID NO: 668 - DNA, 10373 bp, Mus musculus
atgctgaccccgccgttgctgctgctgctgccgctgctttcagctctggtctccggggccactatggatgcccctaaaacttgcagccctaagcagtttgcctgcagagaccaaatcacctgtatctcaaagggctggcggtgtgacggtgaaagagattgccccgacggctctgatgaagcccctgagatctgtccacagagtaaagcccagagatgcccgccaaatgagcacagttgtctggggactgagctatgtgtccccatgtctcgtctctgcaacgggatccaggactgcatggatggctcagacgagggtgctcactgccgagagctccgagccaactgttctcgaatgggttgtcaacaccattgtgtacctacacccagtgggcccacgtgctactgtaacagcagcttccagctgcaggcagatggcaagacgtgcaaagattttgacgagtgttccgtgtatggcacctgcagccagctttgcaccaacacagatggctccttcacatgtggctgtgttgaaggctacctgctgcaaccggacaaccgctcctgcaaggccaagaatgagccagtagatcggccgccagtgctactgattgccaactctcagaacatcctagctacgtacctgagtggggcccaagtgtctaccatcacacccaccagcacccgacaaaccacggccatggacttcagttatgccaatgagactgtatgctgggtgcacgttggggacagtgctgcccagacacagctcaagtgtgcccggatgcctggcctgaagggctttgtggatgagcataccatcaacatctccctcagcctgcaccacgtggagcagatggcaatcgactggctgacgggaaacttctactttgtcgacgacattgacgacaggatctttgtctgtaaccgaaacggggacacctgtgtcactctgctggacctggaactctacaaccccaaaggcatcgccttggaccccgccatggggaaggtgttcttcactgactacgggcagatcccaaaggtggagcgctgtgacatggatggacagaaccgcaccaagctggtggatagcaagatcgtgtttccacacggcatcaccctggacctggtcagccgcctcgtctactgggcggacgcctacctagactacatcgaggtggtagactacgaagggaagggtcggcagaccatcatccaaggcatcctgatcgagcacctgtacggcctgaccgtgtttgagaactatctctacgccaccaactcggacaatgccaacacgcagcagaagacgagcgtgatccgagtgaaccggttcaacagtactgagtaccaggtcgtcacccgtgtggacaagggtggtgccctgcatatctaccaccagcgacgccagccccgagtgcggagtcacgcctgtgagaatgaccagtacgggaagccaggtggctgctccgacatctgcctcctggccaacagtcacaaggcaaggacctgcaggtgcaggtctggcttcagcctgggaagtgatgggaagtcttgtaagaaacctgaacatgagctgttcctcgtgtatggcaagggccgaccaggcatcattagaggcatggacatgggggccaaggtcccagatgagcacatgatccccatcgagaaccttatgaatccacgcgctctggacttccacgccgagaccggcttcatctactttgctgacaccaccagctacctcattggccgccagaaaattgatggcacggagagagagactatcctgaaggatggtgagggcgtcagagggtcacccccatgcgctctctacaccctcacaggcatccacaatgtggagggcgtagccgtggactggatgggagacaatctttactggactgatgatggccccaagaagaccattagtgtggccaggctggagaaagccgctcagacccggaagactctaattgagggcaagatgacacaccccagggccattgtagtggatccactcaatgggtggatgtactggacagactgggaggaggaccccaaggacagtcggcgagggcggctcgagagggcttggatggacggctcacaccgagatatctttgtcacctccaagacagtgctttggcccaatgggctaagcctggatatcccagccggacgcctctactgggtggatgccttctatgaccgaattgagaccatactgctcaatggcacagaccggaagattgtatatgagggtcctgaactgaatcatgccttcggcctgtgtcaccatggcaactacctcttttggaccgagtaccggagcggcagcgtctaccgcttggaacggggcgtggcaggcgcaccgcccactgtgacccttctgcgcagcgagagaccgcctatctttgagatccgaatgtacgacgcgcagcagcagcaagtgggtaccaacaaatgccgggtaaataacggaggctgcagcagcctgtgcctcgccacccccgggagccgccagtgtgcctgtgccgaggaccaggtgttggacacagatggtgtcacctgcttggcgaacccatcctacgtgcccccaccccagtgccagccgggcgagtttgcctgtgccaacaaccgctgcatccaggagcgctggaagtgtgacggagacaacgactgtctggacaacagcgatgaggccccagcactgtgccatcaacacacctgtccctcggaccgattcaagtgtgagaacaaccggtgtatccccaaccgctggctctgtgatggggataatgattgtggcaacagcgaggacgaatccaatgccacgtgctcagcccgcacctgtccacccaaccagttctcctgtgccagtggccgatgcattcctatctcatggacctgtgatctggatgatgactgtggggaccggtccgatgagtcagcctcatgcgagacgctggtgcttctgtctcatcaggtgatcctaaagtcggagcccgtccacccctttgggttggcggtgtacggagagcacattttctggactgactgggtgcggcgggctgtgcagcgagccaacaagtatgtgggcagcgacatgaagctgcttcgggtggacattccccagcaacccatgggcatcatcgccgtggccaatgacaccaacagctgtgaactctccccctgccgtatcaacaatggaggctgccaggatctgtgtctgctcacccaccaaggccacgtcaactgttcctgtcgagggggccggatcctccaggaggacttcacctgccgggctgtgaactcttcttgtcgggcacaagatgagtttgagtgtgccaatggggaatgtatcagcttcagcctcacctgtgatggcgtctcccactgcaaggacaagtccgatgagaagccctcctactgcaactcacgccgctgcaagaagactttccgccagtgtaacaatggccgctgtgtatccaacatgctgtggtgcaatggggtggatgactgtggggatggctctgatgagataccttgcaacaagactgcctgtggtgtgggtgagttccgctgccgggatgggtcctgcatcgggaactccagtcgctgcaaccagtttgtggattgtgaggatgcctcggatgagatgaattgcagtaccacagactgcagcagctatttccgcctgggcgtgaaaggtgtcctcttccagccgtgcgagcggacatccctgtgctacgcacctagctgggtgtgtgatggcgccaacgactgtggagactacagcgatgaacgtgactgtccaggtgtgaagcgccctaggtgcccgctcaattactttgcctgccccagcgggcgctgtatccccatgagctggacgtgtgacaaggaggatgactgtgagaacggcgaggacgagacccactgcaacaagttctgctcagaggcacagttcgagtgccagaaccaccggtgtatctccaagcagtggctgtgtgacggtagcgatgattgcggggatggctccgatgaggcagctcactgtgaaggcaagacatgtggcccctcctccttctcctgtcccggcacccacgtgtgtgtccctgagcgctggctctgtgatggcgacaaggactgtaccgatggcgcggatgagagtgtcactgctggctgcctgtacaacagcacctgtgatgaccgtgagttcatgtgccagaaccgcttgtgtattcccaagcatttcgtgtgcgaccatgaccgtgactgtgctgatggctctgatgaatcccctgagtgtgagtacccaacctgcggccccaatgaattccgctgtgccaatgggcgttgtctgagctcccgtcagtgggaatgtgatggggagaatgactgtcacgaccacagcgatgaggctcccaagaacccacactgcaccagcccagagcacaaatgcaatgcctcatcacagttcctgtgcagcagcgggcgctgcgtggctgaggcgttgctctgcaacggccaggacgactgtggggacggttcagacgaacgcgggtgccatgtcaacgagtgtctcagccgcaagctcagtggctgcagtcaggactgcgaggacctcaagataggctttaagtgccgctgtcgcccgggcttccggctaaaggacgatggcaggacctgtgccgacctggatgagtgcagcaccaccttcccctgcagccagctctgcatcaacacccacggaagttacaagtgtctgtgtgtggagggctatgcaccccgtggcggtgacccccacagctgcaaagctgtgaccgatgaggagccatttctcatctttgccaaccggtactacctgcggaagctcaacctggacggctccaactacacactgcttaagcagccacatcctgactccagacatccttccccagatacacatgtgcccctgcagcagctgacttccctgtccccatcccaaacccagggcctgaacaatgcggtcgccttggactttgactaccgagagcagatgatctactggacggacgtgaccacccagggcagcatgattcgcaggatgcacctcaacggcagcaacgtgcaggttctgcaccggacgggccttagtaacccagatgggctggctgtggactgggtgggtggcaacctgtactggtgtgacaagggcagagataccattgaggtgtccaagcttaacggggcctatcggacagtgctggtcagctctggcctccgggagcccagagctctggtagtggatgtacagaatgggtacctgtactggacagactggggtgaccactcactgatcggccggattggcatggatggatctggccgcagcatcatcgtggacactaagatcacatggcccaatggcctgaccgtggactacgtcacggaacgcatctactgggctgacgcccgtgaggactacattgagttcgccagcctggatggctccaaccgtcacgttgtgctgagccaagacatcccacacatctttgcgctgaccctatttgaagactacgtctactggacagactgggaaacgaagtccatcaaccgggcccacaagaccacgggtgccaacaaaacactcctcatcagcaccctgcaccggcccatggacttacatgtattccacgccctgcgccagccagatgtgcccaatcacccctgcaaagtcaacaatggtggctgcagcaacctgtgcctgctgtcccctgggggtggtcataaatgcgcctgccccaccaacttctatctgggtggcgatggccgtacctgtgtgtccaactgcacagcaagccagtttgtgtgcaaaaatgacaagtgcatccccttctggtggaagtgtgacacggaggacgactgtggggatcactcagacgagcctccagactgtcccgagttcaagtgccgcccaggccagttccagtgctccaccggcatctgcaccaaccctgccttcatctgtgatggggacaatgactgccaagacaatagtgacgaggccaattgcgctgaggtgacctgcgcccccaaccagttccagtgctccatcaccaagcgctgcatccctcgcgtctgggtctgtgacagggataatgactgtgtggacggcagtgatgagcctgccaactgtacccaaatgacctgtggagtggatgagttccgctgcaaggattctggccgctgcatccccgcgcgctggaagtgtgacggagaagatgactgtggggatggttcagatgagcccaaggaagagtgtgatgagcgcacctgtgagccataccagttccgctgcaaaaacaaccgctgtgtcccaggccgttggcaatgtgactacgacaacgactgcggagataactcggacgaggagagctgcacacctcggccctgctctgagagtgagttttcctgtgccaatggccgctgcatcgctgggcgctggaagtgtgatggggaccatgactgtgccgacggctcagacgagaaagactgcaccccccgctgtgatatggaccagttccagtgcaagagtggccactgcatccccctgcgctggcgctgtgacgcggatgctgactgtatggacggcagtgacgaggaagcctgtggcactggggtgaggacctgcccattggatgagtttcaatgtaacaacaccttgtgcaagccgctggcctggaagtgtgatggagaggacgactgtggggacaactcagatgagaaccccgaggaatgcgcccggttcatctgccctcccaaccggcctttccgctgcaagaatgaccgagtctgcctgtggattgggcgccagtgtgatggcgtggacaactgtggagatgggactgacgaggaggactgtgagccccccacggcccagaacccccactgcaaagacaagaaggagttcctgtgccgaaaccagcgctgtctatcatcctccctgcgctgtaacatgttcgatgactgcggcgatggctccgatgaagaagattgcagcatcgaccccaagctgaccagctgtgccaccaatgccagcatgtgtggggacgaagctcgttgtgtgcgcactgagaaagctgcctactgtgcctgccgctcgggcttccatactgtgccgggccagcccggatgccaggacatcaacgagtgcctgcgctttggtacctgctctcagctctgcaacaacaccaagggaggccacctctgcagctgtgcccgcaacttcatgaagacacacaacacctgcaaagctgaaggtgctagaggccggaagggccagaagggcctgaaggggcagggccagaaggaagggtggaagggcctgaaggggcagggccagaaggaagggtgggcagggtcgggccacaccagctataaaatggagctggcctggagtggaacattcccaatggcacttcgttgctcagacttggatgcccagactcaaggctccgagtaccaggtgctatacatcgcggatgacaacgagatccgcagcttgttcccgggccacccccactcagcctacgagcagacattccagggcgatgagagtgtccgcatagatgccatggatgtccatgtcaaggccggccgtgtctactggactaactggcacacgggcacaatctcctacaggagcctgccccctgccgcccctcctaccacttccaaccgccaccggaggcagatcgaccggggtgtcacccacctcaatatttcagggctgaagatgccgaggggtatcgctatcgactgggtggccgggaatgtgtactggaccgattccggccgagacgtgattgaggtggcgcaaatgaagggcgagaaccgcaagacgctcatctcgggcatgattgatgagccccatgccatcgtggtggaccctctgaggggcaccatgtactggtcagactgggggaaccaccccaagattgaaacagcagcgatggatggcacccttcgggagactctcgtgcaagacaacattcagtggcctacaggtccctggggcagggggctggctgtggactatcacaatgaacggctctactgggcagatgccaagctttcggtcatcggcagcatccggctcaacggcactgaccccattgtggctgctgacagcaaacgaggcctaagtcaccccttcagcatcgatgtgtttgaagactacatctacggagtcacttacatcaataatcgtgtcttcaagatccacaagtttggacacagccccttgatcaacctaactgggggcctgagccatgcctctgatgtagtcctttaccatcaacacaagcagcctgaaggtgcatcagagggaaaacccggggtgtggcaggtgaccaacccctgtgaccgcaagaaatgtgaatggctgtgtctgctgagccccagcgggcctgtctgcacctgtcccaatggaaagaggctggataatggcacctgtgtgcctgtgccctctccaacaccccctccagatgcccctaggcctggaacctgcactctgcagtgcttcaatggtggtagttgtttcctcaacgctcggaggcagcccaagtgccgttgccagccccgttacacaggcgataagtgtgagctggatcagtgctgggaatactgtcacaacggaggcacctgtgcggcttccccatctggcatgcccacgtgccgctgtcccactggcttcacgggccccaaatgcaccgcacaggtgtgtgcaggctactgctctaacaacagcacctgcaccgtcaaccagggcaaccagccccagtgccgatgtctacctggcttcctgggcgaccgttgccagtaccggcagtgctctggcttctgtgagaactttggcacctgtcagatggctgctgatggctcccgacaatgtcgctgcaccgtctactttgagggaccaaggtgtgaggtgaacaagtgtagtcgctgtctccaaggcgcctgtgtggtcaataagcagaccggagatgtcacatgcaactgcactgatggccgggtagcccccagttgtctgacctgcatcgatcactgtagcaatggtggctcctgcaccatgaacagcaagatgatgcctgagtgccagtgcccgccccatatgacaggaccccggtgcgaggagcaggttgttagtcagcaacagcctgggcatatggcctccatcctgatccctctgctgctgcttctcctgctgcttctggtggctggcgtggtgttctggtataagcggcgagtccgaggggctaagggcttccagcaccagcggatgaccaatggggccatgaatgtggaaattggaaaccctacctacaagatgtatgaaggtggagagcccgatgatgtcgggggcctactggatgctgattttgcccttgaccctgacaagcctaccaacttcaccaacccagtgtatgccacgctctacatggggggccacggcagccgccattccctggccagcacggacgagaagcgagaactgctgggccggggacctgaagacgagataggagatcccttggcatagggccctgccccgacggatgtccccagaaagccccctgccacatgagtctttcaatgaaccccctccccagccggcccttctccggccctgccgggtgtacaaatgtaaaaatgaaggaattactttttatatgtgagcgagcaagcgagcaagcacagtattatctctttgcatttccttcctgcctgctcctcagtatcccccccatgctgccttgagggggcggggagggctttgtggctcaaaggtatgaaggagtccacatgttccctaccgagcatacccctggaagctggcggcacggcctccccaccacgcctgtgcaagacactcaacggggctccgtgtcccagctttcctttccttggctctctggggttagttcaggggaggtggagtcctctgctgaccctgtctggaagatttggctctagctgaggaaggagtcttttagttgagggaagtcaccccaaaccccagctcccactttcaggggcacctctcagatggccatgctcagtatcccttccagacaggccctcccctctctagcgccccctctgtggctcctagggctgaacacattctttggtaactgtcccccaagcctcccatccccctgagggccaggaagagtcggggcacaccaaggaagggcaagcgggcagccccattttggggacgtgaacgttttaataatttttgctgaattcctttacaactaaataacacagatattgttataaataaaattgtaaaaaaggaaaaaaaaaagaaaa

SEQ ID NO: 669 - protein, 3197 aa, Mus musculus
MLTPPLLLLLPLLSALVSGATMDAPKTCSPKQFACRDQITCISKGWRCDGERDCPDGSDEAPEICPQSKAQRCPPNEHSCLGTELCVPMSRLCNGIQDCMDGSDEGAHCRELRANCSRMGCQHHCVPTPSGPTCYCNSSFQLQADGKTCKDFDECSVYGTCSQLCTNTDGSFTCGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANTQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGEGVRGSPPCALYTLTGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVAGAPPTVTLLRSERPPIFEIRMYDAQQQQVGTNKCRVNNGGCSSLCLATPGSRQCACAEDQVLDTDGVTCLANPSYVPPPQCQPGEFACANNRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCETLVLLSHQVILKSEPVHPFGLAVYGEHIFWTDWVRRAVQRANKYVGSDMKLLRVDIPQQPMGIIAVANDTNSCELSPCRINNGGCQDLCLLTHQGHVNCSCRGGRILQEDFTCRAVNSSCRAQDEFECANGECISFSLTCDGVSHCKDKSDEKPSYCNSRRCKKTFRQCNNGRCVSNMLWCNGVDDCGDGSDEIPCNKTACGVGEFRCRDGSCIGNSSRCNQFVDCEDASDEMNCSTTDCSSYFRLGVKGVLFQPCERTSLCYAPSWVCDGANDCGDYSDERDCPGVKRPRCPLNYFACPSGRCIPMSWTCDKEDDCENGEDETHCNKFCSEAQFECQNHRCISKQWLCDGSDDCGDGSDEAAHCEGKTCGPSSFSCPGTHVCVPERWLCDGDKDCTDGADESVTAGCLYNSTCDDREFMCQNRLCIPKHFVCDHDRDCADGSDESPECEYPTCGPNEFRCANGRCLSSRQWECDGENDCHDHSDEAPKNPHCTSPEHKCNASSQFLCSSGRCVAEALLCNGQDDCGDGSDERGCHVNECLSRKLSGCSQDCEDLKIGFKCRCRPGFRLKDDGRTCADLDECSTTFPCSQLCINTHGSYKCLCVEGYAPRGGDPHSCKAVTDEEPFLIFANRYYLRKLNLDGSNYTLLKQPHPDSRHPSPDTHVPLQQLTSLSPSQTQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSGRSIIVDTKITWPNGLTVDYVTERIYWADAREDYIEFASLDGSNRHVVLSQDIPHIFALTLFEDYVYWTDWETKSINRAHKTTGANKTLLISTLHRPMDLHVFHALRQPDVPNHPCKVNNGGCSNLCLLSPGGGHKCACPTNFYLGGDGRTCVSNCTASQFVCKNDKCIPFWWKCDTEDDCGDHSDEPPDCPEFKCRPGQFQCSTGICTNPAFICDGDNDCQDNSDEANCAEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFICPPNRPFRCKNDRVCLWIGRQCDGVDNCGDGTDEEDCEPPTAQNPHCKDKKEFLCRNQRCLSSSLRCNMFDDCGDGSDEEDCSIDPKLTSCATNASMCGDEARCVRTEKAAYCACRSGFHTVPGQPGCQDINECLRFGTCSQLCNNTKGGHLCSCARNFMKTHNTCKAEGARGRKGQKGLKGQGQKEGWKGLKGQGQKEGWAGSGHTSYKMELAWSGTFPMALRCSDLDAQTQGSEYQVLYIADDNEIRSLFPGHPHSAYEQTFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGPWGRGLAVDYHNERLYWADAKLSVIGSIRLNGTDPIVAADSKRGLSHPFSIDVFEDYIYGVTYINNRVFKIHKFGHSPLINLTGGLSHASDVVLYHQHKQPEGASEGKPGVWQVTNPCDRKKCEWLCLLSPSGPVCTCPNGKRLDNGTCVPVPSPTPPPDAPRPGTCTLQCFNGGSCFLNARRQPKCRCQPRYTGDKCELDQCWEYCHNGGTCAASPSGMPTCRCPTGFTGPKCTAQVCAGYCSNNSTCTVNQGNQPQCRCLPGFLGDRCQYRQCSGFCENFGTCQMAADGSRQCRCTVYFEGPRCEVNKCSRCLQGACVVNKQTGDVTCNCTDGRVAPSCLTCIDHCSNGGSCTMNSKMMPECQCPPHMTGPRCEEQVVSQQQPGHMASILIPLLLLLLLLLVAGVVFWYKRRVRGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 670 - DNA, 104083 bp, Homo sapiens
  misc_feature (1)...(104083): n = A,T,C or G
ttaattgggtcttccattacttgctgctaaatgcatccctaactaagaccatggtgaagctatatcgccacaggaaatggagactccagggtgggctgcctgcccatcctcccactaccacccgccctatacacttgagagaataagcgatacctcattaaaggaggaatgttctcaaggaaggatcaggttccagacaagccaagaggggccaggataatgtgagccaggggtggccccaggcttcaagcaaggagatgggtggagagcagtataacagtgttaggaggaggaaggactggacttagtggagaaggatggatgccaatcaaggcctgccaaggatgacaggatgtgagcaatggtggagtcagctgatctcaaggcttcaaatggagccctcaggctgtcagaggcttactgtggccaaccgacctttacttcacagaaggacaagttagccatcctggtgaatgggcaaagtcaagcagctctggatggagtcagctgtggtcaggattgtgcctctgcaaggaaatctcagttctctaattactgtcttgcctctctcccttcccctgtgcagccaagcatcttgggaaaattattcatattcagtcttctcttccttacttcctcattacactgccagctggctgctgcccccaccagtcatgaaactgtcctggcccatgtcacatacaccctcctaggggccttgaatgatggcacattcctgtctttctcttgctgggcctttcagcagtactcaacactgttagccattcttgagtaagttctcccccaactacttttcatgattcctttcttggtcttcggcctacctctctgcgtcctccctctcagtctcctgtcttcacgggacactctttctgtgtgatctcatccacatctgaggctccacagcctgggcaaggctatgtagtatggtgattaaaaccttggccgctggcagaccacctgtgttcaaatctctgccctaccaggtggttgctttgtaatacccaaacttctatcaagatgtggatcattaccctcaccccaacccacaggggaagccactgttctgatttttttttttaagtagagtaatataggatgtagttttatgtctggcttattttacgcaacatgttttgaggttcatccatgttgctgcatgtatccatagttctttcatttttcttgctgagtagtgtcccatggtggatctataccacagtttgtttatcctttttcaaatgaaggatacctgagctatagccagcttttggctactgtgaagaaaactgctatgaatattctgtgttcaagtctgtgtgtgaacatatgctttcatttctcttggataaataactaggaatagaattgctgagtcacagggtaggtgtatgtgtagttttataagaaactgctacatattgttccaaattgatagtacattttacattcccactaatgatgtatgagagttccagttgctctgtattcccactaacatttggtattgtcagttttttaaagtttaatcattttggtgagtattgagaggtatcacactatggatataatttccttttttttttttttttttttgagacggagtcttgctctgtcacccaggctggagtgcagtggcacgatctcggctcaccgcaagctccacctcctgggttcatgccattcttctgcctcagcctcccgagtagctgggaccacaggcgcccgccaccacgcccagctaattttttgtatttttagtagagacagggtttcaccatgttagccaggatggtctagatctcttgaccttgtgatcctcctgcctcgtcctcccaaagtgctgggattacaggcgtgagccaccgtgcctggcataatttgcattttcttaataactaaagatgttgagttcttttctttttcttttttctttttatttttgagacagggtctcactctgttgcccaggctggagcacagtggcacaatcactgctcactgcagcctcaaccttctaggctcaagcaatcctcctgcctcagccttttgagtagctaggactgcaggaatgcacctccatatctagatcatttttaaattttatttatttatttattttgagatggagtcttgctcttgttgcccaggctggagtgcaatggcacaatctcagctcactgcaacctctgcctcctgggttcaagtgattctcctgcctcaacctcccaagtagctgggattacaggtgcccaccaccatgctcagctaatttttgtatttttagtagagacagggtatggccacattggccaggctggtcttgaactcctgacctcgtgatccgcccgcctcggccttccaaggtgctgggattacaggcgtgagtcaccacgcccggactttttgtagagatgaggtctcgatatattgcctaggctggtctgaaactgctgacctcaagcgatcctcccaccttggcctcccaaagtgctgggattacaggcgtgcaccactgcacctagcctcgagtacctttcatatgcttattgtccattcattgggttgtcattttattactatgttataggaatttttaatatatctcgcattcctctgtcccttctcagatcaatgttttgtctatctatttggcttacttccacattttcataataatgtcttttttttttgagtcagggtctcactgtcactcaggctggagtgcagtggcacaatcaactcactgcagcctctaactcctgggctcaagcaatcctctcttctcagcctctggagtagctgggactacaggtgcacaccatcacactcggctaattttttaaattttttgtagtgacagagtctagctttgttggccaggctggtctcaaactcctggcctcaagcagttcttctatgtcagcctcccaaagtgctgggattactccataatgatgtcttctgacgagcaaaagttttctattttgatgtttcacttatcaagaaatttatgttattgctttctatagcttaagaaggggttgctttcctccaaattatgaagatattctgtgtttttgtctaaaagctttatgattttagcatttgtggtttaggtctataatcaatctttttttttagacggagtctcgctctgtcacccaggctggagtgcagtggcgcgatctcggctcactccaccctccacctcctgggttcaagcaattctcctgcctcagcctcttgagtagctgggattacaggtgcccaccaccacacccagctaatttttgtatttttatttttttaattaattaatttttttgacacagagtctcgctgtcactcaggctggagtgcagtggtgtgatctcagctcactgcaacctccgcctctcaggttcaagcgattatcctgcctcagcctcctgagtagctaggattacaggcatgcaccaccatgcccagctaatttttgtatttttagtagagacagtgttttgccatgttggccaggctggtcttgaactgagctcagatgatccacccgccttgtcctcccaaagtgctgagattacaggtgtgagccaccatgcctggcctgttaattgtgtatttttagtagaaacagagtttcaccatgttgggcaggctggtcttgaactcctgacctctggtgattcaactgcttcagcctcccaaagtgctgggattacaggtgtgagccactgggcccagcctataatcaatcttgaattaatttttgcatatggtgtgaggtaggggtcaaggttcatttatttctcccatatagatatgaagttgttccataactatttattgaacagacattcctttctccactggctggctttgacatctttgccaaaatcaaatgacctttacagtgggatcagccagttggtgcaatacgaagtcccgcctctcatcccctcacagaaacacagatttaacaatttactgatcaaaatacctttatgagaagtacagaatccggttgagaagtgtggtaccccagacaagtagagagctgagaaaagctgcactgagatggatcctacattcctgggtctgggagtgggcctttcccagagataccatcctccagcagtaagagacctccaatagtcgggtctcagacaggttccagctaagagtaaaatcccagatcaatggtgaaaaggagtttaagaatggatgctgaagccaggcatggtggcatgtgtctgtagtcccagctacttgggaagttgacaggggaaaatagtttaagcccaggaggttgaggctgcagtgagctatgatcataccactgcactccagactgggcaacagagcaaaactctgtctcaaaaagaaaaacgaagcctgtgcctagtcaacattgaagcaagaatgcagaagttgcacagggtgagatagggatgagcagggtggaggggtggtaaacacaaaggaattgcaataagaaatcaaacaactatctgattttttaaaattatgttgagatatttggggaaaatgatagatgcatagaaaactaatcaaacgaaaaataattccaagataaaagtatataaaagtaacattataaaataataaacgcatatagaatttttattaaaaaatcaaatgattgtgagtctatttctggttctctattctgctccatggatctgtttgtcaattctcatgctagcaccacatagtcttgattactgtcacttacaagtcttgaaatcaagtagcataaatcctccagcattgattcatttatttttctttttgagacagggttgcactctgttacccaggctggagtgcagtggcatgatcatgcagtgatcaggttcactgcagcctcaacctcctgagctcaagcaatcctcccaccttagtctcctgagtagctgggcctacagatgcatgccaccacagcactgggatttttaaaaactctccaggtgattctaatgtgagccaaattttctagactcagatttctctgtcactatcttcaggcctatacagttaactggttagtatactagatcctacttctttattgtttctgaatcctcttcctctccagctccatcactcatgcattaaggacttcaccaatttctcaactggctctacactacttctagaaaaaaaattctaagtccttactgtggctaaaatcacgctttgtgattaggctttctgatacttcatccaacactctcccctcaaagtaccttaaacttcagctatgataccatatttgatgttcttcacatgttttaaacttctcatgcctccaatgcctttcctgccatccagcctaaaacaccctttccttttgttattggttgtcattttcttcctctcattcaacatttagcctggcatcatctgctgctctctgtcttgaccaccttgtctggaagaggtatccttcccatgttcccatgcccttctgcacatgccttcatcacaggtgttaaggaactgactgtattgtcattgtctgtctcttgttgagcacccagctaacctgaaagcttcttgaaggctgagactgtgtgtttccgtctcttatccctagtgcctagcaatgtacttgcttatacgaggtacctaatatttttattaagtgaatgaaatctgggcttggatctgcaccattatttgggacagattctttaatctctcagaacattctattttcttatacacactggaaataacacccatgacaaaaggtagacttaagtgagctgatactgtaaataaagtccactgcgtgggcctgggacatggtatgcgctcaataaatactggtccttttccctctctccgcctgccatcagacctttccgggatacccttcctacgcacacttccttaactgaccactaggtggtgctagcctctggcttgacattcagttccagagctacccaattaacgccccagcccaggccctgctatactcagaaaaggcgggtattttgtaatttgctgagcgacccgaaaaaagagatgccctttacccacactagcttctttgccctcatcaccattccaggtatcaatcatgaatttcagagaattcctccatgattccctactattatggttataatctcaacccaaggatttgaagatgcctcttaagaacagatgtggggaggaagagaaggcactgaggcagagaggattaaacaatgaatgctataagagaaatagagggaagaagatgcttgaagtcacatcctgttccaggaaaggcaactctagtcctaacattcctttcaccaatcaagagcctctcacgctgggtggaaacgaagaagaaaaagacatggtccctgccctcaaggagtatatagtctagtggtggatacagagcccacaaaataaagtgctaaactctggatactgaagctttcctgaatacaagtttggaacaggagagataggcagagcgagaataacaggagggcttttctgaggagggtagaggagcaggggaactgtatcattaatggctcagatagaaatatgcattctcagcagggtgaggtggctcacacctgtaatcacagcactttgggaggccaaggtgcatggatcacctgaggtcaggagtttaagaccagcctggccaacatggagaaatcccatctctactaaaaacacaaaaatgagccaggcatggtggtgggtgcctgtaatctcaactattcgggaggctgaggcaggagaatcgcttgaacctgggaggtggaggttgcagtgagctgagatcacaccactgcactccagcctgggcaacaagagtgcaactccatctcaaaaaaaaaaaagaaagaaagaaagaaagaaagacataaatatgcattctctcaccttacagacataccctcagcagttcacctgctggaaataacccaagtgcccaacaatcccaacaaactgtggaacatccaagcaaggagattccaagtagccaagatcaaagggtgagctaaatgcgttcatacggtatggaaagggatcaagctaagttaattgaaaaaaaggcaagttacagaacactatatatcatatgagtttctttatagttttaaaggatattcacttatatttgtatgttactgttttatttatttatttatttgagacagggtctccctctgttgctcaggctggagtgcagtggcacgatctcggctcaccacaacctccacctcctgggttcaagcgattctcgtgcctcagcctccccagtagctgggattacaggtatgcgtcacgatacgtggctcatttttgtatttttagtagatatggggttccgccatgttggccagtgtggtctcgaactacctgaaaagtgatcctcccaccttcgtctcccaaagtgttgggattacaggcatgagcccaccacgcctggcctgtatgttactgttttaaaaactctcctggccgggcacggtggctcacgcctgtaatcccagcactttgggaggctgaggaggccagatcacgtggtcagaagttcgagaccagcctagccaacatcgtgaaaccccatctctaccaaaaatacaaaaaaaattagctgggtatagtggcgtgtgcctgtaatcccagctacttgggaggtcaaggcagaagaatcgccgaacccgggaggcagaggttgtagtgagccgagattaggccactgcactccaacctgggcaacggggcaagactccgtcttgggcgggggggaaacctctgctggtaggggagacctgaagaactgttagtagaagttactctgagggtgcagctgaaaaatgggggtgtggagagcatcaagtttccttttactttttaccttcctgtactttttttaaccactaggtattatcttttctttctttcttttttttttaacaatataaagttaataaaaatacacattcacattcaggagacagcaggggatgggaggttgcaagtgagaagtgcatgctgactgaggccaggttttggaaagccatgactgaagaggagttcacatttgactggtctatagacacccactagaggttccccagcaaggaagagacaccgggaaagcagtttttggaagattcacctgacagatgggtagggggagggaggaaagccccttcaagccctcaggctacatgtggttgctccagataccgttttcctctcaaagctgtcaagctgtctaaagtctgtttcgacctgatttcacttggatcccaatactgggaggggccctgggaggaacctcgtaggcatttggtgagtccgcatagtgcgtctcacattgtgttgggccatgggagctggataaaaggagaaataagaccccgttcctgcctggagcaactctctggcagtggaaatggaggaaatctgagatatacttcagaggaaaaaaatgacaagcctggagcacaggctggcaagattggatataggaaggaaaggcccccttgagttggcataaagtctgaggtttctagcccaggagactaaaggcaggtggccaccgcgctgagcaaagccggctggaagaagctaaaggttgagctcactgtcattaggaggcaagtccttcgtgctgctcctgtttctgccaaggacagactggagtggggacttttccgtaactagaacgtaaaagggggaacagtccctcctctccagcgtcaatttttggcagccgacgtcgtctgccccgctccttgaactctgacatgcagacacctagaaagtcagacactaaggtaacagccataaaacgccgcccagaagggggcagtgaccaaaagcacgttcactggcccctgggaaccgcctggcgcctgccttctgcaaagtatcattcccgtgtgggctgagcctggggacaaaggtccggcgctcagcagacacctccttggaacccgaggcctggaaacgaaggtccagagtccctcatcttattccaaatcctggcgctcggaatctaaaaccctaacttgatggcaagccagtcagaaggtattaaaaaaaaaaaaaaaaaaaaaaacagaaaaataaatgagccccgacttcttgggcgaaagggggtggcctttcctcaaccccacccgctggtgactcacctccctccaaaccagggcctgcccctcccgcgcctagggctgggcgagcagggcgggcgggtactaaggtgggctccatccccgagccccacgcgggcggacaagctccggcgtgtcccctcgggtgtccctgtttactccgagcccgggagcgaggtgggggcgggtcctcgcggtccctccccaaccccgccccctccttcgcaggccccaatcccagtccggtcttccaaagtctccaaatcaaagctcagcctttccctgcaccttccccgcggactggcggtccctgtccccaccccgggcagaggaggcaccttcagggttcccctagaaaatcgagcctcggcccagaccactgagtcccggacgcccccggagggagcctgaaatcctagagtatgacactgagtttcaaaggggagccgctcagctctccgcccactgcccaatcccaccctcgaccccttctgctctctggagcaccagggaggagggcccagccaggggagagggcgccccaggccccaaactagccagcgagtccccgggaccctcactcttggaccgctttccagaactccgaaccctgtcgcgggtccgcgtcgccctcccccgggcagcgcgtcaaatcggcgcatgcgcactcactggattgccgcgtagctctttctccccccacccaccaaccttttttctttccccgccccttccctccctccctcctcaacccgtcccctccctctcccccatcagcccccccctcggcacttcagtccggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacggtgagtgagattccgcgtcccccttggacccctgggggcaccctctccccagcccccactcctgcatacggatggggaagggagacgcgggagggggtgccttttgttatcccagtccagctgacacagcagcggcccgactgggggcggggatggggtccgatttgggggatgggggccctgggcaaatgatgcttccggggccccccagcacaaacaaagaccagaggcctgggtagagagaagagggctccccatttttctgatcctggggaggagaggccttcttttcctatctctgttcggggagggcctccgcctcccctacatcctcacaaccccccaccccccatctgaattgtgaaggaatccggatttgcaatgttcggctgcaaaagggggtgggggtggggggggtggcttttgcactggcctctgtagctcgaaaggggagccaggccaggggtaccctgccgggcagagggcaggcaggcccgggaaggctgtgggtggggagagggagggccccctgcttgggcgtggaatcgaccccagagccccggctggaggcctgggtgctgaagtaggctcttccccctctcagggcctctgtcagtagcctggggtagggctgtgttggggggcagagagggggagctcgccatactatgtgactttgaattttccttcttaattcctgggagctttgagatgaaaaaacgtcagatgtcatcactggggaaggggactggagaatggcctggaatgctggggtaggagggtgggggaggctgccttcttcctgacttctggcttcatcacagtttggattggaaggagagttggaggttggatggggattatggctgtgcccccacactcctttagtaaatctgtttattccctgcacccctccaagcccaaaaccccatacacacacactttgtatattgcagagttaggcttaggctagaactgcatccttttggggaaatggggtgcctctcttccctttttttgtcagctgtttttttctcctacttgtgagtcactggttcaagtcttgcccaagctttaagcattaagctggggtcatggggttgggctgggctaggtccctgatttgagaaggggtgggatctcatcccctcctgtcatcttagccctctcatccaaagacaaaactgggctggataccatcatacaccccctcctctgtcttgccagattgggattgggaaagtttttctctgaaaccagattatctccctccctctccctaacttgcttcaattgggggaggagacttacagggtcaggaagcagctgtgtccccaaaaaacatatttagtgtccctcagttgtgccatcttggggactctctaccccccacccccaccccaccaattagctgccccggaggaggagaggggcttttcctgaatatcctccagatgccgcacagccggcttctgcctataactcctgtcattatcatgtgtttttctcttgttctcagccctgtgaggtgagaagggaaatcgaggcagggagattggggttgcagccgcttctgggaggaatagaaaaaaaatttgagagagagagagacccatcaggagccccttgaaggagggtggctagagttaggcagaagcaagagggtttctgtggagagcagggaaggtcaggaagggaccccagatagcatcactcccagggctctaaaggagttctatttgccacaccaagttagtggaagagagagactggacatgttctccttaactatctccctaccctttcttaaaatgttcacccacgccccctctgtatctccagctcagatcaaactatccaaagccccaggagaggacccctccccaaacacacaccaatatttctgccttgggagtgggaatataaataatcagctccaccccactcttgggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctatcacagccttgctgctttctctccagggcagcaatcctaggggctttcccacctcttctgctttctcttctatgcctgaaactgcctctggggtcccctgccctttggggagtaacgtcactccccactagcgacaaaattgagtgtacctgctgctggagaggttgcagaaagatggggtggagaatgggactattgagggccctgctgagattggggaacattttctagtggggagggcacccccagacaaatacagctcacagaataaggctgacttcctccctccctttttcctgaccttcctccacacacccccttgagccggcatattaccagttactagagtaggtacagtggaagtgagttatgaagctggggtgttagcttcctggatccctgagagaaagttctaaactcctttctccctgatcagactcacatcctaaacgtctccctttgcctcgttgtcttttaaagcaagaatgtgtaagaaattcattttggggttggagggatattttgatgtttagggctgcttcactagacatctttttcttctgatcttgttctctctcctctcttcattttctcaaccacccttccaccactgagcctcccaaaggatgacagcccaggtcctggccagagtcagttcctgtccagatgcccccattcttcaaaaccccttccttaccttttgggaagcccttccttactcaagtctatctctctttcctcctgctgcagtgtgagcccttgcacatcagaacccccaagcctaggtttattcccgcccagtactctcttctcagggtcctcctcactcctcagactctttacctttcaggtcctccagctctgcgtgtgggctcattgctcttggggcatctgggtgcagctgaatggtactgcaggaaggcccctgacttggtagtgctgggtatgagcgatagagaacctgcctccctcttctgtcccagatttcagcctggttagcaggatcctgcattgtttggagaaggaagcagttggctttggagtgtttccggtgcaatggcctcaggcaccaatataaaccctccctgggaaagaggtgaggggtatatgtggagagttgtccctcttgctcccctaggggagatgaaagcctctccctctcccaccaggccttagcttccctggctgaagagctccattttcctccctcctttctaccctcctgactccaggggtggtagtggtccctattctgggtctcccttgagtcaggcactgcctagggccgagactctgtctctccaagataggacagatcttgctcccaccctactctaggctcagcggggtagtcattctctgggttcatcccaggacaactgtgtcatccccttggcaatctctggactgagcccccttcctggcttttctggctgtctgtctgtctttctgtctgtctgtcattagtgtgcgctgtcttggctttttagaacctctctgtctctcaccctctcagttcatctcttactgccgaacctttgtgacattctctgccctgctttctgcgtctctgtcacttgtcttatttttctctgcctgtctccatttacccccatccaggcctcttggtatcccaaaagcttcttgggagcaagagtctctctgggctttcccactcaccccctggctccctcccctctgttttggctatttttcccccttcctggccagacccagtgtccagttcagcaccaaaagtttcctctccactttcctccgacttcctctttcttcttccccctccactaatttggggaatgggttttggagagaatgtttctggaagaaaggaacttgataccctttgtgggctaagagggagaaaggaggtatttcagaaggaaggagggaggttagacttctggcagaacttcctcctgaccaggagcctaagaactggagaaagatgtaaggagtgagtcaagaacttggagcttttactctggtgagcataagctgtgtgtgtggctggggtggggggagaaggagaggaggcttagaaatgcctggtgagtgatatggtgacctctggaggccttctgggggtctggcttttatttgtggggaaaggaaaagctggtgggggaggtcacgggtcaggctaatgtcctgctgcatcaatattgactcagaatggaagcggagacccttcccctcccctggctgtccaagccaccctgtctgtctgtctgtccaggccgcaaagcagaggcccagactcaggaatgacaaaaatgtgtctgagcctcaggaaagagccactgggcaacacccaaaatacaaaaaattcagtgaaaacctctcggtttgggtttgggaggcccttgctgccccacccccataaggtcgaaaattcagattcctgcaggctctgtccccgcgccgcccccccaccccaccccccgcaccttgagcatcctcctcccactctgttcccttagctatatcatgtggttccctttagagaacccccctctcacctagctcagaggggagcctatctctccttctgctgtgtccactcttaaaaagggccccaagagtccctgtcatgcttttgcagtccctgagtctccttgtcctttaagaagcacctctaaggtcttagctctcttccttgctctcgctccctcaagggggtatcaaaggatgggttcccctcctctggagaagactccttcagggttggacttcgctgtcaccctctctggccaggcattctcaccccacttccccacccccaaggtcccagaatgggacacagaatgacagccaagggtcaagcagggcagtggggtctgtgttgtgtctggacgcacacccaactctacacctcctgccctggctccagcttggtggccctggggaccgtggctgggctgggtgcctgggtttgggggggtggggcagggtgttggccaagttagcatggcagtcacattcatcttcaggcaaagccgagaacagacggcccctgtgtcctggtgttcttcctccaaactcgctctctctccttcctctctagatctctccttcttcttctcctgcctgtcttccccttcttctgtcccattcttgctcctctctgtctcccctatgcccttccctcctctctgaggagccctgaaggccaccccttaaaatcctctccccactgccagggccagagaacgacagcgttctccctgcaatttcccttccttgttttttgtttttgttttgttttgtttttgagacacagtctcactccatcacccagactgaaatgcaatggcgtgatctctgctcactgcgacctccgcctcctgctaatttttgtatttttagtagagacagggtttcaccatgttgcccaggctggtctcaaactcttgacctcaagtgatccgcccatctccgcctccacctcccaaagtgctggtactacagacgggagccactgcgcccatctggtttcctttctttctttcttttttttttcttttgagatggaatctcgctctgttgcccaggctggagtgcagtggcgcgatctcagttcactgcaagctccgcctcccctggttcacgccattctcctgcctcagcctcctgagtagctgggactacaggcgcctgccaccacgcccagctaatttttcatatttttagtagagacggggtttcaccgcgttagccaggatggtctcgatctcctgacatcatgatctgcctgcttcggcctcccaaagtactgggattacaggcatgagccaccatgcccggcctggtttcctttcttaacccggctgcatcccatgacctatgaggaaaccacctgctcagttaccagtcaccctgtgcctcagctcccccatgtgtgagaggggggccgcaagggcacccacctcacagggttatagtatctaagtgagttaatagtcaccgtatttccaatcagtggctggtggttagcaaggtgaaaaaggttagctcccatcggtcagggagacctccgggttctctcatgcgggccaggaggcggggaaggccttagttgcttttgaccttagggcaatgttgttctctcatctaaactgcaggccacaaaggtgggttttctgggtgctggattcagacacagaaggctctgctgaggggagtggggttggctttccctctaagcagattataagggtcctaccccgctcccaactcagctctctcccagctctgagtgaggcttcccttggctgtgtagactgtcccaaagtagtttatttgtttctttcttccctctccccctgaaggaaatcaaagacaggcctcagccttctcgctccagattcctgggcccttcaacaccagccctgacaggaagttctttcacgtatctctctgcaatccttgtgctggccaggccctcgggagatgtggccccctcccccggtgctgctgtgggataggggcctgggccctcctcttcctttcacttgtcccatcccccatcccctccctgcaagagcacatctggtttgtgaatctctctcattccagcttttggagtttgccagctgctgtttcctctgtggagttcaggccaaaaatgggggtgggggacagcgggggggactcagtgagggctaaaggagggggcaccatggctgggatgtggaatggaggggaggttaggtgaccacccggtgacctcaggccgtggctgtgcgctctgcccctgggaggagcagggcatggaccaagtcccaggtgggtggcacgggggtctgtttctgggctccaaacatctcatctgcctctgagtcccattccagcccccctcttccccctcagccggccacggctggtcaggggaagcggacggttctccggcatgctaactaggctggcgggctgtgtttcccgggaagacctcacagctggcccagtggggcaatgaactcagcattatccacctcctcaaggggcctttattccaggctcagggtgggggccaggggagggaggctgaagggggagcctggctaggccatccttgatgtgtttcctgaactcggtcattttggccaggggcctgagtgccgtctcccctgccagcggtgggggttaggagggaagacatctcagtgaggctcccatcagactccctccctcctaagagccccccccccccgccattttccttatacttctgtctctgccctgcatttgcattagttgggtacagctgtcttctcaggcgactctggctcctgcagggcagagggtcatctcaccctccttggcaccctgatgcctagtgcagtgcctggcatagagctggccttcagtgtgtgccagcagaatagaaatgtgatggcacagtctgaggaaaagccacgaaaggccaggagactgggagctcagccttgggtgggggagaaggggtgggtgactgttcctcctgtggaggatgtggtgatagaggttgggaggagtgggaattcggaggactggtgtggatttcactggttcagagcttggagtcagcttagctggttttgtcacttgccagctatttgaccctggccaagtcacctggctcaatttcttcatctgtgaaatggtggtattagttgtccctatttgtcatactgtggagggaattaaatatgatgatacatggaaaaaactgctttaccacagttcctggcacatactgagcccacaataagagttagttgtcagccgggtgcggtggctcacgcctgtaatcccagcactttgggaggctgagatggatgtatcagatgaggttgggagttcgagaccagcctgaccaacatggagaaaccccgtctctactaaaaatacaaaattagccatgcgtggtggcgcatgcctgtaatcccagctactctggaggctgaggcagaagaatcacttgaacccgggaggcaggggttgcagtgagccaagatcgtgccattgcactccagcctgggcaacaagagcaaaactctgtctcaaaaaaaaaaaaaaaacaacagagttagttgtcaccattcttaattcctccttgggggatgagggaagagaatggggtaggagtggaagaagcctgattggggtgggagggtagggccaagaggtcctgaatatagtagctaactagttggactggactgaaaccagttcctagagttcatttcagccatccccctgcctctgctccccaattctgatatcttgaaaatctttaggtgcttcttaactctaaggatgtctactgaaagtctccctgaggtctaaccaagggaggctgtgtctttagagaatggagaggacaaggcaggtggatcacctgaggtcaggagtttgagaccagcatggccaacatggtgaaaccccgtctctactaaaaatacaaaaactagctggacatggtgatgcatgtctgtagttccagccactggggaggccgaggcaggagaatcgcctgggcccaggaggtggaggttgcggtgagctgagattgtgccactgcactccagcctgggggacagagtgagaccttgtctcaaaaaaaaaaaaaatagggaatggaaatggaagcaaggctctctaccctgcccattcctgcccagccttgccctcctgtgcctctgctaataccatctccaactactactgtgtgtgccaagggcatccctccccactgctcccatctgggggcctagtgattaggggttgggaaggatggggtgatgggtcaggggaccaggagtgtcccagaaggcagggaagcagagaggttagataagaccagctcggggcctctagtagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggagaaaggtccccgcccagcttttgccctgccaagggaagtggagaacttgttggtgggaccccagagtcctgggtagctggcacagtcctggtggctccacttttagcctctcccctgcttggttaatctgggccagggtcaaagcgcccctgcattcctaggtccgtctctgttctctctcttgggctttatcctgctccagtcccatctggtgtcctgtccccacacccccacccgtaattatcaggggtaattttagggctggaaagggagccactagtgggctctgcctcacccctacactctgccctggagggtgggggccaggggtattcagcaagtatatctacggcatggtgcttcagcctggagtctcttcttgtctggtgccacctgcacccccacacttttgaccctgatgcttgggcgttagaagtaaagaaagccatgcagaagggtcagatctgcctctttttgttcattcttccttcaatttgctgtaaacctcaccttatatgcattaccactctgttcacactcataccccccggactcataacatcacacacagacccacctggcactgatgagcccacctcccacccaaaggcacaaacacattctcacagtaacacagagtcacactcaaatgtggatgcagaaacacactctatactcagagagatgtccccagacacacataccaacatagagacacacacacacaaacccagattgattcacatggaaactcactgaggccagatacaccagcatacagaaagacacacagatacactctcactacctaccgctgcatgctatacagccacaccatcagttgtgtaagcagactcccatccaggcacacatgggtcatagacactgtcactcacacaccgtgtccaggcttgggggccaatagacagtggtctctctatctcatccatcctcttgagcaacaaaggaagttgcagagatgatatgaccagttggccacaacctttttttttttctttttttgaaaggtgggatctcactatgttgccttggctgatctcaaactcctgacctcaagtgatcctcctgacacagcttcccagagttctgggactataggcgtgagccaccatgcctggccagaccacaacctttgattcttcccaaatccttctatcaggcttgttgctgtggggttggaagtctagaatagtgctgtccaatagaaatgtattgcaagccacatgtgctattttgaaattttcgagtagccacttaaaaaaggtaaaaatgaacagatgaaatgaatttgaatattttatccaatggatccaaaatattatcactttagtacagtgtattcatataaaacctttagagatcttttgcatttttctgacattaagtcatcaaaatccagtgtacattttatacttacagtttgaacttgccgcctttcaagtgcttgatagccacatgtgactgggctacgtattgggcagtgaaggtctagaagatttggcaccactcttggccctgggttctgcaacctgggagctatgggaaggagtttttctttatcattggagtttctctgccatggaccctgcttccctcagctcatcaaaacctttttttttgtttgtttgttttgagacagatctcgctctgtcgcccacgctggagtgcagtggtgcaatctcagctcactgcaacttctgcctcctgggttcaagcgattctcctgcctcagcctcccgagtagctgggactacaggtgcatgccaccatgcctggctaattttttgcatttttagtagagacggggtttcaccatgttggccaggctcatcttgaactcctgacctcaagtgatctgcccgcctcagcctcccaaagtgctaggattataggtgtgagccatcactcccggcatcatcaaaaccttttactgacctcagtcgtcatcaaaaaccaggctgtcttcagcctgtctcctgagcatagaatgttgaggcactggggtccatgggaatggggcatttggagggtggactctactgaaggcctagtttctacctccacctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggacggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagtttttcttctgtaagatgagagatcagtgttttcatacttttttaaaaatagtatgatcctttcttcaaaaggttttctgcatgaaacctgagtgtgaacacagggaggagcagaggtgctgtgactaaagcttagccatctagtttagtccacctgccgcccctacgggtgccctagaaggcatcccccaggagctgcagatctttgaggggccctaaatctgccttggtccctccctctctgacagtctagactgtctgaggtggttgataggaaagccatccaggccgaggtgggaacattaggatgacaagtcagactgcttccagcctgtggctcaggtcaccagctctacagtctttcccccaaagggccctgtgggccatggagagtccggtcacagcgtgagcatttaagagtcgtgtccggggaggcagagcctcaagcctgcgtgttagggaatagtggcttctcccttctcttttcttcggggtctgggcccggagcaagaggccagctttgagaggccatgagcgtagccctaggggaggggctgtgcttgggtgtgggggcagtgtcctgtgctgtgtgcctgagaaaacatctgtctgtgggaggagactcatctggatcctgttcactaggagcagggaggatggagcaaaggagtttgtggaagatttttctccctttctttggttgattttgcatgttttcatctgaagctcctgggacgggatgcagaatgcgggcctgggggctgacttaaatgaccacgcgcaccccttcctctcgtgtggtgtgtgttcaagcttacttccttttgagtacctttacagtctctaaaacaacagagaacttcaaaaacctcaggtctgaatttccttctctgatattacagaaatcggcctcctcattccctcaccctatatccagaaaagttactcttttctaggttttccagagcaaatgatattttccccctctgtggagaaaggctgggcaggcagcatgaatggctctcgggtggaagtggggaggagaaagaatcgctggggcctggccccccatcccaactcttcctggcaggcttagtgcctctaaacgtcttagcatcttgggcggctctctctcctaggtgggggtggagtgggaagccagggtgtgaggccgctggacaaaggggtctttgtggccaggctgcctggccccacgcaaggccattaactgggtcgctggtctgggggggcaactgctctcccacctctcccccctcctgtctcattcccttctgtctcccctgtggaagtgggtcagtggcaggagaaagattagaaaagaatccagaggggaccagttttgctcctccttcctgtcctctacctgggccttaggccttctctctgaggcctctagggctccggggatgggttagacaggtgcttccaggccagagctgggatcctgtggggacagacacgattccatgcccacttttcagccccagctgaagccaacattgtaatccccaggcagtgtagatgagaggcatatcaaagggataagactcaccatcccctcttcctgttgaccccaacaaagtgccagaacccctctccatggggacagaggtagcccagaacatccagaacagagacatgtgggttctaagccatcactggctgtgtgaccttgggcttgtcttatagcctctctgggcttcagtttcttcacttgtgaaatatggtagatgcttcctaaggcccttctgtctctgacactgcagcccttagaagtggtttctgaaggttgactgggtttaggggaaggttgtggcctgcgtggagctgccagatctggcggcctgaatatgtgtctctcctgcccccacacagagctccaaggcaactgctctcgcctgggctgccagcaccattgtgtccccacactcgatgggcccacctgctactgcaacagcagctttcagcttcaggcagatggcaagacctgcaaaggtatgtgagtgcatgtgcctgtgtgcatgtgtgtgtgccagtagccagttgaggtgggcagggaggggcagagaggggtagggggcctggctggaataagaaactagaaggaaggtgcaagagagggggtgccaccaccccagggcatgactgtgagccctaaccatttgcttccactagacttctaaaaattcaccttaaaattatagtttatatgtaaatttttctgttgtaaaaaattagagcattaacagataaaaccaaagtcccctttgacaaatccccctcaattccggtccccttcccatctccctggagttcaactctattatcagtttgctctctctctttcaggcccttttttgtgcatttgtctctgggtattcacagaaaatctaattggaagtactgctcaagagtactgcgtgctcttttttacataaacaatagtatactgtgtatattattttcaatgtttttcactcatcagtatgttccacaatttttttttctgtgttaatatgtaaagatctacatcattcttttagaaaccactatgacgtatgacttttaccacagtttacttggtcacctccctgttgatgagtgagatgttcccaatttttcactgctacaagcaatgcaaacttttctgttttaaatttgcctccctcgggtctttgtgcaaatgccaccttctcagtgaagccgtcccccgacccctctaaaactgcatccctgccatctgcattctctatccctgttctcttttcattgcactagcacctctaatgtatactttatttactttgtttcatatgttattatagtaactatatttcatttattatctgaatataagtttcatgaggacagcaatgtgggtctattttaaagttcactgatgcacccctggcacctgacccatagtagggactcaataaatcttccctgcgtggatgagtgatatgtacacgagtgtttctctagagtggattccaagactggacttgctgggtgttaaggtttgcacatttcatgctgtaatagattctgccgaactgtccttcaaggtagctgtaaggatggacatgttgatcatgtctgatgatcacccacttcgttgcccttgtcacactggaaatgaccacattcttgccctttcctcggcagattttgatgagtgctcagtgtacggcacctgcagccagctatgcaccaacacagacggctccttcatatgtggctgtgttgaaggatacctcctgcagccggataaccgctcctgcaaggccaagaacggtgggtggggttgcctctggccacagtgctaactaagccccctcaatgctgttccctggtgggtggtggcctgagaggtggtcctagagccctggctgcacggactcttctcttccccattcccagagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgtgagtcacctgctctcagcttggagggctggggagggtaggggagacagggaaggtggaccctatcttgaacagaggccgggagttacacaggatggtcctgtctggggcaggagaagcaggaggctggatacaatggtgtgtgtttgaggcaggggcagagccaccggcacgctccctcccagctctctgagcaagtgtctggatggcccctgcatttctggccaagggctgagggggcagtgaatggtcaatctccagagaccagggactgtcccttctctgagaggggagtgttgactagactgcagagggactttccggtgcagtgggagccaaggctagggaaagaaggagcggaagcctgaggtgccctgttaggctgcagctgagggtaaaggagctggggcccagctgctctgtctccatgggccatcgtttccctcggggaccattgccaatggactctctgctgccatcgggggagggcagtactgaggttatttctctgtggctttgtggcagtgaatgaggctgggagaggagcgtgagccacatgagattttagaatatcctggatgcttccattcaggcttctccctaggctacacttttgctatcctagttgtggaagaaggggtgtcacagaaaggggcacgagcatagctgggtgtagacccactgccgggaacagccctgcccatctcagaggctgttacaccagcaaccttaaaagtcaacatctggcagcatcacatttccaaagaaatgcaccacagggctgagaggaagaatctggcctgtggttgatctgaccccctaagggagattaacttgatctgtaactgtttagtaaaccagaattcccatctctgccttggtttcctaatctgcataatgggtttgagcttgtctgtctagatcagattaactggagtgaaagccagtggtaaaggacagcacactttgaagttgaggattgtgaaccttgggcctctctagaagatcttcaagtttctttatttggttcttgtgatgaaaagaaagatcccaggaggttacaagggattcattctgggagagagaaaggcccctccccgggatggtggcgagcaggggttcctctgagagccctcactctccgtggcctcagcgtaaggttcacatttctgcctttggctcctccagagcatccctgatagcgtccttgggctgctgctgtccacagctcacctgtgatcagacatgtgtcctccttggggtgctgagctgggggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttctgggtaggtggctatggggtgtcctggaggtaaccttctcaacttctactctggcctcatctccttatctgacttcctccccaggagaagctggtagccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttctgggtcatccccctccccaggagatgctgactggcctgccctggtgtgtagggtggctggtcccaggcactcacctgcacagtggctgctggcctgtaattagctccccaaggaggacgaagaagaaaggctgcagctttcccctgctttcactctgccctccagggcagccctccctgcaagccttccattctgtgctgtgactgtgacctctgttggacccctggggctgagcctcatgcagcaggggtgcacacagagggaggagtctgacaattgaggggtgttcgagccagcgaggccagcccgctggtgcaggcagaagggggagcctgccccagagaaaactctggaagcagaaatagaatagaaagaaggaaggaggccaggaaatgagcctggttcacatgtgtcctgggccatgtgagtcagacctgttgtggagtcctgagagcccccgagggcccccctgaggccctgcagtgtgtgaacattcctcttcaatgccccagggctgctgaccctcctgcctcaggcccagtgttatccccctggattgggtgggtcatctcttttcctcccacctgagattacctccccctcccctctgccgctggcccagtggtttggggaggtctatgaggctcgaattccaagaccagagaactccatggtgagagccggaagagaaggcaagacccttggccagtaccaagagcagccctggctttcactactgctttctcaaaggggctatgcattgatttgattttagatggtacctggacaagctttttttttttttttttaactgttatagttacgtttttatttgatatgcattaggaaactcctgtaactagcacatcaaatctgttacttcagcaattgtttagcatgcagcgaaataagaaaagtaagttaattgaaataactggtaataaacagtagcgcaagctgtacataagcatggtagacattttgaaagtgatacacaaaagactaaagttctgaaaattgaggcccagagggatcaacaggcctgatagtcccttagtcaggaaccaggcctgcgcactctcacccccacctctgaccagtctctcagctccagaggcctatggagcctgtaacccagctttgtccagcctcctgccaggctgcccctgggcaggcctggtggtgcagtctaccgaccccagcccagccctgcatttcctaagctgagctcctctgatctgtattcccttcaccttggaggatgccaccactgtagaaagaatgaggcagactgcaagattggggtcctgggaacatgggtgtgtatggtgaggggaggttctgaggttgtaaatagaggccttgaaggaaatcgggtttgctgaagtcactcaggagtttggactgtgtgtgaaaggatggtctgaaggggctctcagaggtctcagggttcccctccctgcaccatgctgcatggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtgcctggacacacacagatacccacatactcacacagaacctcatccacgcccaagcatggtctagcaacacacacagattcccccacacaggcacatgcctgcccaccttccggtctgtgccattgagcagtatcgtctcgatgcggtcgtagaaggcatccacccagtagaggcgcccagccgggatgtccaggcttagcccattgggccaaagcactgtcttggaggtgacaaagatgtctcggtgtgagccatccatccacgccctctccagccgcccacgccgactgtccttggggtcctcctcccagtctgtccagtacatccacctgtgggcagcgactggtcagcatcacctgggnnnnnnnnnnnnnnnnnnnngggtgtaaaggacagttttagcaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaatacatgtgtgtcagacgcctgagacaaagacaaaaggcagcgctctccttacagtatttgcagtcaggtgaagaggccatgatcaaagaagctccagaggcctatggagcctgtaacaggaaaacttccttctttttttttttttttttttttgagatggagtctcactctgtcgcccaggctggagtgcagtgatgcaatcttggctcactgcaagctctgcctcccgggttcacgccattcttctgcctcaggctcccgagtagctaggactacaggtgcccgccaccacgcctggctaattttttgtgtttttagtagagacagagttttaccatgttagccaggatggtctcgatctcctggcctcatgatccacctgcttcagcctcccagagtgctgggattacaggcgtgagccactgagcctggccttgaaaacttccttctaatagggcaagcttccttctgggagcctgagccgagtcttgacgagtagtaggtgttagccccaaatggcccacctggagggcccacctagagtcaggaggccacagggctctggctggaggcacagagggcgacttggtggaaaaggtgggaaaggatgggttcagggaggggaggacatggtgggaaccgcagcccccatgtggggagtgtttatcatgcaccaggcctcatgctaagtgcagttagtgtaccatccagttttacaaatgaggaaacagagactcagaggcattaagtaacttgctcatagcctcagttggaaggtgacagaaccagaattcaaactcaggctgtcagtgtctagggcccagttggacccagggcagagcagaatgatatgaggagaggtggggaggttcctggaacaagggccagaatctagtgtgctccctggggatgtggatagaggtccagggacctctttggatgtgtatacactcttgggtgtgtagatgtgttgggtgacattttctcaggacataaaggcttcttccttccttccgatttccttattttagagcaggtgactagaatcctgcagctgaagctagagtctttttgggcatggggtgggtcccatgtgtttgggaaagcagccaccatgtatggaaatgcctcttgaacaatgggaatgatggagaagttgagaaaagctggagttgtagtgagtgcagatgctgagcagtgggatggggtgccaggacaccaggtctattctggggcctggaactgaaagtcctctgtgccataatgggcagctgtggtctctcgtctgactcctgcacctcttccctgcttcctagcctccctcttcatgcctggaatcccctgcccctctgcccctagaccacccccaactccttccacaacacagcctccctctctcccctttggtttatttgagattctcctgtcctcaggattttcggcctttggccagagcctcttcagaaggtgcgctcaggtggttggcccttagaaggctgggcgacaaggggacggctcccctcagggttggtggagccagaatgctcaggatctctgggctgaagcccaggactccacctggaccccaattcataagacagagaggggtggcccagatactgcctatagggcagccctggaggcaaggttcctcctctccctttgagcccatctctctacactggccttggagtggtggccaagtgtatgtgtgtgtgtgtgattgtgcgtgcatttgtgtgtgcatacgtgcgtatgtgcgtgtgtgtgtggtggggcaggcagaggaatctgaactttaggagagagaaaaataatgtggtgcagggggttggataacaaaggatttttgcttgcaactaatagtctccagctgcaaaaataccaaaggggaggccaggcaggccgaggactccagttcttgccaactcctcaccggcctgctgagtggggccctgcctggcctttggggaggtggaagggagaccggccaagggtaaatatctgagagcagggatgatctctctgccttccttcccggaattgggagggaatccaggccacatcctgaggctgggggggctgattgtggagctgcacctgggatagcggcatcagatctctgcaggtttcttccttctctctcttgccaagagaagggtggatagggggagcaggggcagggtattgccagccctagggctgggcagtgactcagggaagcctcaggaagtcggagagaaggccggccgtagctgcgccagctggtgctgggaaaacagctttcactgatgaagttcatacacatgccagcagcccccagacccctgccgtgcccaccaagtaaagggcacgcagccctgtttgacttccagccaccctgctggctgccaggggatgcaggcaggtccctgctttgagacttcgatttcctttggaggcagcccagcagcattcatttgaatctgttttctctgtggttacagcgtgtggggcaaagaatttggttgccttacccctgcactaggccctcttcctacagggccttggcctcctcaagctactcttccccctctctccaatcttgtgaggatgggacagtactgggggcccagaggaaagagtggctgggcttggggatgcatgaatacttacgggggtaatacctcgtctctgtggccttgttctccaggcattgggatgggatttagcagagaggacctgaagaagaaactagtttgatgaagccctcagttggctccttcccttcctgtcctgtgactctgagtcagtgtcagggcccagccaagttccttgagagcggcgttcctgttctttttgcccccaccccaccctcacccactgttagggagcagcccctgaatccctgtggggaggagggggaattagggaggggtcaagcagaacagcaagtcattatacctgtagctgtgtgggggcagaagaatccctactgggttgagtatgggtaatggaggatgagtttcagcccaaagcaggtagcccaaagatttctttacttgttggggaaactgttggagatggagttccaggcaggggtcccagaaagtcactgccttaggagtttcccagtttgcaagaggcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgagccatgcctcagtttgccctgaggattctttcatggccctcctcctagactctctctcctccagccctatgacttattccccacctcttctgaccctccccaggacatgaggacattgagcaataaggacattgcaggaacaggggactggggctgagtagaggaagtttggcccatgtcactggtgcccaaccttttgcccccatggatcttccctttggcatctctgtagagttcatattttgaaatacttttctcccaaactgggtttattagcgtgtaccctgcttttccactttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagttaaaaaaaaaaaaaaactggactgagctagtggacctgtgctctctaccttttggtgccccaagaagatggtcccttttcaaggatgggctagaattgggaagtctgtcagtcaaccagccagccagcatttacgcaagccctcctgtatatccactctgagctaagcatgggggtgttgggtgggagggcgtccagagaaggtgggcttccaggtgtgggttctcaccagcaaagggtgggcatctctgcaagagggcctaccccaccccatggctctttcattcgtactctccagacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggtgagagtggcaggcggggttctggccctggaaggtgggaggctgaggctacagtggtaaggagggtgcccaatgtccagaccccatttaacatgcatcttcccacaggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggtaagcaaaaatcttcagaataggttagtccagccagaggagacaggagtaaagcattgagttaaaaaatggtggggccaggcacggtagcccacacctgtaatcccagcactttgggaggctgaggcaggagaagtgcttgagcctcggaggtcgagaccagcctgagcaacatagggaaaccccatctctacacaaaatttgttttaattagccaggtgtggtggtatgttcctgtagtcccaactactcaggaggctgaagcaggagggccgcttaagcccaggaggtggagactgcagtgagccgtgatcgtgccattgcacttcagcctgggtgacagagtgaggtcccgtctcaaaataaataaataaaaattaaaaactacaggatgaattggggaatgcaggtcatgaagtctggaggaagctgaggggatctccaggacagagggaggaacccctgtcatctcatgctgtccattcttgcctgcccgtctcagattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgaggtgagcagggctccatggcccctccaaagctggctttaccccatgatggctctgggaccttgggatcacagcccctctctgggccctcctgtggggaccctggcttctttcatgtcatgaccgattctcctagccagccactcgggctacctgccctggcccctcagcttcccctgccagcccccatccacccactcagcctccagatcccactctgtccctcccattccccttgccagtctggagcagtagcacctggccatgggcaaccctggaactctcttccctgactactgaagcccccactccaagagtttgaaggctgggttgttggggggcagagggtttccacccctgtggcttccaaatcctaaaatgggatagcaagcacaaagaccacagcagcagggggtgtggtcagattcaggaagccttctcaaggcctggcacaggggctctgaggggtcctaacagctcttcaccctgcccccagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagagtgagtgacagggaagggggtgtgtgcccattgggaggctgcgggagggttcctcaggtgtcccccacagcccggctgcctctgtctgacatgcagggagatgaaggaagtgtcccagagtgtacctgctagtgagggcagagatgggacttgaatccatattcgaaaaaagtgcttttctcactcacccaccggactctgcagaaaactaaactgattcattcagcaagtgtctagtgagcagtgagcactcactacatgtttggcactgttctggtcatcaggattaagcagcgaacgagatagatgttgtccctggcctcatggagcttatagtctagttggggaaacaaataaatgtaactttaggtggtaataagtggttatgaagaaaataaaacagagaatagtcaggcgtggtggcttatgcctgtaatctcagcactttgggaggccgaggcaggcagatcacttgaggtgaggcgttccacaccaggctggccaacatggtgaaaccccgtctctactgaaaatacaaaaattagctgggtgtgatggtgcgtgcctataatcccagctattggggaggctgagacaggagaatcacttgaacctgggaggtggaggttgcagtgagctgagatggcgctaccacactccagcctggatgacagagcgagacttcatctcaaaaaattaaaaataaatgaataaataaagcagagaatagagttaatgaggagagcaagggcctctctgaggatgtggtgtttgagccaagctctctgtgaaatgaagagggcaaccatgtaactccctgagggaggagcatgtccggcagaggaaatcaacagtgcaaaggccctgaggccagtgtgagtgtggcaagccagaggaacagcacgaaggccagcggggctgagtggtgtgagggcagagaaggaggcaggggttggattttattatatctgggataggaagctcatagtgacttttgagaatggaagtgacatgattggattcacatttgtataaaagtcacgctgctactgggtgggggatgggcagtagggaagtagccagaagactttcagtgtagtgggcaagaagtgatgtggtttacactaggatggcagcagaggaagtggtaaacagtgatgtgactccaacatattttgaaggtactccttttataccactgatttcatgactgatcagtgggcacttagctgaaaacctgctattcttccctcatttcctacccttggagtgcagaggtcagaccccagggtattgcggccaggacccatcgtcctgtatgttagcgtgtgcgtggtctgtccatctgacccagagcctcgcatccctaacgtctcctgacccatcacagctagggcattgcagccccttggccgcagcccctgggtggggatgatggtcatgtgtgtgtctgactgtaccctggcttgtgcctgctctagagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggtatgggctcctagggatgtggcccatggggatggaagggggctggggcccaggcatctgtttctcggtgccctctcagcaggatggtcccctgctgactggctggctgcactggttggcatggagatgaggggatagacagattgacccctgtgtgacccccttcttggctgagccaaagaggcagggttaggatgggttaggcagcatgggccgtccttgccagcccttgggaaaactcagggtctgtctgcattggcttagagccctggagctgcacacagcacacagccaggggacaactgaggtcttgaattggagacaggcctgccagatcaaaacagggcacacccacatgtatgtgcgcacacagggtctgtgcagctgaccttgcagtcgccaaaaactgcatgctaatgtgtcctgagaaaattgtgttttgtgagttgcatccaggtcttccctctgagctgcttgggcaggttcacagtgcattgtctttttaatgtctatgtgaaggattctgagctgtacgagttctgccccaaatctgcacttgggcctcaggatcaggccgcctccccatcaatctggtggatgccagttataacctttgccctgcaccccatccacactgtagttcagagaaaatcaacagtcagcaatcatatcacaagactttggggaaatcaaaagtaactcatcaggaaaagattaggggtccctataccaagggaactgctatttaaaggacacttggagtgaaggctttggctaagtgaaaaatcacttcctaatttattcattttgttagttcaggatttttaggcctaggatatgatgtcacacttgtgcccagagccacatgcccgttgtttcagctctccatgcaggcacgggccagatgccctcacacgagagcccacatcagccatgtagtttaccatctgccacgtgtggttttgagaggctagccctgatacaaatggcagcacacagggctttcccctattccttttccagcctcctgtccctacccccacccatctgtctagggccccagagggtccctgcacccctctgtagcccagactgctcaaaggtacctgagtccgggagggccagaggcaggcagctttgaacttcctttgaagctgttcatcactggtccctcttcccccaacaggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtgagtcctcccaggccttggggtgggaggagctgggagtgtgtgggcctcagataactggaggatgaaatggacagggaagcaggggaaggcaggtgaggcgggatactttagcaggaatgagagtctgcaaggggagaaggagtccctgtcttcagggaaatgggagtgattccttaaacatagaagaaatctgatcctgtcactcccagttcagggccttccaccagctccccttaccctgagaatgaggcccacgttcttgtcaggcctgcacagccccacagtgtctgcctggcccttgtctgacctcatctgcatcccgcttcccacacttgaagttctgtccccactgcctgctgtctgtttctcaaacaagcaccccggctcctcctgcctcagggcttttgctcttggagttcctcagcctggaactcccagatatttgccggactggcttcttctctacatcaagtctcactcatgccacctcctcatggtggccttctccatcactcccctgacacccccacctgcagcccggtcactctccaccccatcaccctgctttatttccctcctggcctttatcgctctccatgtaaccttgattgacctgtttcttgtgggatgggagctccgtgggagcagggaccttggctgccttggtctccactgcatccatgaatgccaaaactgtgcccaacttacaggcactcaacaaatatttgttgaatggagtgaatgaatgaaatgtgtggtccagtgatgagcaggacaggagacccctgtgaggagctctgggacagcactcatggattgggatcacaggggaggctgttgatggcgggggtgcccaggtgatgctgaccagtcgctgcccacaggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaaggtgggcaggcatgtgcctgtgtgggggaatctgtgtgtgttgctagaccatgcttgggcgtggatgaggttctgtgtgagtatgtgggtatctgtgtgtgtccaggcctgtgtgcctctatagatgtgtgcatctatttttctgtgcatctatagatgtgtacatctgtgagcttgcatgtcttatgtattgtgttgtttgtttgaggattgcctccatttgcgtctctttgtgtctattcgtgttgtctgtgaagttgactgtccatgtgccagtctctgcatacacaccatgtgcgcctcctcatgtgtgtgcatagatacacggcatgccttggtgtgtgtctgcactctctgcaagtgtgagggcctagggacggcatatctctacacttggtcatttgggttgtcatgtgcttcacgagtcatgtacgtgttctagtatataaggcccttcatgatatggcccctgaccccctctctggtctcttttctccccacttccttcatcccaacactctttgaacaagcagcactagacagcttgctcctcccagcacacgtcacagagcatctgccctctgtgccattactcatgcagttcattccacatggaatgttcaccccagctcctcttcccctggcagactgctcaggggctacctcccctaggatgtcatctccagacccctcttcacactggatcacccgtatgtgccctatctgagacagtgggaagctcaagggcagagatcgtgtcgttttcacctcttactacctactacagctcagcccctaacagatcctggtaaatgttgaagaaatgaatggatgaatactgcccgtctgctcattagtgtgtgtgtgtgcgcgcacgcatatgagtgtgtgtgtgtgtgtgtgcacgtatgtgtgcgtgtgtgtgtttggggactatgaatgaataggaatgagcccaggagaggaccatatggacaacctcaccatcagcatccttgctggatcactcgatcacccgctggcttcaggatctaccatcccactgtgtgcaaaactatcactctctggggctcccaggctaatgggggaaacaaagcaaaacccatgcccaggacatagacaaatgaatgtacaaaacagtgatctcacaggcctccctcaattttcttccaactccttagtaacatcctctccatccctagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaaggtacctccttggggctgggggcagcgtgggacctggaaggggtggtgggacttaggcattgatttgagacttcccctgggagtgaaggcacttcccagggatcctaggctctgacttttgaggatcctgagaagagaactcccccaacacaatctgattctctgttccccatttcccttcctgccccatgtctgtgtctcctgttcttcaacatgatcttcttcctctccatatttcctctttctgtccccacatcttaatgtgtctcctcccctatcccttctctgacctctcctcacctcttcctccctttgcctttccccatggcccttccccacagttggcaccaacaaatgccgggtgaacaatggcggctgcagcagcctgtgcttggccacccctgggagccgccagtgcgcctgtgctgaggaccaggtgttggacgcagacggcgtcacttgcttgggtatgaggtgcctggctgggtgggagtgggaagcagaccccatcaggaggatgccgaagagtggggaggggaggatccagggtcccagtcagagattaaggaggcaatgaggggcccttagggggccaacaggaagcaagggagggggagagcaaaggctctgggggctaggagggagtttagggaagatgggaggctgggagggacttgtgaggggatggcaattaggggaaactgagtgaagaatggacagctatggatggaaggaggaaattatccttcacttcttttaaatgtatttctccattactaaagtaaaataataaatagttccaaatattggaaattactttgggaggccaaggcaggctgatcacttgaggtcaagagtttaagaccagcctggtcaacaaggcaaaaccccatctctactaaaaatacaaaaattagccaagcgtggtggcaggtgcctgtaatcctagctactcgggaggctgaggcaggagaatcacttgaagcccggaggcaaaggttgcagtgggccgaaatcatgccactgcactccagcctaggcgacagatggagactctgtctcaaaaaaaaaaaaaattaacattaaaaaatacatataatatatatgttggaaattagagaggagaaaaaagcccaaatcccaccagtgagcaccatatattgttagcattgtggtaaagtgaacaccattcttttttcctcaggggggttataattgttttttacatagctgtaatcatctgtttataaaatgtcttctgcccttttcggttcaagtgtcacagcattttctgtgttgttattgcatgattttaacaagccttgttttttattcaaaatgggttgtgttcattgtaaaacggagtaagtaaggccgggcacagtggctcacacctgtaatcccagcactttgggagcccaaggcgggtgaatcacttgaggtcaggagttcgagaccagcctggccaacatggtgaaaccccgtttctactaaaaacacaaaaattagccaggcatggtgtcacacgcctgtagtcccagctatttgggaggctgaggcaggagaatcgcttgaacctgggaagcggaggttgcagtgagccgagattgtgccactgcactccagcctggcgacagagcaagacatcatctcaaaaagcaaaacaaaacaatgaaataagtaaacagtatagaaaaacacaaaggagaaagcccaaatcatcccagattccaccacctgtagataaccactgttaccatttgggggaaccacctcccaaatgtttccctatgatttactttcacataaatggagtcgtgctgcacatactgttctgtttcctgcttttgtcacttgacagtatgtaacgagtacataagcagcatttttaatggctaaaatatatttcatttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaaccaggagtgattttggagaaagtgctggtgagccaggagctaaaaacccttacagatgacagggtgcagcctgggagccttccagaagtagaggttggtacagaagcatgatgtaaggggaagaacagtccagggaacagcagtgaggagcaaggaggacacataccagcctccaggtccatggtccatgggatacgggaggggaaatcgccacccatggggccatgggaagtttcagagattagagaggggtgggagatgagtcagaccaggcaagcgcccagctgtgaggtctggagaccgggctcacacaggagcctgcacttgtggaggttaccaaggcacagacaaaggacgtcgtgatttagctgctaatgggccaagacagatagtgatggtgaggcatacgttctggggacaggatgggtggagcctgcgcggatgtggtgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaagtttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttggatggcaggcctgcagggcagctcggctctggcagtgcctatactggagcgggcaggaagctgggggcacccaacttctcgctgacccctgactcattccctccccagatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaactgccgggcgtggtggcgtgcacctctagtcccagctacttgagaggctgaggtgggaggatcacttgagcctgggaggttgaggctgcagtgagccatggtcatgccactgctctccagcctagacaacagagcgagacctgtctctaaaaataaaatgaaaggagcaaaagaatttagggcagaggggatggagccctgagcaggagtggggtctgctatccccttcccagcctgggaaactgagagggctgagcttgcaggggacagagcatagctctagactggagaggaggaacaaggcagggtagatctcctcctgggaggataccagagaccccttgagagaaagagtaaagcatccagtgagaccagagagatggttttgaattctctaagagaaatggttttggatccttggaaataagggacaccaaaggcagagaataatagggaagaagaggcagtgaagagagggtcaggacaatgagtactcacacccatccctgccccccagcccgcacctgcccccccaaccagttctcctgtgccagtggccgctgcatccccatctcctggacgtgtgatctggatgacgactgtggggaccgctctgatgagtctgcttcgtgtggtaagagggatgggcagagggagtcaggctgggcctgggggaggggcatcctgagagcatgccagttgggggtgccggagacacctgcaacccagcacttgggtggccttgagtgagttaatctcggtggcctctgtgagaggagagccccatcatcacagcattgtgtctcagcaaactcatgcaggaaaagcactcagcacaggtcctgtgtctgctgactcatggggatgagtgagtggagtttccagccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaagtcaaagggcttcagaatccagcagggcctccctccaggacactgaatccctgctgggttgcctgggagaaaacaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccctcaggctctgggcttcaggctcagaagcccacctggcagatagccatggaccaggtgatgtcagccttgagccaccagggctagtatgtgtgtaaatgtgcgggcaggtgactgccgtgtgtggtgtctcagggctctgttctgtctgtgttgtgttgtgacgtgctgccccagtggttcctgtcccagctgatgtgtgagcggatgtgttgggtcagtgccacgttgcccctcactttttctgtgtctcgcatgccaatggttgccccggcggtttctgtgtttcagagaaggattgtggggacggctctgacgaacagacctgtcctgagcctgccggtcagtgcatagaagcacatgcaccatcacccagagctcagctggccccagccccctgcaggttctccaggcccctactccagagctgctaggatatgaagaaaaagcaacagagaggagggagagcagaaaacagagggagaaagcaaatagtggtcaggaaagaagcagagacggcagagggagcctctgaggaaaggagatgacagagaggtggtgacaaaaagcccaagatgcaaggggaggagagagttagagaagcaaatccagttggaaaagaggcaggaacataacccaaaccccagtctccaccacatgtcccataaatacagagggtcaagtcaagcagcccccacccaatgctgagaaagcaggagcttccttcagccagcctcagcgagcttggtccagaagtggcccccactcttgccagccacaggcagggcccctgtaagccaggcacccagagcatggtattcagcagtgccagcctcagggcaggcctgtaaagcttgtctcaagccggccacgcctgcaccccacctacctctctccctccaaaactagagaaacccctgcctttcccccaaaagcaagcagacccctgttcccacacctgccagaaaggggaaatgaaatgtttaatgttccctgcacccagcctttctgagcttcagtgaggggccctccaggagccttctcctcctcctcatcctgaccacgtgggccatggtgcatgctgcagtctatgcagtttctgtgtcttttctgtttgttattttcccagtgggggggttagggtgggctgagggtgggttctgggcagggggcccaagctgggatcacagagaaggctgctccaccaactcccgctttgcctctccccttcttcccccaccgccagacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgtggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggcctgtgtttggtaaatagtagcttgagaaaaggatgctgcaggcagggatgaatgagcctgaagagacagaggagagagggcctggctccacaaggctcccagtgccctggcctctggggcccagcctcgggggcggtggggacctagttttctggagggatgggccctctcaaggaatgctggcttcctagctctggaagatgtgcagatttttatgtgaaaactaccaaatttttaacactacagtattagtttctctcgtctcacagttctggaggctggaagtcccagacccaactgttggcagggtgggttccttctgaggccgtgtgggagattctgtcccaggcctctccccagcctccgcggtttgctggcaatctttgcagctccttggcttgtcgaagcttgacccgatctctgccttcatcttcacacggtgtcctccctgtgggcatgtctgtcaccagatccccatttcccctttctgtgaggacacctgtcatattggattaggatacacccttatgacctcatcttaagttgaccatctgcaaagacactatttccaaataaagtcatattcacaggtattatgggataggactaatatctttttagggaacacaattcaagccataccaactggcagttgattttagaagttttaaaaggctgggtgcaggccaggcatggtggctcatgcctataatcccagcactctgggagggtgaagtgggaggatcacttgaggccaggggttcaagaccaacctggttaacatagggagaacccatcttgaaaaaagaaaagaaaaaaaaaaaaggctgggtgtgttgactcacacctgtaatcctatcactttgggaggcaaggcaggaggatcacttgtttccaggagtttaagaccagcctgggcaacatagtgagacccctttctctacaaaaaataaacaaaattagctgggcatggaggcacatgcctgtagtcccagctactcagaaggctgaggtgagaggttgagcccaggaggttgaggctgcagtgagctgtgagctcgccactgcactccagcctgggtgacagaataagaccttgtctcaaaagaaaaaaaaagtttaaaaaaaactacagaccaaactcttcctgcaggcctcatctgacccatggaccactagattacagcctctgccttatagagttagggcacattcccaccctagtaggagaagactggacagcgttgagtgcccaccttgagccctgccctgagagggaggacagagaaggccacaggaagcttgggaaatagtaattgcgtctccagggctatctctgtgaaggggagggtgaggggcacaggtgatatcccttagggttctgagaaggggcctctggaggctgtgtggtgtggtgagaagagctccctgccgctcccagataagctgggcaaatttggacaagttgcttcccctgagcctgggcatcctcctttatgaaatgagctgaggtatgtgaggcctggcgtggaggagcagggtgtcactattggtagcagttgttaactatggtatgagctggatggtctgggaccattcaggaggagttgtgtttagactgcaggtaaatggacaggagggagggtcttccagtggggatggcatggtccggagaatgctgtcgtcaagacttagagggtgaaactgagcacttccgtagggtgacagtggggccaggtggagccgttcagaccgagggaaaggctcgtgcagggacagtggggaatgaggctgtcctcaaagggggcagatgatgacagcaggtgtaaatcgtgagaggcttgatttgggaggcactgggaacctttgaaggatttccaagccggaaggtgctgtgatgtaggaggtgatttcggaacacagccctagaggaagattagattgagaagaggttcaggggccccaagaaaggaaaatcagttcagagactgctgctgaaagtcccggcatgagatgagagcatcagctgggtccagggtagggaagggggaggagcggggtgtctgtggcagcatgagtgtatgagtgtggggctccaccaggcagtgctcctgctcctctcctggcctcctgagtcagatctcaggacagcagccagagtgatcctgacaacataagtcagatcatgccctggccctgccctccagcctgtactggctccctgcacccttggaacaaatgccaagcccctctgcacggcctgcagggcccccacccctacccctctgacctgcattcctgccctcccctccccctgcactctactccagctgtggcgttttcttttttctttttttttttttttgagatggagtctccctctgtcgctcaggctggagtacagtggcgtgatctcggctcactgcaagctctgcctcccgggcagctgtggcgttttcttttctttcttttttttttgagatggagtctctctgtcgcccaggctggagtgcagtggcgcaatctcagctcactgcaagctccgcctcccagttcacgccattctcctgcctcagcctcccaagtagctgggactacaggtgcctgccaccacgcctggctaattttttgtatttttagtagagacagggtttcaccatgttagccaggatggtctcgatctcccgacctcgtgatccgcccgccttggcatcccaaagtgctgggattacaggcgtgagccaccgcgcctggcctgtgtgctgttttctgaagtgctggcgtagtcctatctcggagatgagactttgcagcggctgttccccttgcctggagtgtgcctccagggatcctctgggctcactcgctcttcatgcaggcctctgctcagattccttctgcccagaggtcttccctgaccatcttacctgacagatcacccccatccctctcagcttctacccagctttatctccatagctttatcaatacctgaaattacagtctagatttatgggttatgtcttgtctctcttccccattagaacctaagctccatgagggtagggactttgtctggttcagtgctggccccaggacagcgcctggcacacaggaggcactcagtaaacatttgtggcatgaatgaatgaaatagaggctaaggaggtgggcatttgggctcaggccttagcaaattgcttctccagctgagatctccggtgtcaatggggggattagatgaggtgattgtggggcccttggaggtgtgatgcctcctgactctactactgagttggtgcttccaaggagtgtcagcaaagcttggcagactctccaggcctgcctctgctcatatccccaggctgggcttaccggggtggcagggcacagggatgaggagggctgacctgggcaacccctccctcctgaggccctccactgtccctctgcagccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcggtgaggcctggtcccaggagaagggtagggagggtggctgggtaggagtctgggccaaggacagtctttgggggacctgagtctaggagagagcagctctggcagccgggcaggcgagcagcacccagagtggtcaccagcagcctgtgtggacctggcgctccccatggcgctgtgctgagtgagccacgccattagagcagtttatccacaaggcatccctgggggccaggtgctctgttttctccgtttgacagatgggagcactgaggcatggaggggttccatagtggtcccccagacttgggccaaggtagtacagctcctaaactgctgtggagactcagaccccttgcccacatgcataccacagagagatgcggagtgctcttgtggagacaaaggcaccagggttgactgctgatggtcagggcaggcttcctggaggatgtggggattgcatggggttcccaaggacaggcagtacttgcagagtgagtgagaaggcatgggggcaggcgcggtggctcacacctgtcattccagcactttgggaggctgaggcgggcagatcacttgagctcaggaatttgagatcagcctggccaacatggtgaaaccctgtctctgctaaaaatacaaaaattagccggacatgtctgcagtcccagctacttgggaggcagaggcaggagactcgcttgaacctgggaggcggaggttgcagtgagccaacatcctgccactgcactccagcctgggcgacagagcaagaccccatcccaaacaaacaaacaggcaaggggaggagggtgcccattcaagaccaaaagagatgaggttgggggagtccaggagtcagggaggaccatgtggtgtgacttggggatgaggagcagagcagccttatctggtcctcttagccaggcagagcccccagttccttggaagggaggagtggaagataaggccacagggactggctgggagaactgccgacaggctatcagtcaggctggcagtttccagggtgtgccagaggaccaagggtggtataggccctgctgcaccccaccccaaacccctccaaatcaggagagatcagcacaaggggactggacctaaggacctcccagggtccctcccagggaggcaaaaagctggggcccccgccctgggcccaagaaggcaggaacatatcgagaccagacagagatattgaggggtgctccctgtgggaaggggaggtatggtgccagctggtgggtgcaagggtcccaactctggtcctgagggagcccaggaagtcctgggctgaagctcagcctgaagctcagcaggaatggagacgaatggggccgtgggcagggcacaaggacttggtccaggctgcccaggacttggggcccagcagggccgtggtcttgcctcctctcagcttctgaccctgggtctgttccatgcctgcccctcccctagaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgtcgcagcctgggtgagacaacagtgaggtgtggtggggcaggccgaggcaggcctctgagctgcagtgggttgggcttggtggccaggtgccaaaggctgagttttccaccctagcccccagtgcccggaccagcagagacctgcctgcgccaggacgggtggcacacaggcagctagccccttgctgaccccatcacatccctcccatcccagaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggaggtgaccaccgattgctgccaggcaggatgcacacaggcggagcgctcaggcgctaggggccacaggtcccatccaagtggccccaaagcagaggcttggctcccccatcccccacacttctgttcattgggttagattttgctgtgggtctccatgcctgacgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctgctttctgtcccaggcagcgtggtgcaccccagacttccttcagtcacacacaatagtgagtgcccactgtacacactgggcagtgggcatgcagcagtgatcaaaacaggctgttttcagttgtgtggtcaaggaaggtcccctgagaaggtgacatctgagcaaaggcttctaagaggcacattttactagagaagtttgtattgtttgtaataatacaaacttgaatttgaaaccattacaaatgtccatcaacgaggggggaggctaagtaaactgtgatgatatccacactgtgcaacagtctctaaaacaatgaggcacacacataatgtattagcatggaaaaatctttatggcagtcacttgagctcaagcagttgaggctgccgtgagccatgatcatgccactgcatccagccttggtgacagaagaccctgtctcaaaaaaaaaaaaaaagttggggagacaataggagtcctactcttgaatatgggcacatcagaaactttggcagaagtgccagggttgagggtgggtcatcgagggctcccaggatttcacacattcatgcacagctccccaggagacgctaacctttcactgccctctcttctccagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggtgaggaccttgcccagccttctcctggccccatggcccccctgaagtcccattcagcctggccagggacaccttactcctcagtgccatctgcctcctcccaccctctacctacgatcccaccacagtcgctccctgagggccctgactttagccctcctgacccctccccactccccaggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagcaccctctgtgccctgagaaggcccaagtctgtggcaccaggacggggtggggaggaacctgtggtgatgagggtgatgagaaggaccaagggatctagaactaggaacggtggcaaaggactgggcacaggaggaggaggacggaggggcgtggggaggccagggccgaggggagggggcaggtagaggaggcggaagcagggccatcagctgtggttattcacactgtaccatcctctccactcacctgtcctctccactctgttccctctgctggggctgtgtctgcccagagggaggggaaacttctttctaattggtctgcccagggagggtgcctttttcttttctttttttttttttttttttgagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctggagggaaggccgcaggccccaggatcccggttgtcagctaaggcagagtcccagtcgggagggtcccgataggagaggctccagagacagccactgtgagaaggggctgcaggtctgccaggggggctgcacccagcggggtatgtccacggagccaagggccagtagcaaacagacggatccagaagaaggcagggcctgaaaccggattggtgggaagcacagaggcagggactgccttcagtgaccagcccatgccccacagagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcaggttcttcctggccctggatgcccaccagtggacatgggcacctccacccgccccttgctcccaaccctggtctacttggtccgagtggtccttctcccagtcctgttccccctcagtgctccagcctggtttcctgatcccttttctccagaaggcacactggctcccctcctgacccactgccctgcagacacccaacaactgactccctacttgtgcccccagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggtcagtctagggcccagggccggggagcatggggtgtggggctgggaagaagaggaccctgacctttccctcttggcaccctccccccaggaagctctactggaccgatggtgacaacatcagcatggccaacatggatggcagcaatcgcaccctgctcttcagtggccagaagggccccgtgggtacgagcttccctgcccacccccacagcccctccctaattccttgaccagcaggtgcttgcagggtccttcagttgcccctcagcctccccagagccctagcttagtgcctgttctcaccatctgctcccttccctggatccccagccctgggccagactccccggcagtgactcccccttttccaggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggtgagggctgctgggcgaagcagagatgacgcagagcaggccaggccagacctactgggagacaggggctggcttggggcagtctctcaccatgtggggcgggcctgatgacttagggccaatgggcccttcaggagagctgggtgtggggccttcccaagggtctcatcccctcctgctgccccaggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctgggtaggtgcgaggccgggcggccgctgggggctcaggggcaacaggggagccgtccagagctgcaggctgcagggccatggggcaagggagtaagtgggttaggctgtacccaccacccaaaggggctccttgtttccttaccacaaaggcgccttgtaggctcccagcagccctgttcacaaggccaggggcccaggaggacagaaaacctgagagctgggtagggtggtgacccccattaggtccagggtagtcagtgaccatcctgtttctgagcagcccaagcctgaccctgaggtcccaaggagggccacctaaccctttccctctgcctcccacctgcccccagaccataagggcaccaacccctgcagtgtcaacaacggtgactgctcccagctctgcctgcccacgtcagagacgacccgctcctgcatgtgcacagccggctatagcctccggagtggccagcaggcctgcgagggtcagtgcctggctttcctcccagccttgtcccagctccccaaccctgacccctcctaccctacagccccaccttcctcttcttaccttggggacaagactacattcgtcgtgtaggggacactggactatgaagtggctatgactctccagtgcctccagtaggattttggaaaaatagatgtcagcaggcagatcggggcagctgcatggaagaggcatgctctgagctgggttttctaggacaagtaggatttggatgcattgttcaaaggagagggaactatacacaaggcaaggtgtgtgcaggagccccagccaagagtggtgggcaaagtgtggggaagtcctggagataaggctgtgagctaggcggggctcctgtgttctgagccaggagtgcctggaaagtgatgtttggggaagatcaacctggccgcaatggtggtggggaagaaacagaggcggttaaaccagttaggaggccattaggagtaatcagagtgtgagatgatgggcctgggctgggctcagtaagggttgaagaaaagaaatgaaacccagacgcatttcacaagaacctgctaactgatttatgagcttgctgggggacagcatttcccaaaagtgcattcctaggagcctccctctttgatgtgggtagattttaccaaaagaaactctgagttgaacaaagtttaaaagtgttttgtgctgcagaacttctcagagccttgaatatgtttatgtgtgccaagaatttttcaagcgtttggggttttccaaaactcacttgaccattcatttttttttcactgagtctgagcaaccagggaccatgtggggattcactttgggatgtgctgtatcaaagggataaaggcaagggaggattctgaggtgcatgggtagtggtgcctcaagacatgggaaaactgggccaggcgcagtggctcaagcctgtaatcccagcactttgggaggctgaggccggccgatcacttgaggtcagaagtttgagactagcttggccaacatggcaaaactccgtctctactaaaaccacaaaaattagctgggcgtggtggtgggcacctgtaatcccagctactcagaagacctaggcaggagaatcacttgaaccgggaaggttcaagggttgcagtgggccaatattgtgccactgaactccagcctgggcgacagatcaggactccatctcaattaaaaaaaaaaaaaaaaaagagccaggtgcgtggctcatgcctgtgatcccagcactttgggaggctaaagagggcggattaccttgaggccggggttcaagaccagcctgaccaacacggagaaaccctgtctctactaaaaatacaaaattagccgggcatggtggtgcatgcctgtaatcccagctactcggaaggctgaggcaggagaatcacttgaacctgggacgcggaggttgtggtgagccgagatcgcgtcattgtactgcagcctggggaacaagagtgaaattccgtctcaaaaaaaacaaacaaagaaaaacaaaagaaaagaaaagaaaaagaaatgggataactgggaatgagactggcttcggagtgaccttagggggttgagtttttgatgttggagagagggtgtggcatagaccagacagagggaggacaaagaggaaactaggatcaggctgagcaccaaactggaagtctagattttggagtcacctagtcctgattgtctggtctgaactcccagactttccctaaggaacttgcaggggtgcagggttgggttgtgctgggtggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgatggtggggggggatgatatcaaaggagaagcagagaacagttggagggtgacaggaaccaagtttaagggagtgttggcgatacccatgccttaagtttccttgtctttcaggcgtaggttcctttctcctgtactctgtgcatgagggaatcaggggaattcccctggatcccaatgacaagtcagatgccctggtcccagtgtccgggacctcgctggctgtcggcatcgacttccacgctggtgagccatttggtggcagagggagttgggcgtggcgtaggagctttaggggtggtgtggtgtgccctgagggtccagtgagaggctgcctgaattggcctgaggtggggcacttgctacagctgccaccctgactccacctccccttcaagcacctggcccctccggcactctctcacctctgtcttgagccttgtgagattttgacccctcaccttacccctgccttattgggcatccccatgtcacctcctccacctccagaaaatgacaccatctactgggtggacatgggcctgagcacgatcagccgggccaagcgggaccagacgtggcgtgaagacgtggtgaccaatggcattggccgtgtggagggcattgcagtggactggatcgcaggtgagcagtgggcaggtttgtggggcttggggtgtggcagaggactgggggacgaagtgagaggaggagttggcgggagcaggaagaggagctgtaggggtgcctgggagcttggagacaccaggtccacctgtcctcacctaacctccctgagccccaccaactccctccttaggcaacatctactggacagaccagggctttgatgtcatcgaggtcgcccggctcaatggctccttccgctacgtggtgatctcccagggtctagacaagccccgggccatcaccgtccacccggagaaagggtgaggagctggaaagactggccttgtcattctgcccatggcccatgctgatgaggccctgtctcctccagggtctgaggactgacccccacttccacccccaccctacaggtacttgttctggactgagtggggtcagtatccgcgtattgagcggtctcggctagatggcacggagcgtgtggtgctggtcaacgtcagcatcagctggcccaacggcatctcagtggactaccaggttcgcacgccaacttggccttggatccgatggtagacccctgacccaggctcctgttccctgtgatgagcccattctgggaggacttggagcccaggggaagtcacagggtctcccagcccagccctccacccagagtaggactcctgctaccacagagatgatgggcaggggtcgctcagaagtggggagtgggggagtggagagatgcctggaggtcaccttatcagcagggcagtgggcaggagtgtatgcaggaggcaggagtgagttaggggaggctgaactgagggcctcactctggcccaggcactccctgctgccccagacatggggctggcagcgagctcagccctggaggtgaggtgggtgcctctggcctgtaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggtgagggcttctgtcctggcctcctcagctgatctcttccttccctcctgcctccactgatgccctgcttgtgccctgtccttccctcaggactcatgccaacggctctatcaagcgcgggagcaaagacaatgccacagactccgtgcccctgcgaaccggcatcggcgtccagcttaaagacatcaaagtcttcaaccgggaccggcagaaaggtgaggctggggctctgggctggggtggagaggtgagggggactctggcctgggagagtgctccccagggaacccagtgtgagagggctgggagacaagttagacccatggggcaacttccgatggcccgagagacccagggatggggaggaaaggctgaggtgctctgggacagatcttggcattgggctctgggccctggagggtcattcaagctgggaataccgaggcagagggcagagctttcgccaaagcctggatgacaaaggcaccagtgagcctttcccaaggcaggccctgccctctgtaccctcccctcccccaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaagtgagcccagaccctaagtcttcccaggaagtgggacatggggcggggagcagcacagactcttagaccccagccaggcactctaccctaggtctgaatcccagcagctacaactcagctgaatccaactgcacccccgcagttacatgactcctgatttggagtcagcgtcagcccccgacttcctcccgccactggtcctagttctgccttcagagctgcacagaacaagcgagaggtctctgtggagcccaacgctcacaaacccaggctgcagacatggggctgagctccagtcacttgggctttcaataacttgggtcagtttcctgctcttgccaagcctgagccttctcatctgcgtggatgagtgtctcatctgagacaggattcctcgagctgctgcgcaggaaggcttagctcagtgatgctggggacggagtgtgtgctctggaaagagcagttacagtgtcagggctgtcatcacaggacagcctttcagctctttgaaaactgcatcctgctacattttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacgtagtccagcctgcatgtctgtctaaaaatgtagcacccgaagctaaactcggtactccatgctcgtagcttgatcaggagagactggcacatcaatccccagacccctggaagggatgtcccctcacctccggctgtctgcaggccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacagcccaagcaggatttgatttacagaaatctacattgcactcagctcagcagaactgcagctccaggaaagtgcaaacacaccagaaagcccgattgccctcagtgggagagggttgagaggtgaccacaggtcatttgagtgaggacagcagaggttgggggcactgagtcagaccctggtgcccccgagccctctctgctgcacctcttgcactcccataccccacacttcgccttccagccaggagagcacctgccccaggctgtcccccacggctcctgtgcaggctgccctctgggccctcctgacaaatggctgctcctgtctcttcacagacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaagtgagctgctgcctggggatgggggtagcagggagaggtgggactcggggtggcagaaactccccaggcagatccaagcgggggtgcaggagaggcaggccctcacttgagctccacccttccctgctgtgtgatctggggagaggtgcaaaagcttcctaagcttcaggttcctcttctgtgatacaagctggctaagattccagctgcctgcaccaaagggagcatcaggactgtgggggacgctctgcctttgtgattgattcattcatcagagcaccatgttggaggcacagggtagggcctctagctctgggatccaaagcttcaggcaaagaatgtttgtcgaacccttcgtacagaagcctaaggctgggcctaccaagccacctagctgggttgagaagtcatacttgtgggaagtaatggtaactggcacagggctgtatacgggtgaccacaggtgtcatgaaggcagtagattggcccagagcctggaactggaaaagacaaggaaggccagctcggacaggggaagtgctttgagcaaaagcctgaagaaaggcaaattcaaggcagggaggacagagggggacctctgcatgccatagagcataggcaggcctgagcccagccaggaagtgaggtcagggtgcggaggagttaggagcacaagccaggacaggtggcagaaagcacccgggggtgggtgctccccctggagggttcacccgcagtcagcctgctctgttctcccgcaggggcagccctcatcccggctgtttgggcctctagtgagccaccccctcgccttagggatccaggcccacatgttagcaacatttttttcccaattcagcagtgcttggaatgtttttcaaaagctttactaggaaactagtaaacacaacccaaagcagctgtatagatacgtgagtgtcccgaacccagattccccccaccagtcccccaatgtcagtcacctccaacctggctcaaggaccctctgtttcctcctgcctctgtcatctggcacatctgcagctgatgatgaaggtccagtccccccttccatgaccctcggctgcctcacctgtctggggatggcctcagagcctgtccctcatgagtctggagcttccctggagggtccagcaaggctgcctggccctcgtcccagaggacgtgaccccctggctgcccaccaagctcctttcttatgaggccaggggattccatcacgcattcagcgagtggcttttgagggcaaagaaggtgcagaggacccagtggggagcgcgaggggcgtcatgaagagcttcgtggctgtgtgctgaggactggccccacctggaagtcagggaacgtgtccttgaagaggcggcatgttagccagcgtctgaggatggcaggagtggctgggtgggagcatggtcccagtgcccaggagaaagagctgagctggcaggaggggccctccccctggccacaaggagcaggcactttcggggaatcagaaggagccagtgtggaccccagtggagagggcaggggcaagtggagactccaacaacccagcctcctcctgagccctccccgcgtcagcactggagcactgatggccctgtagagctcacagtaggatagttagaaggtccgccatgttcctggacactgagcacctaccccaggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcgcctgccctagtgggcgctgcatccccatgagctggacgtgtgacaaagaggatgactgtgaacatggcgaggacgagacccactgcagtgagtgaccactgcacccactcagtgctccaagagcctgctgggccccacttcttagtcccccccagcaaatgcccccttggaaaagggcatccagagccttcaaccccctgccccacaccccaactcttgaggtcagactcagagactctgcctctagctgctgctgagcccccccacagaggggtgctgtgggcatctctcctgtccttcccatggcatcagcctccccaggtgggtgacccccacccttccccatctaactgtggcttctgactgccccagacaagttctgctcagaggcccagtttgagtgccagaaccatcgctgcatctccaagcagtggctgtgtgacggcagcgatgactgtggggatggctcagacgaggctgctcactgtggtaaggaagctgggattgggccgggggaggtgccccagggagggacagaccccacccaactccaccccacacacagacacccctgcagacgacggcgaaccatcacctccactgctagacctgatctacccgctcctaagtctctcagtggccctctctccccctacagaaggcaagacgtgcggcccctcctccttctcctgccctggcacccacgtgtgcgtccccgagcgctggctctgtgacggtgacaaagactgtgctgatggtgcagacgagagcatcgcagctggttgctgtgagtggcggggccacgtggagcgggtggacagcaaatggccacagtctcactttgcagatggggaagccggggtgcaggagaggaaatgcctcagcggggtccactgggggcggagccatagctgtagcccaggtgtccagactcctcatccagtgccctgcccactctaccaggagaaccacaggaggttagagtgagggacggtcggccgctggccaggcagggctgaagggctgtgtccacctctgtccacagtgtacaacagcacttgtgacgaccgtgagttcatgtgccagaaccgccagtgcatccccaagcacttcgtgtgtgaccacgaccgtgactgtgcagatggctctgatgagtcccccgagtgtggtgagccttcggcggtggtgggaaggaggccctgccctctgccgggccagggcatcagcctcacaggtccattcctcccccagagtacccgacctgcggccccagtgagttccgctgtgccaatgggcgctgtctgagctcccgccagtgggagtgtgatggcgagaatgactgccacgaccagagtgacgaggctcccaagaacccacactgcaccagcccaggtgggccccagacctggctcccctctgccccctccccagactgcctgagaccccgctgacctgccgcctccgcccctctgcagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaaggtatgcccagccctggggaggagcttccacaccccagacgtgccaggaacgcctttctccactgccttattcattcattcatcccctagacagtggggatacagcagtgaatgagacagaaatctgcttggttggggtctgcctctatctggcaggtagagagccagcagatttgctgacagatgagatatgcagtgtgagaggaagagaggagtgaggcatcaagtaggcaagagatacacaggtctggagttcaaggagaggcccaggctggagagggaagtctgggagttatcaccatagagatgctatttgaatctgtgagcctggatatgattcccaagggagcagtgtaggtggagaagagaggagtccaaagtctgagccccgagctgagcaacagccaggagcagggaagtgaggggaccagcagaagagcctgagaaggagcagctgctgaggcaggagaacagccacgagaagaaagcatttccatggggagggcacacgcagctctgtcaaatgacactcgggggcacacagaaggaggcctgcactgtgggccagctgggtgggctcagtacccatatgctgctgcccctagtgaggccgggtagagggaattggagtctctgagccaggtctccagggtgggaggcccagaccctgccacacgcccagcccaaggctccctgtgcctgcagtgccgctgtcgccctggcttccggctgaaggacgacggccggacgtgtgctgatgtggacgagtgcagcaccaccttcccctgcagccagcgctgcatcaacacccatggcagctataagtgtctgtgtgtggagggctatgcaccccgcggcggcgacccccacagctgcaaggctgtgactggtgagatgcgcgcttggagggcatgaggtgacccaggctgtgtgggactgcccgggtggcagagctccagacaggcaggagaccagggccgctagaatgtgccaggagctgaggcaagatcctctgtctgcagacgaggaaccgtttctgatcttcgccaaccggtactacctgcgcaagctcaacctggacgggtccaactacacgttacttaagcaggtaccaaacccaggccctcctccccgctgcccatctcccagacccagcacagcctcccttgcaagtctccccgcttaggtccaaccatccctcccccagatgcaaatgtggcccctgttgccacaaccgacttctgctgtccttcactccccaaatccagggcctgaacaacgccgttgccttggattttgactaccgagagcagatgatctactggacagatgtgaccacccagggcagcatgatccgaaggatgcaccttaacgggagcaatgtgcaggtgaggcgggcggccctcggcgaccaacactggcccgcctcagatgactgttttcagatcgtctctccttcccgccccaccaacccaaattgcttccttctcactccactagtcactatatgactgcttgttctagctgctcactctcctctgggcccagacagcaaggactgggagattcctcttgcccttcccctcgctgccagcctcatgtctccttaatcatcaggaagttccctgtgaggtctggccaagcactgtgaggcttggggcgtggtcccattcacctagagccccctctcctagagcctctgctgacacctacacagtgtcaggcccaggactgggcattttacttccatggttctcccaccagagctgtcagagggagctctaccccattttacacgaggggaggctgagcctcacagaggcttgcaggtcctcccccaggtcacccagagctctccctcccctgccccttcctgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtatgtggctgaggagggttgggggagcccctgaaagcagcatccaagcccagcctccctgcaggccactggtgcgatgggttacgggatctcccagggctcactgcctacccatcgccaggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttggtcagtgtgccagtgaggctgtccaggcacagcagactcagtggggatggaggtctgaagcgacaggggatcaagttttgggggcaagagtggacataaaaagtggaggatatggcctgaggacaccactcactggggtgtggggttcagagcaccccgggggcttccccagcctggccaccacccagctcccttgggaaggaagaggagaggcccttcccttgtatacacagttctggaggactggccccaaggagggtggggnnnnnnnnnnnnnnnnnnnnggcaggaacttgccatgaggcagtctaggtttgaactccagctctgacacttgttagctgtgagaccatggggggtctgtaccatgaaccatctgtaactggggctgacacccacctctcagggtggtggtagggcttgaggaggtggagtgggccggcaccctgtccgagctccggctgactggcactgtgcctgccccttggccctgcagtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccacgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaagaaaaagaaaacaaaagggcagtgcgaggggcaaaggttgagagtggggcagggggcagttttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccacccggagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgaatgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccgagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagccgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaggccaaaaaaaaaaaaagaaagaaaaaaagccgctggtgtctgcctgtgtgtgagagacgctgggagctggggctgcgctttcctgcttcggccaccagagggagacctgccccgtgctggaggcaggctggcgcgtggtttttagtgcccttctcccagggccctccccctctccatcttactgtgcccgggaagcgggtggcactggacttgacatggaagatctgcttctcctggctgtgtgaccttcagccatgacttcgagtctccagattttgtgttccctctgggtctaggacactaactcagatctgtttctctgcattcacttctaccagacaccacccccctacccaaaatgatcacccacagtgagaagccccactataagaagtgaatacactgaggctgcaaaggttttctcatccttcagggtcctcccatgcggttctctctgcctgagtctgctcttgaagcactgacgtctcactttgtggagactaatgaatcaaatgcgaagtaaaatgctgcattccagagccaggtgtctcctgcggtaaaggagagctgggaagaccagtttgccaggccctctaggcccccagcagctccagctcaccaatcatttcagtcattccagggggtaacaggaaaaaactgtcaatcaaaagtgtccaggtccatttcaacccctgcctagagggggaaacttcttgcagaaagttgcacagtttacactgcccaggactagagagggtttgagtcccagtacagcaaatatgagctcaggaagggtggctgcaaatgtctgaagatcccttacccaactcccaaccaggaagtgctgcctttcattcctcctccctcactggttcaactccaggagattcctcccaggcttccttctgccttggggaagctacaagtctaggcacctgtggaaagaggagccctccccttcccttcttagccttcagaagctctctccaacctcatcctccaagccaactctgagatcctcccctgccttcaaaagggccctggatgggcaactgcggggaaacagaatccgtggttgccgagtaggaggtctgtgtcccaatctggccaccaggtggtgtctgtacgcctggagcaccgcctatcctgaagccccacacagcccccgcctcagcactcattatgcacctgcgggggaccccagcccagtctctcgcttccttctctccggctattttgccacacccctccaccctctgccagccagctcccctccctgccccagcgcctgcctgctcccaccaccaccagccccaaccctgcccctctgccatcggtgcatctggtgccccccgggagccactgatctctgcctgtcacctcaagatcctgggcagagcgacaagggacccccgctgcagcttggaaggcatacccctccagtcagcatcccccactccgcctgtcaggacctgctaggagaaggtccaccaggaggcagtttctcaaactacccacccgggaggcaggtgggaagccctcaccttggcctgagagatgggaagaaccagggacagaggctgagaaccagggacagaagctgataccgaatgagaggcagaaacccagaggcggagagacagggggacagaggcaaagacccagagacagggcgagtagtgtgcatgtgtgtgtttgcacttgtgtttgtgcgagcgcgcacacatgtgtgtgtgtaactggagagagaacaggtggcctgagactgtagctaaaggaggagagatgcagtgggttcggcccccagaagaccaggaccctggtaatgggcttctgtcctggacagcctacgcctaggtgtgcccactgttcccacctactactgaagcagcccccgtgcctggaacgtgggctcagggttctggctcaaggccttttggccttgagcctgaacatttctgccccttcctgcctctctcctctccacccccaccccggcacccaggttcctgcctcctggcttctgcctgtctccctgggtgtctctgaatctgcctcgtcctctcagcaccggtccttttcctgactcgtgtgtgtggctgtcacgtcccatatctatctgtccatttctttgtatgtgcccccacttgtcttctgggctgccagtgacagcatacacctgtgtatgtctcagtgtgtgtgtccacctctgtgggtgtttgctctctgccaagacaaagagagggtgagcgcactgagcaactgtctgggtgtgctcgtctgggtgcaggtgtgctcacctctgttgctgtgctcctctgtgtgttggggtgccgctaggtgtgcgcctgtctctgtatttcgctctgtgtgccctgtccccgtgaaggcatctgcgtgcatccctggggtgggctctcaagggatgtgtctgtctctcagtctctttgcttgtccctatctctgtctaggtgttggtcataccacaacctcagccacagcctcagtgcatagcaacagctgacagctgaaaccacccgggcaggagagagagaggcagtggggaggagggaaccgaggaagaaacagagaagaggatgggggcagagagctggggctggggacagagacaaggacagagatagggaatggggacaaggatctagaagagctggtggtgaaagatgggacggcgggaggggaggaacagagactgcaccaagaggccaggcaggcggcgctgagagggatttcctgcccagcccccatgcagaggcgcactgggcctcgtgggggtcagtggtgggggccaggggcaaaggtgaacagccggtctagccgaggggtcctgagaccgcagaggtgcggtgaggcggggacggggcggcgggcgccgtttgtcagccctattgacagacgtgatggggtttccgtccgtgatcaatgattctcatctccgggccgaatgagccgcggggcgcccatccatccccgtcagcatcgcgcggcggcagccgcccgaggccccgcccgtccccacctcggcccctgccctgcgcctgccccgacacaccttggccctgaacagggcagaggcccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggctacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggagggcagtcgttcccgcggggaccgcgctggctccaggaagcagggaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgctctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctttccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcaggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattgacacacacacccagccaatccaggcacatacacacagtcaccgatttacacaacagacatgcagccacgacaagcagccacacacacaca

SEQ ID NO: 671 - DNA, 13836 bp, Homo sapiens
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgtcgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaatgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagcccagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggacgacggccggacgtgtgctgatgtggacgagtgcagcaccaccttcccctgcagccagcgctgcatcaacacccatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacaggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaaaaaaaaaaaaaaaaaaggccaaaaaaaaaaa

SEQ ID NO: 672 - protein, 4183 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSPEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 673 - DNA, 115284 bp, Mus musculus
  misc_feature (1)...(115284): n = A,T,C or G
aagaaagcaccccaaaaagtgagtggttgggccagctgagcctctgtagcctgggtcctgtgccctaacagggaggcctggcctgcccagttctactgtttgcaagtgtggctccaacctgctgctgaaccttttgtagcctgacacaagtgaagctcctagtgacttgggcacagtcctcttcctggttctcatgttttctgcacagctcagataaaatgtataaaaaagcatttgccctgctcttctagatgcaaatgggcagagcaggtgcctatttagagccacacccccaccatggcttggagcagatgctcatgggtactcccctctgctgggctcaggcttccacgccgcaaagagaagtgtcttggagatatatcggctcctcgcagctggccaccacgctgaaggtgttctgtcagtgaaagctcttacccacactgtacttgtcagcgaacactgccactaagcctcagtgctgtgccatggccggctgagtactcatttaggatggacaggaattgtctctgatgtggataggactcctctggccaaggagtacctctgactctgcctgtaggggaggtttgtggaccccactcattgggaccagtgactttccatggggtgtttcaatacagagaggcccctgactttagttggctcagcccagtacccaagaagtacttagaactatatggccactttagctaaaattgtaagctggtaccctccaaacccatacaactcagagagccagagctgtcagactacagcacatttattttctggtctcacaacagagtgcttgtttgtttgtttctttctttttaacctgagacagaggtttttttctcatgtagcctaggctgtcctggaactcactatgtagaccaggctggcctcaaactcagtgatctgcctgcctctgcctgggatcaaaggtgtgcaccagcactacccggcatgtttgtttattttagagacagggtgttgctcttttccaggttggcctggaactctctcttagaccggccttaaacctgagatcttcttgcctctgcctctggagtgctgagaatacaggcgtgagccaccgtgcctggggcttattttatgatagtctattaagactgttattacttctggatgttctgaaatgactgtttccaaaatgaactgaagactctgcccactgttttccagctgcccctgaagggcaaaatcagccctggagaagttattctctctctctctctctctctctctctccttcagatagcagtttttaattttgttctgtttgagacactagctcactgtgcagccctggctgaccttgacctctatcttctctgcctcccaagtgctgggactgcaggcagactatcacacatctagcttcatggaggatcactcgatagtgtaggtggaacaggttttgctttgggctcatatgtgaagaagcatggccgggtgtccccaggaaagcccaagccagtgcctgaagtaagccccagctggccatgtgctgcacggacagcagctcccctgagtcaccagctgtcgggaggtgacatgacttgccaccttcacggggcactgtgatgagcaccgacacagcctcctcatgtgggtggcaagcgtgtgcttctcattaagaaaattgctactttagaacaggctctgaaaagaacttttttgccttttactaaaattaagaaaataataataaaacaacccacccaacaccctaaacttaaaaagaagaagacgtcaacccaggggaaaaaaaaaaactctctatggggtccagaacggagttagaacttggcagggacacggacagagagcaaagaaattcccactgggcaaggctagcgttcccatcctccactggctgcagctgtgagcccgagccatgttggaaagtgacagaaacggttgtcagcatagacaactgaactgatttgctctgagaatatcccagccagcccctgcagtcattctgcttgccggccacacgaaacctcatttggagcccttgacgactgaagaggccctcagctgggacttgactgtcatgatcactgagctcacttgcatcgggggtggggggtgcaagtcgccttcctggggaccccgctcccaagctgcaggtgactgaggctgcccatgggcataagccacggagaaataaatgggagatggcctctcttgttctccatggtagagagagtgatgggctgccatttcagtctctgtggtccagcctccagcacggtgttcgtggaagggccatgtgtttgacaaatacttaacacatccagtagccagatggtccaaacaacccatcagtggtgtggtatgtaaatatttcccatcattaccacaatgctgccgtgttgacactagcgaggatgaagaataactatgaggggctcctgacagccgccaggcaggtcacaggcagggccgcaaagtcacccctgtcacctggaaggcctcaggcaagcgtcggctctggctattccttcccagatactgaggaggcacctatctccaagaggcaccatattctcctcagctcttcatcaacacaaggcctgcttctcctgagccactgctttccggtgtgcccgagctctgtgggccagcttggtttcctctctgcttggtttaccaagaagcacacagctaagtgtgcagattaccctcagctaggcatcttggtgcacatgttccttcccttgttggctgtcgtctcatggagtgaacatagggctgtaagtgttttggaaccagggagtagtgaagatcacgaacaaaggtcctactatgtgcttttaatatgattaccaagtgtccagttagatatcagcagtcaactttctagtctcatgaagagggagggaggaggagagagagcgacagctcactgtgtagcatagactggcctcaaactcaccatcctcttacttcagcctctcacatgctagcagcattccaggcatttgtctccctgtctcgctcacttgtcactccagatcgagttggatctggtttccacgaagtgaatcaggaacccgtggtcctttcccatgaaaggtctcaccaggggtcggcttgggctctggatcatgcatccacacttccttctgttagaattgtagccctgacaggggtgggagtgagtgaggtcacattcaagttcacatgagggaacggaggcacagacagagctgaccgacacagagtctcagccccacgctaaggatcacccactgtacacaggaagtcccaccagggtcacacttcaaccatgttcaagtccccgctctggacagtgcaacacatgatggcactggagctgctgagtggatggcccggctgctccactcggtcactggagagctctgagcttcggtgcagctgttggacctcagcacccagcccgctgggatgccgagtgagcatggaaagtcagtctcttcccaagcctcactaaggcacggactcctctcagtgactcatgtgttctgatcgggacaaaaggtccgccctagtctcctgttaggaacagagctttctgcaaacccctcagctacaccatgccggttgtctgttgctacctaactgtggcccaaatttctcatgtgctagccttccgtgtttgctcctgaggtggcaatctgggcagggttgtcaactgcaacacctctgttctctagtgtcagctgtaacagcttgacttgagcgggaagccccacttgcaagtggcagagtgaccagtgttaactcctggtggcaccagcggggactcctgcatgcctccgcttcccatgtctggggcaggcttctcccagttcagtgaccttcagggaactggtttccctagtgtctgttgctacccccagagcacaaagtcagccacatccaggccacagctgcctcttctgctccctccttctttcttatttttcccattgtgataatgtatataaaacatgcaactgagccctgggctgttctaaagtgtgcgccccagtggtagtaaagtatattcttattgctgggcacccattcctccagggaacagtctcatgggaaactaaaactcaggcaacacatctgtctccctgcctcccgacttccttccttccagccttgcgacaccccccccaaattctcctgtctgtctctaccagtctgactgaattacacgctacctcatgtaatggatgctctttatcctcccgtggccagcttaattcacttggcagaatattttcaggatgtatctgaattcctgttttaaaaggaatcctttttgcaacgcatgtgctctgtgttgattttactcatctggacctctgtcctcgaacagcttctagcagtgggacagaatgctgccgtgaatttaggtggacacacacctgtttgcacacctgccttcagtttttcgttaggcttctcgaggtggaggttcaaacctggcccagcgttgcttcctgccaaccccgttggttacaacaggtcaaagggccatttaaaagaagagggacagcacaaggtcctggcttcttgaaggccatccaagtagtagtctgccatgatcaccctggggaaggtctttgtagacctgttcaagagctggcactgctggctgacggatgtccctgaagcacacaggtttcctgagtaggcgctctgagagagggtcctggcagctcatctcaggccgggcccagtgcttcccctggagaccgccgcagtctcccactggcactgttctgtgttcctgcaggctgtgcctctcattacataatctgttattctgtgctccaccgggccctggttacttgtcagaagtttctaaaagccagctgaatcagctccaggcagctgggggtgctgcctctccctcatagtattagtcactctgtacttagctaaatttaactttttatcatccaaatgatatttttgtgggcttgggattttacataatgctaccaactgctgcaggctaagaatttctctttttttgctatgtgttcctctgtgtgtgtgtgtgtgtgtgtgtactgggtttttcccccatgaacttttgcactctcaaggaaacattgctgggtcccttttccatggctctgctctcccggcttccaggatcagggttcagctctgcattcaccatctaccagttgagagcagaagagttcctcatggctttcctatggccccactcgtgtttctgcctgcacttgagggctctccactctgaaggtcttgagagtccccactgcctgcagcacactgggcctggggaagagcagcatggtgggagagtgggtacagaagactcacttggctgtgagatgctcagccaacctgcccagacatggggttccagaggcaggcgcttcctggtctcaggtaggggtagaggtgacaccaccgtgtcaggccaggaactagccctcaaaggagaactgtggcatggtgctgcccgcctttcatcccagcactcaggaggtagaagcaggatgatctcggtgaattaatggctagcttcatctacacaatgagttccaagctagccaaggttacatactgagaccctgtcccaagggggttaagagtaggtgtacaactgggatggtatgtgtggaactgggcatacagttagggaaccgggtggaatgctcagccccccctgctcagaagtggctgtgtgtcgggccctcacatcagggtctggtgtgtgtgtatgtgtgtgtgtgtgtgtgtgtgtgtgtgtgtatgtccgtgtgtatatgagggggtgaaggtagcaacagtatgtgcccagcaaggtgctaagtggttgttctcacagactcattcttgaagatgcttcaagtctatactagtggctattctctcagataagaaaactaagtcccagagagtcccatctgtctacagcctctccaagagtttggcctaagctaagctaagtgcatccccgagtagaggactcatgtgggactcatactttgccctgtgtagtgtacttactatccctggtctgatttgctcgcctagttctccccaggcactgtcatcacggtgaagcaaggtggaggaaagagattctgcaggggcaagagaagagctcacctcatccagtatccaatttatttgttgcgttttaatagctttcaaaatggaggtgtattcattcctcggtgtaaattaagttaccgacattggcctggggacatagtctatggtgagcatatgcctatatcgtgtgtgaggccctaggtttagtgcccagtgaagcaacaaatgagcaaattttatattttctttaagattaagaaagatcagaaacatgtccgtataaaaatttgtccacgagtgttcacagcagcggttccttaatctccagtgccgtccagatgtcaaacggcagatgcacagagaagggaagcacgtgctctccattcagcaggacgttgttcagttataagacagagtgaagtcagctgggaatatggctcagaggcagagggcttgcctggcattggtgaggctttgggctcagtcacaggcactgcaaaaaattacatcaaaaattttaagtcattaaaaaaatggtgtactgccaccatgccacggtctctgagaacacaaccctagaagaagaagccagacgagagagggccgcatactgtatgactccactgatgcaaactgtctaaaacaggcaaatcggcacagacagaaggcaaattagtggtcccgaggggctgggagtgggtagagtgaatgagcggtgactctcatgggtactgggtttctttaaagagggacccgagcgttgcagattaagatagcatgatggccctgccaccttgtgaatagattaatgagcactgatgataatggccggatgctttcagagggcgagctttgtgccatggtaaggtatatgcaaattctgaaaaattaagtgacgctgcttcgcattccaaggccctggaaaggtttgctttagagccacctgccgtgtgtgccatcctctctacccattctgcagccacctgcctcagtctccatgtcaacaggggtggagacagaagcactggcttcagtctcactacccactcttagctgcttacagccggggccagcctgaggcacgcggacgtctgggcaagggagctacttggcaccccatcaacccggtattctttaagtgtttgtgtgacatttattgagtggggctgaggggagactgatattctattaatggaaaccgtatagagaaacagatttgcttaccagttccttccactgaaacagcaccagggttcagaaaacttttgagggaagcaattctgactcttgccaccttcagtctctcaggcaggcttggtttccgattgctgtcttctctccccggcagttctctgcatcgtcgaagggcattctagagattttactttaaaacttaaggtagcaaagtgtcttcttcttgttcctaggagtagctgctcacacgctgtatctgagtgttgactggggctcctggggtcattggctacacatatgtgggacaggcatgcaacagatttcagcaagggggtgctccacttcacgctgtggatgttccgggtcttgggagggaacttggattgaccagtgacatatttttgtttcattctaacagagctctgaacaccctgagttctgttccacaagtgattgtctgtgaggcctgctggttaacctggtgcttcatgcatctcagatctccagtgggttcgggcaaacagcacccctctttgctcccctcccccccagagtgtttctttcccctagtctctgctgggtgagtcaccattgtccttttcacccatggggagtcaggtagagtagagggacttgcctgacaaaacgggctcaccaccgacgctcagcacaccccccgatttcccttcccgtgaatgtggggaccttgcatgatgacctcatagctgttgagaagagtggcggtggaagctaagagtcaggatggtatagttcgttggagcttgctgagctgtggcatcaggtacatatacatcgaaccgggcagcctgagtatctgcccttgctggactctggggaatctggagtgttctgctgcctcaggggtcaggaaggtatgaggatgtgtgaattaacacaggggtcagaggcagaactgccaaggaggctgtgtttctgaaggccagcccccaaaagttgctcgttccctcaccacggtgttccctaaggtgtaggaggggcagtgtgggcggtgtgtgaaaagcgccgttccctccagccacacctcccactgctgtgcatcactggttctctgcacgtccccattccctctttctctcctctgactcttgctggctgtgctgcccactggcagttgatcactttgtcatcctggtcctccattaaacatcccttgggttttacacttacctctgtcaagactgcttgccctcacacccacaactggtgtcttactggtcctggtgcctggcctcagcctttgaagtaagactgtcctgaacttggccactagttcctggactatttcagtgtctgtaacctgctggggaactgcagggcacgtcattggaagggttcctagatagctgcctgtttccagtacataggtgcaggtacagggaacaggctcctaaatgtgtttggcagggaaagactagtgttgagctgcgatgtggaccagggcatgttgcagttcttgtggcagccctgggttggacagcagcttctttggtatttgtgggtgactgtgactccgtgaaaacatatttctctaacttccttatttattgatctttttaactatttgtttgtttggttgggttttttggtttagtttggtttggtttggtttggttttttttcgagacagggtttctctgtgtagcctggtctacagagtgaccagggatgggtatgcctgcccaggtagaaacactacccaggaatgagactgacaacctcacccagctgcctgcttatatacaaccatgacttggctcccagcctaaccgtttcactcaggaccctgttaggattagaggacatcaggccatagtgtgggggtggggtggggacaactggaaaactagggaaagcaggactctgtagaccaggctggccttgaactcagaaatcctcttgcctctgcctcccaagtgctgggattaaaggcgtgtgccgctgccaccaccacccggccctggttggtttttcaagacaaggtttctctgtgtagccttggctgtcctggaacttgttctgtagaccaggctggcctcgaactcacagagatcagccgatctctaccttgagaatgctgggcttaaaggcgtgcaccaccatcccctggcctaatcctctatcattcctatcttgttttgtgagctcaggtctgtcctgtgggtacttggcagaagtcggcatctgttcctactatgtctaggtgaagggagtttaggctcagtgcaaggctggaggccacctgcatccaaccaattgtccagccaatggacactatggcctgatgtcctctaatcctaacagggtcctgagtgaaatggttaggctgggagccaagagtcatggttgtgtataagcaggcagctgggtgaggttgtcagtctcactcctgggtagtgtttctacctgggcaggcatacccatccctggttctgagataggcgctccctccctgaacgtctccatcaggctttgtaaaacagatacctccctccctgtcatccatacccttcgccccccttgctccacgaaggctttgggtctgatatggctcaggccgaggctgactccgccagagctccccattggttggcacagagggacaaggaactcaggtggctcatctcctctacctttgggtttttttcctgcaggatgctggcacatgtgtcttggtccctgactcccttctgtggacacactgatcattcctcctcctgtggtggagacgtcgagggagctgctcagatctacaggtaaagaccaagtgctgtgcagtgcccaccttcctgcccagcctttaaagtctgtgggctgttgagcctttgacgtttctttctccccttaaagacctttctgatcgctgtggtaaacagcgacccagagattaagtgaaatactgtcgttgattgggaaggaattctgtctctggaaacagccactgtccccccaccccacgcagagcataccaaggagggtctttgctgtttgttctcaaggttttatctgggctccctgctccagatgacacacatgggacaaagtcggcaggagttctattgaaggtaccctcttcctgggctctgggaccccagtgaccttctggcctctgtggagaaccaagactgggtgtggtgcttgctcaccctgttgcccacaagctgcgccagtcacccagaaactggtgtccctgtgttttctcaggctctggccctctgaacccgctctgtgtcttggccattttgtttcatggacagcgtctcctctgacctcctgcttgacgtgagagcctctggtggcccgtccaggtggtgaaccgacttggccttcctccccgacttcccacggactctgctttctaaacccccgtcagaaggcttgagctgtgggattgcagatgctgcacactccttctagggaagaaagccatgaggggaggaaggcttactggccccagcctccttgtgaccattggacctccatcttacttgagggagctgaaggctcaggtgttagattcagtcgcgtcactggccagcagcaagcaggcttgacatctgtcccaacttgtgacctggagcacacagtccagcttttcagatgtgatgcctgggcctttgggtccagccttgacttgctcccggttccctccctctgggccccttcctcactgggaaactcccagggcccagggctgcggggctgcctctggcttctgctcgcaggctggcacccggggctgttcttttctctaattgctcattttcttcacttgccaagaagaggcctccaagtgctaaggagagtgcagtgcgttacgtttttttttgtttttctgttttgtttttccttcactttctaaggtgtctctgcacaggaggagctatgggaacagtgacatcagagcacgcagcccccgctcatggcttctgtggtcagggctgagtcccacacttgccatgtgctagtagagttggcctccggcgtgaggcagagtccctcagagaaccctgccccacagggcctaaatgttcatgtcatctcttggtgctcagagagaccctgcctctgctttggcttggggcctctacttcctgtttcctttctcacaggaaggggctctttcctgcttagcagctgccatgcgtgagtttgcacaggtgacagcctcacagcccatctcgcccggggtcctcagtgattttccccgcatcactcccgtactctgcaagcgtgtatcaagtactcggtgtacattaggtgtattgtgcgtgttgtgccagcctgtaaacgcagaaggcaggggtgggggtgggggggagttactattgcaggtgccagggacgcagctgtgaacagagcagacagagcccccgtgcgagcagtttgcctcctggtgcattctgtgctgtacccatgtcctgaagtctcctctacacactctgtttgccaacttcctgtctaccttcccttcccagcccatttcaagtacttccatgtaagcccccaccccatactagcccacccttccttttcttactgtcccagcatactgctgtacctctaataatattagtgtcaccataagctctgaagcatttgtgtgtctgtgtgccgtcaggctgagggcactttaacgggtgagcctttgtacctctcctgccccctcagcctgtcctgcaaacccagatctggagaaaagcaggcctgaatgggacaatcacgtttgctcatagtgagcctctgagctgtcctgggagtttgtagtcactgatgggcacaggactctgagcagagagcaagtctctgggtagagggcagccttatcagcggtgatgtgaacaggaatgcccaccctgtcctctgccaggccgaggaaggaaaagacccaacaaacagtttatttttagagaagtttcttgctccaaaggaactccaagcgctttccttccagaagggtggtgggctggagggccgggcagaacaactggcttgtttctcagcagcctggtatcttctgcatcttcctagactagagactgcgttacagagagtctgtcccaaagagggtcccagctggggagtccatttgccctgtgcaagttgaacatgcttcattctgagtgaccgggtagagaacacttagtctcggtgaccttgaggctagaatgcagcaagaagggtctcccggaataggccttcttggcttctttccgacatcctggtgtaggctcaggctgggtggggtgcttcctgccattgtccccgtgacaggcctcagcaaggtcactgtctgctgcagaggaagagggcctggggagggccttggagcacagcagtaacaggtatagactccagaccttgctctggacctgagctgaagccaggacctaggctgttataacctgagtggctgagcctctggggccacagcttctcatctctctttgtgagcaacatgaaaaagttggccagtttcttcccttgggtctaggccacaccacagcccagaacaggcaaggacaaagcagaaaggctcactggcacactggcacagagtaaaggcaccaggccggggctcccgagggtcaggagcttgtcctcagctctctgctctcctcagtgctggtgggagaactggctgagatttgatgtctcagccatgctggggccagctctgcatttgtgcctgctggctggttctgtctgtattcctgcggtgtgatggccgcttggactcacatccagaagtatacccaccggacacggactttggccacaaaccctccaaggacttgctttctctgaccacaggcctctcctccctggtatgcactccccaaggacagcccttttcattctcttggggtcctgtctgcttaggcaaagcactgctttctgcagatgcagatgcgctatatgtccaacaaggtggcacggtctgcctggtgtttcctttctctctgctgctcatggtcaccagtaaaagcttgctctgtggtagccagctttctgttaccgtgacagatacctgaaataatcaacttagggtgagagaaggtttgggttgactgatgattttagaagctccagtccatgactggttggtacttgtcttagtcagggtttctattcctgcacaaacatcatgaccaagaagcaagttggggaggaaagggtttaatcagcttacacttccatactgctattcatcaccaaaggaagtcaggactggaactcaagcaggtcagaaagcaggagctgatgcagaggccatggagggatgttctttactggcttgctcagcctgctctcttatagaaccaagactaccagcccagagatgatcccacccacaaggggcctttcccccttgatcactaattgagaaaatgccttacagttggatctcatggaggcatttcctcaactgaagctcctttctctgtgataactccagctgtgtcaagttgacacaaaattagccagtacagtactgatgcttttaggtgtatgctagtccacactttgtggtgctccatgtagcaaaccagaactcttccctcaaagccaggaatgacagacaagagaagagaaagggggtggagtcctttcttcccctctgaaggcaagtccccagtgttctaggccccacctcttaaaaatgtgtacgacctctgaatagtagtccaatagcacagttgttcaggaagttgaacaagctggaaagtgaggcctgggactacagcttactggtagagtgctcatagcacgtgtgaggctctgtcagaggtgggcttcgggagggcctgagggactgaggctatgtggaactgactgggtagagagagcaagcaaagggaaggacatcagggaaggcagaggtcagagaataagaagggcttaggttataagaagggagtaggttggggctggagagatggctcagtggttaagagcaccaactgctctcccgaaggtcctgagttcaaatcccagcaaccacatggtggctcacaaccatctgtaatgagatctgataccctcttctggtacatctgaagacagaagaagaagggtgtaggttggtgttaagaccctgaccttcactttgagtggtatgaggccatgaaagcattccaacgttgagggccgggatcagcctgtggctacactgttggaattttgctggagctgtggtgggaagaagcagggggaacatggggacagctgcagtaatgggagggctgggtgcttggacttaggggtggatgttggactctaggtctgtgaggacctggggctggagggactctgagactttaatcctcatttaaatgaaggttcttgtagacttcctgatctgacttttactgtaacctgtagggaaactaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccgatctccccagtgtgcagccagagctcatgcctgccatggtggtccgattcaatctgtgatagatagcatctgttgtaacaaaggcacacagaaggccagccgtgtcattgagagcagatatcacttacaacaggaagacctgctgtgctcttgacgtcatcacttgtcaggaggcttctgtgtctccttggcctttctttggaacgggctacggttggtcacaatggtttgggcactcgagactctgattgacaggctttgcagtggataggcctgaaccatcttcgaagagtaggacctggtgccttcttcagagctccgccagagggctacctggagaaggcagagtaagatcttgtttcttttctcttgaggaagtatgagaaatgtatgagcctgtgggccagagtggaagcacgtatccagtgtgattctcttttgtgctgtataactcggcctgtcccattcctaatacacagaccattgaagagtggcgacatggaaattgctgccgctgactgccagagactgtccctggcacctatcctttgctctggtgaacaacctggcagtcacgggacacggctaagaacatggttccacaggcaggacaacagggccaggtaccaggtcgtgctgaggcctggccggtctccaggcacctgtgtgcaacaagcttctggaacgtcacttgttggcggcttcccggggacagaggtgagggctacaaagcaaccaaagacaagctttctgccctgaaaatatagctaagaggctgagcatagtggctcagggctataattgcactcaggaggctgaactaagagaatttcaagttcgatgccaacctggaccactctggctccaaacaaagtaaaatgaactccagcaaacaaacccaaagacgagtgcccagtccagaggactgcagggctgtgaagacacaccctccaactccctccccatcctccctcgtgctgcagcccctgcacagactcttccctgctggcctgcagtatctgatatgctttgctccgggctgttttgccatttctgttgggactctcagataaaaactgctgctccagaaccccctgggagtgtctcagacgcccaaggctgggtgctgtttcccacactgtgatagcttcaggagttactcttctcatggcttctgtttccctgagaaaagagaactgccgacttactcctggactgaggtgtggcctccgtaggccagtcatcagaccagcatgaattaaatgtgtccggtgctggagccactggacaggcaagaagaagcagggctgtgttgtgagggagaaggaggagaacctccttagtctgggtctctgctccttgctctgtggcacttgttattcagggagctgatgcccctgggagatgggtctcagtcactccctgatacatcaatgtggaggagttcattaaagtacaagtcagggaatgtactggtggcatctcagcaggggaccgtctgcatcaccaatcaaacggggctggtctgtcagatgtccccctcaaggcacatctgatgtcacaggtgttcttttaaaagcttttgttttttttttttttgttttttttttttaattagctcacaaagtaatagcttttgatttgggattttgatagtgttccgttttggctgattcttccctctccgcagcttgccttcagctcagctcctcacccttctttctcatctgtacctttctttttttttttttttttttttttggaaagaaggccctgagtaagccacactttatttttttttttaaagatttatttatttatttattatatgtaaatacattggagctgtcttcaaactctccaaaagagggggtcagatcttgttacggatggttgtgagccaccatgtggttgctgggatttgaactctggaccttcggatgagcagtcgggtgctctaacccactgagccatctcaccagacccatctgtacctttcaaaacgtccctcctcacccctgactccctgctctcctttgctgctggggagagaggggagacaggttcagtttttgaactgcttggaaggagagtttagacatgaaaaagatggcggcagaggaagaccgagaacactctcctggagcccagcagcgttaggaggcctttagcaagcacacttctaagaactttcctttgtacaatgtgctggctgattttggctctgtggcaaactgcctgaaacaccttgggcaggtcccctcagctctctgtgcctcactctccccatctgtgagatggggcagtatcagggtttacagtaagtccttgtggagattgaacaggcaaaacatctgtagagtcctgggaccaaacagaacccgtcagctgctgcgatcagtccagactctgcctgccagtgctgtctacagagctggcctttggggagataccttttccaggtctcattatgtagacctggcctggagttctctatatagatcaggctggccttgaactcactgagatcttcctaactcttcctctcacatcctgggttaaagacataccatctccatgcctggcccataaatattttttaaaggaaaggggaggggggagggcacaggggcagagagaaagcaaaagcaaaaagcctggtgagttatagcactgtaggtatggctgccagcctacaagcctgaaggcgggtctcttccctcgctgctggctctgttgacaaatctcagcagagcagcagctctggcaaagcagattgggagagcacccagctctgccttagtcctgggcatcaccctagtttgctgctgccattgtgtaaggccagctctaggtaagcatgaggggtggcatccgttcacgctctcatctggccgggcattgggagcccagtgaggtagaagaatgtgccctctggggtggaggaggcagatgcagattagagcttatgattcacggctgaagaggccaatagcgcaaccgagcaggaagaagacagctattagggtgctaaggggggcaaggctcttaggcagggaacagtccatctgggttttgaagagtgcagatgagtcttactgggggagaaggggaaaagcagacagaaccgcacaagccagtgtctttagtactcctgtgttcttgtgttcggagtttcaggaagggccaggttgctgaagtgtatggctagagggtggcaggtcagaggctggacatgcagcataggtgtcaggagtagagactttgactccgtgggattcaaggaattcactgtccttgtaactgtctctctggttctttagtgtttgctaccagcaggaaggagcctcacttcttcatttacatgtttctgaccttcctctgcctctgctgtgatggggcctgtggatgccctggccctggccccgccccgcccctccccgcccacatctttagctcctggttatggttcttaccacccctgacactcctcttggcctattccaggcctctccagcacccagaacccagtttctcagagggtgccgtgcaccagcctcctttccccatggaagaacagcattcggtatggaaccgcagagtaccggatgcttgcctggaagagcccggagtacagtgctgttaggttctgacccatgtctgcctttccattttttttgtatggagatgttaggcctccaaaatgctgagccttacccaccatgctattggcggtagtgtaggggcttgtccccaaactgaaagctgagtcccctggacactgtaggaggggcttggttggacactgaggttcaagaagaggatccggggtcctcagtgctctggctaacagctgtccatgcgtcttctttccacttgaggttggaaggcactgggtacgcaggaagccggacccagtttcctcctgcaagctcataccaagttcagtctgagggtcaaacaggagggctgctccccagggtagaggtggcctgctttcagtgagcccagcctgccaccataggcctctccttttctaggctggatggtctgctccgattagcacactgacgtcaaaaaagcgtgtcaccttcggcctcccctcagcctggcagctgtgatatatcagtctggacgtgtcccctgcctcaccacagagggccaaggccagcaggggaagagggattatgttgttcccatctgtctgcccagccctatccagctgtttcccattccctactgccaagtggcagatgttggggtgaggtcggcctgggagctagggacctgcccatcagcttcacgtgaatgtcttcaaggctatttctggccttgccattatcccaacggcttcaagtgataaatatagacacagattgaaaagccccagtggcaagcaggcaggcaggcagcattgggggagcatgtggatgggggctcggctataaataagtctgctggaacacctccccagccatgccaccgctgctgccgggccagtgtgtttgagtgtgttctctcaaagagacccagtccctcccaactccccgcctgagcacacttgttcctctagggcgaaggaggggtggaaggaggttctgcttagggaagggaagggaaagtgagctgtatgttgggagctgtaatagcaggtaaactactgacgttttcttcagctctgagtgaccacagtagaaagaaaatggcgagtgacctaataagtgggtcctagggacagccacatgatatggggagtagattatgctaagaatggtggcccctgttcctgttcctgcagctttcactcctctggtgcaacagctgggaagaggattgtccagccttgggcagtgctcctgctggaggctatcgtggacctcgtttggtgtcttttttttttttttttttctgttttagccctgcccagacctctttgtggaacaattttatttgcccccattcccaagtccccactgccagcaccattgcccaggccagcacaccaggtgatcccagtttgggctgagctcccacaggcaggaattccagatattcctgacctgcagttatgcccttcaccccaccccttcctcaagaccgtttccgaaaggcatcctgtgtttcctctccttgtgccttcccttgtctttctcctcctctgcctcctctcagccagaagcaattatctggggctgctggatgagaagcactctgtgctcaagagatgcttcaaggcaaggatcttgggggctcatcatcaggaaagtactatggccatgtcgtcaccaatcatgggaagtggcgccctgcgaaccacctctgtggcctcactgatcaagggctgagcattagagcgtacaagctaggcctggcaagaagtggcaagtattaatcttgtgtagtaaatgatgccttgggtgttacagatcgcaggtgaagagtaggctgtcataaatgagagtagctttgagggcgagaaccgtgttccccttcctcgtgtattttctgtgctgtaggccttccggggacaaaggagagcacagcaccatagcatgggacctgctactcagttctgagcgtgcactctgagctctcagggctactgccaggatgaaccagccctggcttttgttttcaggtttgtctcttgtttttaaggtaatcttgagccacaggaggggacaaagttatgtacttttgtgatatccatgacaaccacactctgtgggagctggggcttttggggctgacatccgaactgggccatagagaaggctgtgtttgctgcacacaggtgtggggttggggatgtaggggaaggcattccaggtggagggaacggcttgtgcagagccggcgaggctgagggagacactgcggcccatgtctgtttggacagcctggactctgtttgtggctcctggtcaggactgtcaggggaggctccgtgtgcatggtgaagtcatcttgggctctaggagaaggttgaggggctttagcctgaggcgtgctaggtgctgtcatgtgtttccgaagtttcatttgactttgtgtgtgtgtgacaggttagaggcagaggattgggggcagactggtgacattacaatgtctttgctgagtacctgggagactcctctcctctcctctcctctcctctcctctcctctcctctcctctcctctcctctcctctcctctcctcttctctcctctcctctcctctcccctcctctcttcttttctttccatgggtcctatagaactgggatgtatgcacgtgtccgcatgcccaagggacagtcgtttctaaagatggcagtgctgggccgccatgagctaaggctcgctggggcttgtgacaagcacagagccatcagatccaatttgcttagctgtcctcttcaggggtgactttgtccagcaagcttggcccagggcagtagccaggcctgcagtagagataactgatcccccagggactggcttgggcctcccttcacaagctcctaggttccaaagttgcacaggctgcttctagctcagtcttccaatccctgcctgccaactgtgtcctctcacccctgtggtgatgcagagcccagaccctcagcctccaaagaaaagtgaatgaaggaagcatgctagtgaggaatggataaacacatcttttcagggaccacagagtcctgagtgaagaccagaccacagtctcatgatgtaaatattatcttattgtggttttgccagggtggactgataaatagggtgatgaaaagaaaccaggattggtcatcgtcagagactggggacggaggcggtgtttgtgaggagctgatagtcctgtgcagagcctccagccagcccttcggtgccaggcctctttctcagatggtgaaattcaccccaggaggagatggggaggcgcacacaccaggtacccacagagaacccaggccatcctggaacctgtggctattctcccctgagtagggaggtgggaagctcacgaaattgctggagtatggaggaaccccagaggctttctagaaccctctctgtctcgctccattcccttcctaactgtactggctagttttgtgtcaacttgacacaagctggagttatcacagagaaaggagcttcagttgaggaaatgcctccatgagatccaactgtaaggcattttctcaactaatgatcaagggggaaaggccccttgtggatgggaccatctctgggctggcagtcttgggttctgtaagagagcaggctgagcaagccaggggaagcaagccagtaaggaacatccctccatggcctctgcatcagctcctgcttcctgacctgcttgagttccagtcctgacttcctttgatgatcaacagcaatgtggaagtgtaagctgaataaaccctttcctccccaactgcttcttggtcctgatgtttgtgcaggaatagaaaccctgactaagacactaaacaatggtcgctcagtccatgctacagtttgctatacagtctggcttcctcatcaagctggctctttccgcctgtacctctgccaggctagactgttgtctgcatttgccttgtgtgtctaggaaaacagatcaatgtttggtggagttcctgagtttcagaatctgagagaaggcccggtctgtggtcttgagcaatctggctctgtccctcttaagcttccacttgtgctgtaaatcgggactctaaaatgtcacccacctggtgtgtgtgccattttagatgaaatgagacctccaaggcaggtcagtcaatacagctggactcactggccattcggctgcccctttaagaagatatggtgacaaagaggacaaaactgaggctcaggaaggctgtgaccggtgagaacagactagttggtgccttcctaggtctccctctctttccctgggttatggtagagcagctaagaagaatgggaagaatccagccagatgactttgagcaggccactccaggctcagtttctaggtctgcatgggtggctgagcacactgacccagccagcttctgacttcagtccttccctgggcactgagggccggtctgatcctagtactggaaggctgggaagactgcagcaccttctgcttccttttcctgtgcttcctttggcctgatccccactggacctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggactaggctttgacagagctctgtctggtcaatgcaaatggagggcagtgatttatggtgcttcgagagagaattcttccaattatcagcttccccaatttcttcctttatggccagagttgaaggcagatgtttggataatgtccccagagtccttagctggctttcctgggccagagaagatgatcgagacctcagtgtcattcagtgtgagacttcacccagatcatttcacagacccctgttccagccctaggtgggtgcttctggtgtgtgtgtgtgtgtgtgtgtgtgtgtgtgtgtgtatgtgtgtgtgtgccagatttcaagtggtgggggaaagcacaggccttggcaggctgcccttcagatgtacctaaggatgtgaggctccagactgaagccagtcctggtcgcctcccctgggaagcctcctctgagctttgtgagcatctggatggattctcaggggtccagatcccctggaccacgctagctctgtccctcccagactaagctcctcctccgagctcaggtcatcttctttaagtctgtggtcagcccggcatgatcagcttcaaatgagacaagtgcttctgataagcattgcctagttccactggccaggctggctgttccactacagaaaactgaggagcccaggatgtggtagacatggctccatagccccatgctctctgtaccaggccagcccacagtagtctctcactgaaatagctggagaagagggccttgtctccaagttgaggggctggtcctaggaaagcaggtaagaatgcctctggccagaatatttacacagcatcagcccagcctaggcctgctggctctgtgtcatctcatactctgttctaagcccctctggccctgcctccccagcctctgagactcctgggtgtcctgtgctgatagtaagtggggcaggacatagctgagcctgacaggtactggcaactgcactaggcatgcctctactcaggtggctgtttgtcactgctgttaacttcacagggataagaggcaccctctttccgtcagcccttttcatgggcaatccagctgtatgcaaggtaggagtaattaaatacacggtggggtggggggtgtcacacctatagacaacattctgtccaatggacttcacccagatcatttcacagacccctgttccagccctaggtgggtgcttctggtgtgtgtgtgtgtgtgtgtgtgtgtgtgtgtgtgtatgtgtgtgtgtgtgtgtgtgtgtgtgtgttgcttctctgagggcaagaggagagaagggatgtgggaatgtatctctaaccagagtcaccgctgcagctgccctgaactcatagaaggaatagtttgttattccctgcacttaaaaataagcattctaagtcaaatatttatttaaaataaatatttaaaaaccttgagatacagtcacataccatacactctacccatttaaagtacccgtcaaggcattgtttaaagtgttctgaattttgtgtagctgtcaccacagtcaacctaaaaacacttacagcacttcacaaacacacccatctctctccagacgctcctccccaggcaatcacaatccatttctgtcttcactggcttgcccagcccagatgttgcattgagatagacgtctatagtatctcttactctggcatctgtcactgaacgcgatgttttcaagtttacccaggtagcatggatcagtacaccattctgttttctcatggctcagttatgttctgttgtatgaacagaccccatttggtaaccagtgtgtttttcaaggatgactctatcttagtacagtactgagttggtggggtagggtgagggtgaaggatggggggaagggcactggtggggaatgtaaacagaagcagcttcccagaggccctcgggatcaagttagaggctgagcctagccgctggatgatgtcctttcctaagtagctggtgggacactgagaggcttgcaagggtggggtctcctgggtctcccggagcttctcttctctttccagactctgggaaattccacagagtgagaacagggctcatccaaggcagacaaggcaggaggtgggagccctcgagcctcttcagtgtcttctttgaggagtctctgctttgaggagcagatctgaggcctggaggagccttgcaggcagatccggaaactggaccaagattagaaccggtgtgattgataagagcctagggattagaggaaggacagctaactatttctttaatcttgctccgattgtcttttcaaacggcgatttctaaccttgtttactctgtgtagcactgttttctggagattggagtccttttattcaaaggaagagccccttgctgctaattcttaggtccaaaggtcccacaggggtctcagatagaagccccgagcttcaaggagtgacctatccgtatcaccatccacacaagctgaatgctggtaagagggctacctcactctagggatccctcagcctccaaaggaaagcagaacaaggaaatcagagaagcgcctcaagaatagctctcgctggcaggtgcctcgcaggagccagccttgttactgcagcagtgagtcccccttgcagtccatccacctacaagatgacctcacaggttgacaagggttgtggagcagcccagagggtggttcctgtgggctggggtggggacaatcgtgctgtgctttccctgtgagtccgcacggcccacctgagagctgtaatgtgtcttcacagctctcagcaaggccagtcccagtgcttgctttgctttgcatgcgcgcggcatgtcagggtccctgtgtcaggagctagaacggattccttgggtcagtgctctctctgcctgccgcttccgtcttgttgacctcagctgactctcaccacacagtgggagaggtcttcgaatcctgaaccgtggagctgtggacggagaagttagatttagaactctggttgcttctctcttctcctgagtggtgtaagaacgaagtaggggacatggatcagccttgtctgcattttcctgcaagaccaggaggctctggcagctggcagggtcaatgcatttgtcacctgggttctgtacctctgagcagctgtaaattgcacaccccatgaggtggcacctgctgctgcaggtcactcaggcacttcaagcaggtggcctcctaatgaagtgactgcaggacagggaccctgctgtgaagccaggcacctctgcaggggtgagtggtcagatagagagaggaggtactcctgactgttcctgcgaaggccacctgcggctgggcagccaggtcatggcagcaagggaatgcctgtgagtgatccaagcccttggcgcttctctcagccgcctgtctactgtgtgcttatggccttgtcaccgcctaggtcactactaagtctgtctgcccacactccaagggaggtgggcaggggccagcaggagtcttgacaattatagaggatggaggcaaatcaagacacttagaactgttgttgggcttgtttttgttttatttgtttttttttaaattacatatgtgtgtgtttgtacatgtgtatgggggcaatgtgtagtccacggcacatgtgtggagtgtgttgagtcacactcgggtcttcaggcttagtgacaaacacctttgttgttccttgaggaacagtcctgtaacatggcggtgttgctgtctgggctctggctccctttggaggctaagttgcccagaggattgtcactgggaactagccagaaaaagaccagacactggctggcctttaatggtctgtggaactcagggcagataccttctcttagcttcgtgtccgtgtctgtaaaacagagataaaatatccaccttcaagggcagcctgcaagatgaaaggagacaggttagatcaaaggtcggagcacagtgtggccatgcaggtggcctccagggtcctgcctcctgcctccatggacacacccatatattgtcctctcccacaccgaggagctagtagggtgttgcaagtgacacggtgtcacttttaagtcaaaattataaaagacagtgtggcttccaccgttctttctcttggatcgattattccaggaagctgctgtcttatgagggttttaggaaggtctccagaaaattctaaaattatagtgagatacggaggtagacttttggccatcagcctacacctgatggcagtcacatgagcgaggtcttcaaaagtggcttttctagccccagccaagcttttagatgattgcagcccctgccttggctgacttgttgattgcgacaggctgagtgacccagagcagagccaccagccgggctactctaggtttctttctttctctctttctctctttctctctttctctctttctctctttctctctttctctctttctctcttcctctcttcctctcttcctctctctcttcctctctttctctctttctccctttctctctctccctccctccctccctccctctctctctctttctttcttttaaatatttatttattttatgtgtgtgagtacactgtagctgtacagatggttgttagccttcatatgattgttggtaattgaatttttaggacccctgctcgctccagttggccccgctcgctccagtcaactctactcgcttagtccctgctcactccggcccaaagatttattattatacataagtacactgtagctgacttcagacacactagaagagggcgtcagattccattacagatggttgtgagtcaccatgtgattgctgggatttgaactcaggacctttggtagagcagtcagtgctgttacccactgagccatcttgccagccccactctagttttcttaatcagcagaaacagtgtgaggtagtgaatggttattgactgaaccattatttgtgtgtgtgtgtgtgtgtgtgtgtgtgtgtgtgtgtgtgcacgcgcgctcacccacgcacgtgctgttttacacagccgtaggtacgtgtccaggactgcagacctcccagctccctttctcctgaccagaggatctgtttatgctgcagaacggttttatctgctgacttcagaggtgcctctcagcagctctgatatgaacctgcaggtctccatgtccacagcaggggtcccattaggatccatgctgtgctgtatccatggcctggacggtctcagctattccccagcctcatggacctggcagtggttgatctgagtctgagtgctgatgaggagatggagggcacagcccagccctagagccgtgacgacgggtttctcagccttgtttgatgaacggctgtagttgggggtgaagcagggctgtctgggcccttgtgggtgtggaagggagagtctgcactcttccacccttcgttcttctccctcagctcagtttctaggctgctggagatgccagccttgcttccttgtttcttactatgttgtccagaccccaccacctcacactgaacttcacagagagtacgtagacagatgtgtcctttcaggtgcccctcagcctcactggagaggaagcgtgacttcttttgctcaccttcttcttgcctgagaaagaaggagcccgagaaagcttccccgaggccctgccacctgagctcattgtacatgtttaaggatggctgcaaacaggcatcacagaccattgcttgtgcatccgcagcgccagctcttaacagtcggctgccttgagcctttgagtgttttcaggcatcaaagataccaggatgagggaaatgcaattcctggcttgcttttttagccagaaatagacctatagacaccgtccaacagtggctgacgtttgtgggatactcactttgcaattcagtgaccaggccgatggagaatgttgggcgatggagatgaacagagaagacacagaggccagatggaaaaagatatttctagagtaggcaccattgtcacagaagtgacactgcatatggttccctgggagaccccaagttcttactgctgtgcttcatgcctgtcctcctttgaggtttgcttgaaaggcatcttgttcatgaggtgtgcccgttcttattctcctcctaatagagcatcctcccccgccctcccccaaggttttcagaggtttgttagaaacacctgtaaaccttcatgggcttggtgcttttctgagggtggcagcccgggaagtgtttgtttaccatttatattatttcacatttgcttatttaagctctgtgtctcttctttcacccagaagcacttgtcactcccacttttaccctacttccggctgccgcctcctaaagccaccagccaactttttagatgccactcctgtgtccggtgtattttgggcactggcaattgatcaggaagccacatgaaatccctaactaaagtacactctctgattcttgtggtggtttcaatgagaaagggccccataggcttatatatttgaatatttggtccctagttggtagaaatattttgggaaggattgggtgccctttgggtttttaaaagcccgagctagctccacgatggtcccacgatggaaatatgcttagcaagtttgagaaactgcgactgggacaggaaaggccatgagaaggagagagagaagccatctaggggggctccggtcatgccgaggactttggacttgattctaagtgtgaagggactcctgggaggctcccgatgcagtgacattattccctgtgcatctagagcttaacctgctccccaccggcccctcatggaagcaagagttagtgggacccactttagaagttctgtttgagccgggcagtggtggcacacgcctttaataccagcacttgggaggcagaggcaggtggatttctgagttcaaggccagcttggtctacaaagtgagttccaggacagccaggactgcacagagaaaccctgtcttgaaaaaccaaaaaaaaaaaagaagttctgtttgtggtagcctgggagtcaccagccgggactttctaggtatttctagagatttgcttggaaggcaaactagcactaccccaccaagttggaagcccgttcccctcccctcctgctgtgcacatagaatcttccacctgtgtgaaaaaccctccacatccctgggtctcagatcttggaaaatctaagccaggagtgtggagaccttccttcagcaccctgtcctgactctgagggagttaactattattctacagtaacttaagcagctagcctaaggggatgtagtatacagttcttagtcctgacactggctaggactaagatgccccaggcctgtcctaccgtcctgtggagttctcaggaccagtactgagagtttagtttccctcaggctttctttcaaaggttcatgcagtccccatgtcagaggtgtggaagcacttggggtcaccctctgccagctccaggcttctctgtgcctccttccctgcttgtctctcttgatacatggaacagcatgacccagcttgggcctggagaagtggagcagagtttgaatgcgaagttaatgaatgcaggtcgaatcaccggctcctagctatgtgacctgggggcaaattactaaccttttccaggatttggtttccccatatgcaaaatgtggaaccaaggctcgagtctgttcatccgcatggtgtgagccttagcagtgtgtcccagggtggccctgcctctggccagccttggttgattagtgttacagccttgagccttctgggatggttgccctgatcctcttaagaagagcattcctgcctgatggggagattacggtcctaatccgtttgtccttaccatttatgacctgaccagggccctgccatatgctaaacactatttgtgcgtcatttgtatagtcaaaaaacggagagctatgtactataaactctccacagtgtagaagaaaacctgaggctagagggacgagtgaacttgccaaggccttctagctggttaatgatagtgccagcccctggcagtcctctgtgaatggcctccctccagccaggaacagccacaggactgggtgcttgtcacggacagtctaggctctgggtctcctgcccttgccatgatatcccctccctggcccccagtgaccttccctgcctctctctgactatagatggtcagagagggattctctgtaaaaacacaaataaacaaaagaagcaaattatgtaacatctggggcagtgacttccagagaggacatggccagtgcaaaggccccctagttcctcagagaaggtattgcctgggtcttcacagcccctgctgccctctggcatcagagaaacaggcaatcttgtttccaacatactggccaacacaaggagccagcccctggaagggaagggtactgcaccagtcaccatggagtggctggccgtgctttcgtgttcccaaatggcatttgagatgtagctttctgttgtcttgtgtttttacaagacgtttttacacacaatgtaaactttcctatgctagccatttgcaagcacgcgcgtcagtcgcgtggactgcatccatgctgtgtggcattactctgcctgctttctcttcccgacagacactctacccattagtgagcgccgtgccctcccatcctgtgctgtctgtggatgtgcctctgctggacgggtcacataagtggcccataggacctgtggtcctcagaatctggcttctcccacgaggcagcgtgttctctgggcccgtccatgctgttggggtagacatttctaaacaagcagtgtttgtgctgtgtcacagagtactgcaggagggagattaaaaaaagtgaggtcctgccacctgtaccacgagaggtgtcggaaactcacacgaccctgcttgggttcctcagctggggcttctagacaggaacacctggaaacccgacagactctgttccacactcctcaccccgcagcttgctccatgctgcatagggtcccggggtgtgcgcttaagagcatctcatctccgccttgcttcccatctgtgagatagaatcttctgtggtctgactgagccgagggccagccctgtgtgccaggttggaagggggtggggtgggaaaggctgatggtgagtcttacactgtgatcgtcttatttattaaaaattaattgaggggctttgatgcatccggacttgagaggagctgacaggtcatgtggtctctgaaagcacagggctggtaatccattttaaaaaacattttcttctccttctttttaatttaatggaggaaatcattagctgggagaatggaggcactgatttatttctgttttggggaggggggcaggagagaagatcgcctcttaattgccgctgttctagaaatacgccagccagacattcccatcggctgggactgccgggttcttggggggattgcatcatgctttcttttcttcagcccccgggggtgtcaaggggccctcagggtgcaggtgggtggccctgatgtcagcagcagatcttcacaataggagcaaagctgcttctgtgcacaggtccttcaagtgagcctgagaggggttcagtgtgtaatgctgggggatgggggggcagttccctagatagcccatgtctaagacttcgttcccagggaaacaggagcaggaccccccatctgggaaaaaggactacgtgccttctctggggcttcatccggttccaaggggaggcaactgggttcaccctaaaaataaccaaagatgcaaacagccagagagtgcaaatgtttttcgtatctgtgggcccaagcatttaaaggtacagctgtccttccaccaccacaatatgtctttcctagagcagagagtaactttggggtaacccgggctttataggatccccatcttctagccccacaagttgaggtctgcctgggctgctgtgttaattgcttctctctagaggcaccacacacctggcagaggatatcacaggccccgaggcccatcacaagacggggtgcaggcagagccagccaactatagccataccatgaaacctcctggatacaaaggtgaggttctcctgacttcgatttaccaagtccgtccagctagggaaaaaaaaaatgggtaaagtagttctcagagagaggatggctataaatagctaggcaggatgtggaaaaggtgagaggcgaattgctgccaaggttgtaggcccagatgcagagcagggctgaaggtctagccctcagcctacccaggctgttgtcctggctttcgaaggctctgctccttagatgaaatgtgtgttccaggcacttcctggcatcccactctcttctctgccacaccctgaggctgcctgaggctcctaggcccctttatattacaactgggacccttgcatggtggtacaagactttaatcccaacactcaggaggcagagacaggagttctaggccagccagggctatagagtgagactctgttgaagaaacaaactaataaactatgattaagaacttttggttctctagtcaattctccctgatgtgcctcatctgagggggcatcctgaaggggctaaccctataggagaagccattgtgaagtttaggggagagtcctgccacactgaatatggccacatcttcgggtggaggccttgggctccagggcaagaagctttgtcattgggaggaccaggagctgaggtctgcctataaatcagggcctgacacagacatgtgaattgaggtacttgctctgcagcttctccatctatctacctgtcattcattcagccatccagtcatccatctttccccattcacctatctgtccattcattcacccatctgtctgcgtactcactcattattcatccatttaaagcatttgttcagtgcctgttgtatgcccagtattctcccaggcgtaccctgggacacagcagtgaatacaaccaccctagaagtctccatctagtacgtgagatagacagttgttgtttttttaattttatttggtggcttttggttttcgagacagggtttcttctgtgtgggcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggttggggagttgggtgtttaatgagtgcagttctggtttgggaagtgaaaaggttgtagagatagtggggaggactgtatagccacgttaatatccttaaggctactgaaccaagcacttaacaagctatcagggtagcaaattaacatttaccaccatttggaaagcaaaagcatcaaaggacagtagaccgtatattaggtaaggttgacgccatggaaacaatgagggggtcaagggaaagcccaggcaggactcagagttaactaagtggctgagaaggcctgagtaatatgtgctcaggcagaggctagcaggagcaggttgtgcaggcgcaaacgcctgcgggaagagttgggccccagtctggacagtgtgagtaagaggcagggaggccactggagattcgagctgtgggaggcaagatgtcccttcaggtttgtggtgggtcccctgggccttctgctgcaggagcatgggaagctgggaggcaaggaagggttttgcaggaaaagaacagacctgtccccagcagcacctgccagctcaggacagagcaacggggaccatgtttacagtcgccccttgggtctgaggcatcgtttctaccagagtgttccatccccttctgtggaaggcagagtgctgcatatgcccagcgaatgtccttctggacacctcagctctctagactatttgtggcgctgaacactctagtcgtgtgaggatcattcacactgcgccattcccacaaagaactgtcccacagtaccactcaggggaattaacagcaagaaaaaagttctgcacttgctcagtacagatgcgatcctttttccctcaatattttccattttcagnnnnnnnnnnnnnnnnnnnnnnnnnnnnnnnnnnnnnnnnnnnnnnnnnnnnnnnnnnnnnnnnnngcaggttcatgtgaccggggacaggagagcaatggtgtactctgtctctcatctctgctgttgtaactttgagacaaatagctctttgcctagccagcactggaggtcccaggagaatgagcttgtaccaccaacccccgcccccaccccaggatggccatgggcctgggaccagccttgctggatgagcccgggaaaagcactgcaccctctgagtgagtccttatacacctcctgagggagagggtggtttcagagtgtggtctgggtcactgtgaagccacccatgcattgggagtctggagggcagctgggggtgcagggggtagtctccccgagcacctgacgctcagcctagcctgggaccaaggttgtgtaaccacacagggttctgctgactcatggagatggtaggaaagttccaatcccacagcccctgtccaggcattctgggatgacatcaggagttgctgggggagacaggggaagggagtggttctagaacagggcagagaggaggctccaggcctgaggttcagagactcttgtcattatggagtctaaggagccgactcccccgctgctatctgtttggttccctgagagccccaccacataccctctgtccttctagataggccttggctcaggctgcagccagaagcctccccacacccgagacagctcaggtaagtggagagaggaaagggagaagcagaggttggggagctaaactgttcgttttctctaccttcagagccgttctgtccctggtgatccccacagctccgtgtaagcctttcatttcagttgtcaacaaaaagcaaagcaacattttctatcagcactagccacagtttgaatgtcagtggccacctaggcccatggggtgacaacagccgcgcctggctggcagaacatacagggtgggtatcctcatggatcgttcacttgggcagcattggccttgcctctgaagcaaccccatgagacagggacctgacagcttgtggctaaaggggaatactcaccattcgtacagccagcaatgccagtggccctagaactcagctttatctgtcaacgaaggtatggaggagggtgcctgtaaatcctcctgcccagctggcagcttccccaggacagaagagactgaggccacttggagccttttgcctttgtccccaggccagacataggtgagccttgctgattggaaagatgagtggataaatatttaatttggggtaacttgcagcttggtgactgaatgccccggacacttccttaggtcttggggagaggaatgaggggggaacccaaatgtagaaatacctcatgtgtccatcctgtggtgagtagatatgtgtagtgagtctatctaatcaataggatattattctgccatgaaggaaggaagcaacctacatagggtacaaccttgtatgaactttgagaaagaacatgatgataaatgaaagaagccagttccaaaaggttgcatgcactccgaaatcccattcatatgaaaccctcaaagcaagcgtgtctgtgggcagtagactagtggtgatcaggggctagagcgaagcgtaacaaaacggctctcccatgtgtctcctttcagggtaatgcagatgtttgctactggatgcaggtggcagttgtaccacactgtggatagacttcatgttaccaaactgtatgctctcagttgataaaaacagtatattctttgttctattttttttttaacaatagaaaagtgagaggaaacagaaatctggttagtaaatctatacgttccttataacatttttctgatttattcatatactgggatattttcataacattgttggaatggggcaggaagaggaaatgttttcttgactgcaggcttcagaggcaaggtggggcatggtacactcagatgttccctcaagagcaacaggcctgggggcactgctgtgggctccagctttgccagccaagtgcacaaggggaggcagggcattggatgctgccccagtgcttccaactggatctggaaggacacaacgtccacagctcagccttccctacatctgccagcatcatgatgccccagagcgcagctcggtagagaaaatggtcctgtctcagtttgtaccaaggaaatgaaagcacagagatgtgaccagactggcaatggccctgtgatctccggagagagaaaagagactccagccaggctcctgtcctcccctagcctctgcagccagaggctgtgatgtgaggctgggggcagagcagagccagccctgtagcaaggtttgcacagcagccacagcgaggttggtagtgtgcaggtgggagatacagctcaatgtgggtctggtccagggtgcccatgatccggtctcatctttaaccagcaggtgcccagcagcctcccaccttggcttcctgccttggtggctctgggctacagaagccttcctgtgggtgggcatcccctccttcctgagggtgggaaagtatgactcagggtttggtggctgagttttagaaacaggaggcaaggaccgaaaggcgatgcttctaaaacgcctagggaaggggaccgcctgcctgttcctgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctctgttgtccctgcgtggtggctcctcacacagccaggggaccgtgtgctggcacttccaggcatgagccgcctatagcgctgctgcgggctgggggcggctctctgagacctgcacgtgggaagccagcagagtctgcaggatggggttgctgagcagggctccagccagcacctgctgcgtgaggctccagctctggtactttggtgccccgctccccttacctcatgttggcttcctgaaaggtaattttctacttcttcttgaacacgttcttaggctaggtttattagcgaggaaggctccatctggtcaagggtctgtttgctttctctccaaaaagctgggatggagggagagctggaaggagaggcctggactggcctgctcaggcactgcctgtctgggcagaattggagtgcacagcttctctcctgagtagctcccagggtggaggacattgcgccgccgtacttccaattttgcctgtgattgctagagcacacacagtctgctttcctagagtgtggtggccccaaggaaagaaggcaatttagagacgctcacgtgccccccagcgggcagagctctggctacaggctgcctggcttgctggctgactaatctttgatcctctggaaatgggcactccgtgtgggaatgtttcgtccctccaccaagatttcaagagggtgctatcaggagacccgtcctcgtcccccagcttatttcaggtggatggccctgctggcatgtcctgtgcccatcttcagacaccccatattggcattggatcctaagactactgtctggtgggtgagcactctccatctctctccaccctggcaatggcatttggagggggagttggtgatgttgacccctccacatcccagcccaggaggcaggcagcacacccctccccatcgcccctccttcctgtgcagctggcagtggaaaaaaagaatcctccgttgtcaacaagaacatctcctgtgttgatggaaagtgagggccgaagatgccgtatttagcacccatttcttagaagatacaggcttgaatggtgtctgtgtgtaagccctgtctgatctttaaatagaaaaacgcacaccaagtagccctgtctgactcacgggagcatcaaagtttggtgtggtcgtagggaatccatatccaactctgaaagaggtgcacagctcagggggctgactgcagcggtgtggtcctgagctgtcagtgcagaggctgagtaactctcccaagtacctaacctagaatatagtagaactcagggtctcgtcgccgcgtcaggtcatggccacctgattgtgctctatttttgtgtctgcattctccttgacagattgctctaataatggcatcagaacctcgacagcagctcaaggcctgtgtagctctgtgcttgcctgtatctccttcgtgactcctttctttgaaactgtgtgagagctacgacagactctgtgtttctagtgcttccctcctgatcggcactgagccccagtgagcagggcaaggaggctgtgtccccagcagcagagcttccaggctctgcacttgctaagaccctcccggcatctggcgctgtgcaggcttctcagtggcattcattacccacgtctgggtttgttggctggctgtgaattctgatgatgccggagaggcagtgtgccggttttgttttgtttgcctgagaatggaaaatatgatgtgacacgtaaaggcaggccctcaagtacagctctgttctcatctctgctctcagcttgggtggggggctggtctagtgttgccactgccgcagccgctggctgctgtcgcagcaagtgtccctttgtcctggagtctttcatgttcccccaggaccagccaagcccccatgctgatcattcagttggcaaacccagaaaggacagccagagctgagcccaagaagatgtaggctccacctcccactgcttgtattccaggtagaccccgagtgccgccctccagccctgcctcctcctacccaagtccttgcttagtggatgctcctgagtgtaattgtgactgcaagatcgcacatggtgctgacttacttgaaagcatcttggggagctgcagagggtgtgagagcagcttggagaggtgggaaccctggctgccgatggcttcagccagtgaaagtgtagaaggctcattccaggaaaagtggaataatcaccatattggctggctttcaggcggtgagtgcttctttcttctttaatttgacaggagcgccgggattcagggaagggatggcgggaagcaggggagcctgtggttcacacagacttcatgaggccctggtgctgtaagggaaaaattcgatgtttttctcccgtgctacgttgagcgtggacaggcaggacaggcagctctaccccgattcagggattctggggctcaggatagcatctatctgggaggttggacatttgtccccacctagggcaccagtgcagagcttttaaacagtctcttggtgtatgaacggagtgaccttaattgtacaggaagaaggaagctcatgagttaaaaactcccatgctcttgtgattttcttggacacatacatgcatatacattcacccttgttcatcctcttcctatgtgtgcacacacatactcatgcatgtgcacagccacatgtaagtaagcttgagccagacacaaacacatgtgccccttctgctagcagaagcccatatatctgttgacattctgctcatgtgcgcgtgatcttactaactgttgccagcactggcagcatcatacacttgtgcctttcctcatttcttttcagctcactgtctaagctgaggaaggcaaactgcccttgtctactcttagaaagagaatccaccctctcccttcccctgcccctctctccttatccttccggcagtgtctggggcatcagagaaattggcatgcttttctgtcagagagcatgcagatgctccttcattgaagggctccagccttaagggaagggattgtcagagaaacattgatgagcttaagatgtagtgagatgcaannnnnnnnnnnnnnnnnnnngctcttaccagcttagctcacatctgtattttcagtagttatccatttttctgcctcagttttcctgccttgttgggacaaaaacccttcactagtttctgggttttttgttttttttttttcttttttctttttttttcttttttggtttttcgagacagggtttctctgtgtagccctggatgtcctggaactcactctgtagaccaggctggcctcgaactcagaaattcacctgcctctgcctcccaagtgctggtattaaaggtgtgcgccactacgcccgcccggctccctcactagtttcaaattgcagggctgacagaagaaagccagcccaaaggccctgtccttgtccctgttctgccatcagcccgctcatgagcctgtttgctggtttgcacaatagggttagtgacagcaccgtcccaagctgtagaggacagaaggcagagcatctctgcagcacgggcgctttcttccatgtcagtgcccttggaaagtacttcacagctttctaggcgcccgcacaccacctatggctgtgagcaggctttgtcatgactgcttaggcagggaggagggattagttaattttaaaaccttcttgctaccttgtttcatttgcttagggtgtgggatgccctgctggtctctgaagtcccatctcctgttggggctgtgcctggctcctgggatgggtgtggggcagggactgcgctgcctggggacaggaacttcttcagacactaggaagtgcaaagtgtgtcagctgcatagacccaggtttgaaccctagctgtgtgattcctgctgaatgcctttgtacctttgcttcctagtgtgcagagcagggcaggagttcccatcatttcctcctgttgtgtgtaactccatctctctcaactcttttctccatcatgagaggggcacaggcacaggcgatgactttgatgacagggtctcccttcaaatgtccactctgcatcaaagtttgtcctggtattgaggccaggacagtccctctgacctgtacctcaccagtacagactacagtctattccattgaccaggctagacccttggagtaaggggtagcattggcactcaccaactctcaggtctttctgactgctccttataaaaatatcttttgtttgtttggttggttggttttggttttttcgagacagggtttctctgtgtagccctggctgtcctggaactcactctgtaaaccaggatggccttgaactcagaaattcacctgcctctgcctcccaagtgctggtattaaaggcgtgtgccaccactgcctggctataaaaatatcttttattcttctgagactgattgctgaatacactcaccctttctagttctttctgagctctggctgactggttcacctcagctgttatggctcaaaacccctctccaagctgactgattcaatctgcctgctttcagattttcattcaattctgctgcttggcctcaaactaactctagcaatctgttctaatcttctgactccttctcattctctggctcgttctgtcctcacctgtatctagcttgttctccctctctctgcagtctctctctttacaactgtccagataaaactgtgtcttctctctcctgcactgcccctcaagtagcttccctatccctctcttcttctgagagttgggcgtatcctattctgtcaaatccttctctgatttgtcagtttgtctgccactcaactagacatacctttcaaacatggttgctccctctacaaactaactttacctttattgttcgagataaaaagtgtactgtgtgtctgtattctagccggaggcattaaaggtatgtgctgagggctgagccataccacaagtagaaaacagattttttttttcagaagtctcagggttcacagtgtgaccaggtatcttggaacagtccctctgttccaggatccaggggtatctctgtgtctcatgttggagctcggccacagtgccaaggaggagcgttcccaggcccagagaaggggcacaggccagtatcataagaccctggctagtccctgggcttaaacagaagtggcttttctgtccccactctgctgttcacagtgtttaccctgcagagttcagtatgttcctgcttgtcgctctatggtgcccaggtcaggcctgctagagggagaaaccaacacagaaacccagggagctttcccaagtcacatgaggccacagcaggagaaacttgtaatctgtgagctgggcacatccagaaagggcatattgctgctcatccctcagagatgtccccagtcattgccagttggtccccttgagatgatatagatgggctcgggccaagacaactccagggggcctctggcctcagcatcaaagtagattcctttagttgccacacctagggctccaacaggcctctgcagggatgggcctttctggttacccatgcccacagttgccccgagaacactaacagctggaggtgatggcagggctgctgcctgtccaacccaggggacttgcatatggccctgcacaaccaagcctgcagaccacgatttgatgtaatctcccgtttgcagactgggagcatttaggggctctcaagtaggccttgctagggcaggaccaagacatggctgtctctccttcactcctatctctgtggggaggaagcgagcagaggttctggaatccacctgtctacctcatcttggagtctcatcggccttctaggccccctcccagtgaccctgtctccctgctgtcccctggctgggtctcacactttgggctttttgagcccagtatcatctgtccattgtgtggttgctgtccagtatgcaggttgagacctttctgccaccttgcagttgtgtctgacctgtcacttactcttacaatgaccttgtaacatggctagggcagaatctgtcccataaagtgtgagtgaccttcccaaggtcagggaactattcaagaatagggtttggaattaaaatcactttcctaaccaatttttactgggcaccttcattgagtaccactgctaacaagccctggggaacctctttgaacaaggccaggacctgagctcaaaggcaaacacgtggccaaaggatgggcttatagtaatagccaagagcatggttggcacatggtgcccaggggccaggaaaggatagagatgtgctccccagacagatgggtctgcacggaggactctaggcccgtggggacaccagggcttggctcctgtgtatagcctgaccaagcctgttctgccctgctgtctcctcctgtacatggaagaggacaatccagactcttgttgtcattttccagcggtttctccatcaccctgggagacgtgttaaaatcactgaacatcccttggaggtgtgattcagagagcctgggagggaaaggcaagagtctgatttttttttttaaactgcatttatctggttgtttgtatgtgggtggagggcatgagtgtacttctgtatgcttgtggaggtcagaagacaacctgtgggagcctgtctgttcttccctttcaccttgtgagttctaggtttggctgctcaaccatctcaccaacccaggagtctggattctaaagaggctcattagaagccaggggatgatggtacacacctttaatcccagcagtcagaaggcagaggctggcagaactctgagttcgaggacagcctggtctacagagcccattccaggacagccagggctacacagaaaaaggctgtcttgaaaaacaaaacaaaacaaaacaaaacaaaagagaggctcattagatacactagatatttctaaattctctggtctgagcagtgccagactcagctatcttgcaaccctatgagcctctgtggtagccctgaccatgactgttgtgggggggggggggcaaacctgtggaattgagatgtgagaggtagagggactgtcttgcttcagcatcctgccacgcccactttgccagctgtcagagaaatccttgctagtagtcctaaagcttccaaaagccctgattctgagatggtccgcattttaactggaggcaggttgagaactaaagtgtagggtgtgcagtctgtgtcccgggtgcctgtgaacctcgcttttctccttgagcatggtctgaaagctatgtgcatagggctggcgcacatcaggatttttggcaaggtcgagcctggcctgaccaacacaggggcctacaaaagcccaggattgggggggtgggcagagaggctgaacagcaatcagaactagatgggctgaatggccagttcccctcaagtgtcttaacaacctgaccacacacagacttctcattagcattagaaggctccttaagtgccccaaggtaattggagcccagccctggtaacagcccaacaaccggctgcctaagagcctactctcacagagaggctactctcacagctagagtggctgcagtcatttcccacagtgcacgcagagcagagaagactggctggtagacacggagaagcccagggtggacgctgggactgagtgcccggacacagtgctgaggctggtgacttaaccgcagaactgctcgtcaccactgctcgggccagagtctggggctggggatctgtgcgaccacacggacagtgccagctctgatgatgcacagcctcacagcttcgtcccacttgtggtggctctaggacttcctcagcttgtggctgcatcactctgctctggtcccatcatcacatggcctccacttctgtgactctgtcttctctcccttcctccaaagataccagttgctagttacattttgagcccactctaaatctagtaagatcttatcacaaattcgccttgattcgttatttcccattctgacatcccatgtaggtttgagcttggggcgctagggaaaccttactcctattatacccagcaggtagatgtccccaaaggataagcctcctactacactgactgagaaacaaaggcctggtagcagctggtcctaggaaacaacagatctgtgtacttttagcagcttcctgtcccatcaccagctaagttaacttgcctccaaaaacagagttagagacaccaggagagggtgtgccattcaatacctccatcaagttgccccccaaagaaagatccaaggtgctgacaagagaggcgaactgccgagtttaagagttttcttggggctggtgagatggctcagtgggtaagagcacccgactgttcttccaaaggtccggagttcaaatcccagcaaccacatggtgactcacaaccatccgtaacgagatctgactccctcttctggagtgtctgaagacagctacagtgtacttacatataataaataaataaatctttaaaaaaaaaaaaaaaagagttttcttgcggccgggcgtggtggcacacgcctttaatcccagcactcaggaggcagaggcaggcagatttctgagatcgaggccagcctggtcgacagagtgagttccaggacagccagggctacacagaaaaaccctgcctcaaaaaacaaacaaacaaaaagagctttcttgtactatcttggggggcacccacccacagagcgggcctgaacccctcttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctttgcatgtgctgagctgggttagggaggaaccagtatacagttcagggttcgtctgtgtcagaatgtctccatgtttaaggctgagtgatacttccttgcatggatagacatctctttactcacccatggagtttctagagagcctggtttaaaaaaaaaaaaaaagtacagggctgggtgtctggcagggctagttagaccttgaagccccacatagtaccagttaaagacttcattctagagagttctacctatcctgtcctcgctagcctgtgtctttgctgcctgggacctgtttcccatccagtgtatagtcacagtatgatgagaacctcagtcttgctggagccagctacctgccaccaagcctcacacccacttgctgagcgaccttaggtatgttccttcctttccatccccaagccctctcctctcatctgtcaaaaagacataatcatgtgacagtttgtatcagctcctcacacacatgcaaagctcagacctcggttctctctcctctgctgccagaccttcccattctgtcatcagaggtgttgctaaacttctgttctgggtgggatattgcccttcaccctgaaatggaagaccagaggcttctgctcagctgagtgctgccttgtcccctgttacaatgttgctggggtgaggagcctcagttctttctgctctgattccttggacgcaggatagttctcatagactggctggacaaatgctgtgacctcagcaccatggtcatagaatcgacaagtgctttcaactctacaggggcttcagctgtcatgggcagccagtgcctatatggcaagagctagagatagactgcccacagaggtggccctgatctaggagggtcttgaaaggtgaccaggacccttgacagaagtggacagcaggcattagttaaccttcagacacatgtctagtatctactctgacatcctgacagtgtgtggttcccacttctgtgagactgatggtatcccttgcatgcagagcaattaaggaacattctcaaagacagagcttgaagctggacatgaggctcagtggtagagtgctagtgtataccgaggtcctaggttccattgccaggaacacacacacacatacacacacaccaaagctcgcatttgaactaattccagtctttcccacaatgctttgcattgtgaccttcaactcagtttttgtttgctttttttttacccccacggcgctatccttttttcaaggtgggagtggctgtgttcccccagcctccgccaactttcccccgtccctgctgttctgttcagggctgctcagcgcctcttcacctcccaccctgttgacatagggctgttgctgggctggttttgtttttgacccagtcagcctggcagggaagtggcaggttgtgtgcagacttcccagaatagcccccggctccccgccaaagatagaggagccagactgtgtgcgatgggcttggaccagttggaagatgactcagttcttctgtaccccagccaccccctctccttcttgtcctccccctctctgctcccctgccctgatacacccaccaggctggcccactgcatgcctctcaacacctgggacatggagtgtgcaagagattctgcagccactggtttctgggtgttagttggcatgtctctggtggtctttgtgcccccagtgaagagcccttacccctccttgtttctgacttgcttgatgaccttagcccagtccctgtcatttccatgacttccgttgcagtgggaaagggtgtctccccaactgttgtgtgtgctgctgggagtgtgagcgaggcaggagggcagctgcctgctgcagagtgactgaggactgatggaattctggccatgactgctgaaagaacagtgtgagggtgagagcaagggacactccactagcactccactatcatcgtcaccatggtggccaccttcttgagcgttgcatgctgggtattcaacactgtctttgtttatttctcccgtttgccctttatgagacatccagttttataaatatagccactaaggctcaaacctctaagttatttgatctagaccagtgagaggtggcgttacaactggagcttccattctgacttcccagcctgtgtctgtcattgatgccatgccgcctcatcgaagagaagtcttcattacactttctggactcttcccgccaaactcagagtttcttttgaaagagcatttaaaaggtcacacctacatcaaggatggacccacaaaagttcctactcaaaagagattcccctgggatgtggaggcatttctgggatgaagatgcccacccatgtcaacttctgtattgtattgaacatgtacacagcttcacagacagtgagcagacatgtaagagacactaccatgaagccctaaagtctcgtgtttctctcccaaacccccagctccccaccaaagacttgtgtagcctgaggtgatcgctgccagtagagatacagttcacccaggtcaacccagctcaggagttgcagtactgagagctgggccatgcctggcgctccaccccctgctctgtgtacagagactagaaagctgtgctccactggaccctaaccccattccttacgctggctcttgccactcaacaggtggccaaaggatgttgtccaggctttatcccagaactgacctctgctttcctgtttgttcctctgcatccagtcttcatgccttcatgcttgcttttataggtattgtgcttgctctcagtctctgtctctcccttcctcctcttaagcctgcccaccctccttccctctcttctctttccctcctttcctccctccctcccttcctcctcaccgnnnnnnnnnnnnnnnnnnnncgtgtgtgtgtgtgtgtgtgtgtgtgtgtgtgtgtgtgtgtgtgtagaagcatgcacatgcatttgtctttatttgtgactaatgtccttggactgtctcccagggtccaagggcctagtgaatttcaagggtaagccacacataaccttgcttagaaccctgtgggttgcaggatgagccggcctgatgtacagttggctcacgacccgtagaaagaaggttgacatgaacaccccacaatgctttactctctatccccaaatgcagcaagctctggaatccaagtgctttgtcatagctcgtttggcagcagagtcccgcgtgaactggggtgagactatttatagtccacgtgaagctatttatagccattatatatcctatactcacggattcagtgcagaaatgtcaatgtatttgattattgaacggtgtggaaatgtgctatctgtctgatgttcaagaaacttaaatcccacgtgcatttgccccaggagtaagcgttgtgtgacttttttttttttttttactggttgtaaaagccctctactcacagtaccagccacagtgtctctcctgtgattttggagattaaagaggcaatgtcagccatggagcccttgccctgacccccatgcgtccatcagcttgcccagcagtaggtgcttttttgtttgtttgtttgttttggttttgttttgttttgttttgtttttcgagacagggtttctctgtatagccctggctgtcctggaactcactttgtagaccaggctggcctcgaactcagaaatccgcctgcctctgcctcccgagtgctgggcttaaaggcttgctctaccacgcccggcttcagtaggtgcttttagtgtcatttggcatcctttcttttagctagatctggtataagaagctctccacactctcactggacacacacacacacacacacacacacacacacagaggctttattacctctccttcctctccagaagattctgagtcttccgtatcttgtctcagtataggaggatgaaagaggtggctgggccttaagctctccttccctatgatgcttctgggaagtcttaggcgcagagcacccggatttacattcaaagtacattgaaattggggtgcaaatgctcgggggcccaggtatatggaagaagggaatgtgcagacccggctgcttccgttgagcaggagaaccagccttggctgttacaggacctctgtgtggaccaccacctcctcccacatgcctgtagttcctctgagcatccctgagcatcagcccagcaagtcacagggaggggaacccagagagacttgagtggcattcttaggaggagtccagttcttcctgagaagatgcccactgcagcttctggaagaatgaccccagggaaccttagaacctggaagctatgtctgccaccatgggagggctagggaagacaggagctgaggcatcatctattcagctagagtatggggcaagttagagaggagcctccctgctgaagctcccggtgtaggatttagccacagtggcaggaagtccactttagggtggcactgagggacatggtaagcctctggcctggtccacagagctgtgcaactgcctgaattgtatgattctgcctggccacggctcacctgagggagggaatgtggagtgctgacactgacatgtaagaaaaggtcttagcatgctcaccttggatgagcagctctgagaggagggccaccaacctattggtgtccaggagtgatccctggggcatgtggaaggccacctaccagcctctgtgctctttgggtctgagcagcccccttcccttcactactgcagccccctggattgttttccagctaggatggctgtgatcaccatcagtgtctgggcttcagtaagccctagggtgatgagtaatcagcatgagaagccattgtctgagacaactctcagaagccttgggtcccactgacccagccatcatcacgtggtctctgcaggacactggtctgcaggcatgagccattctcaggcacggtggctacctatactcttcctgtggtacccagtttagctgctggaatcattttggtggtggtggtggtagttttgtttgcttttgcttgtttgttgttcaagatgaggttttgctgtgtaaccctggctatcctggagcaagctctgtagaccaggctagcctcaaacacagagctctgcctgcatctgcctcaggagtgctgaaagtaacagcatgcgccccactgtgtggctgctgtggaaatcttgagccttcagctctgagatacctcagatccagcagcacatggggcacccctgctcccagtcttcactgccttctttctatgccaggctggtgctgtgtctcagtgaacattaggtgtggggcccacaaagtcccatgggcaaaacctgattcccttgcccatcctcacttgacaggactcatagtgaacccctgtcccctatcctgtgtgcttttctttgtaggaggataacaaaaagagggtatccagagagagcctgataggaaggagacccactggatctgttgatctgggtggaacagaggctcctatagcctattctagcctcaaagtggtccagggacatgggcatctgagccaagtctactgatgtgcgattaatttacaaatagacatgcagagtggaacgatgtgtacacaggagcctgctgttcccacaaagctgcatcaagatgtcatcaagccgggtgttattttagttccaagtattgtatctgtttagcacccagtctacaaagtgccatgtacaatggggggtggaggggggcaaagctggcagtgtttgaggacccctggaccagtgactgctttgaggaggttccaggccctagagcagtggttttcagtctcctaatcctgcaacccttcaatatagttcctcggtttatagtgatccctaaccagaaaatcattttgttgctacttcataactgtaattttgctactattatgaatcataatgtaagaatctgttttctggtgttcttaggcaaccccttcgaaaaggtaattcaacccccccaggggtcttgaccccacagattgagaaacactgccctagagcaattccctagacttgtagcaaatgaccacatttcacagatggtagcatatggccaacacatggtacgtcaggttgccctacacatacaacacccatagacaggtgtggtatctttcctagaaccagattcacaccacatcttataggagggcggtgtagaggatttcggaatgacacaggcaaaaaccatataaccaattgtgaatttgtacgctttttttttggccttggggtagaatgaattgtgtctttctgcccattaagaggaacaggtttgcttagcaatcagataacgtgaagaggctccaaagatgtttcaccctggattagtcagccatttgtcatcgtgagtaacagaaatcccatctgagctggctaaggtgagaagggaaccgaatcagaaggctcctgttgccatgagtgtatccagcttcccccacggcaggagcccagtagcctcctggactacagaacacttggctacctatagctttgtggacttggctaccattgaaggagtggctcatattctttttgaccctttcaaaacagaaaagtcagccgggcagtggtggcacacgcctttaatcttagcactcgggaggaagaggcagaaggatctggcatgagcatgctgccagagcctacagaaaccgagaggcactggctttactgacattttggctttagacttctggcctccaaaactccgagagaagaaactggtattacttgaagccagccagtgtgcagtgcattgtaatggctgccccatgaagcaaatccagccggtgtcaactcaggaggaggaacagagtggaaggatcagagagacagacgtggacctactggtccaaaacaacctctgactggcatctcatggcaggtgacaaggcagatagaaggtctctctagagaaacagacgcttgtcaaagatgtcctccagtaccttatataggaaagcagtagctctgagctgagagtgtagctcagtgggttgcgcctgacgagcatgtacaagaccctgggttggagtctggcaccacagtaatgcaggaacaaaacaaacaaggagatgagcatggagagagagctagggccagtatgaatgactctcggcagaagtgactcccaggccccggggctgcctgggacgaggccgctgccactgcagctgcagctaaagcctatgccgtcaagcagtgagctcacacacttcagtgtgcagaggtgaagctgaaggcccacgtggaggagaaaagactctggaggcaatgaaggagatctgagaagagcccaacagaagttcacaacagttctgatgaaggaagggctaatgtgtgggagcagactgtgaaggcaacctgtgggacgacgcacagtcagggactgcacaaatggagtggagtcccgggagagaagaggagaagcagccggagtccacctaagtccagctctttaaagatagctgataccgacttctcaagggtcctcaacttagaaggaaggacccagccctactccttgaagtggcagggaaaaaaagatgatagggctcccctccccccttcttcctgcctgaagtttccctacgagtatttcctaaaaatcatacaaactagggcaaggttttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacactgcgtaattcaaaggagcacccatgagaagctgcccggctttatccagttggctggagctcaccctgcacagccacgctcagctcacctagctcagaggcaggctctctttcccaagcgtgcactgggtgggtgggtggggttgttccccagtttgaccagtagttttgttgttgtttgtttgtttttgttttctttgtgctttctttcctctccctctttctccctggagagggatgagcatccatcatggctagcaggttttatgggggctatgaaaggaagctaatggctctgtaaagaagagccagttacctgggaaaccttccaggcatgttgtgttcctggcagccctgggaggcctggtggaaaaggccaccagccttcagagtgagatgagcaagatctaggtccaagtgctcaatgcatgatttacctgtcctgacttaccctagggacactgcctaggcattgcttgtcctctgtggaccaggagactgccttccaagatgggcatttgggctccattgttgttgatctgtgatacctccgactcttgccgaatccaagagaaaagttggttagggctgaattactggctggaaaccaaatattgtaccctactgctttgagatgctttgtggtctcatcaaatgatagcccatccaccctgagctccactcttgccgtcttgtcctgattggagtgttctgagtacctgctgttgttagctatccatcactaggtccaagcagacctcttctaatctaccccattggaggggagccaaggagccagctgccccctcactaccacggaggcctccagctgctgtctgtgttgttcatgcccctgcatgcacccttggggaggcaagtctggccctgtgagaagtctgagtcacagatgctgtcacaaaacagggacatagcaggcaaggaggctgcactattcttagagacgcttacagttgctctaaggaatcgttaacagagcagcagattaacactgcctggttaggagcactgcctggagtgggagccctgagccctcgccaggctgcctttcttaggtacctactatgtgccgcctagagcctcctgcctaaaaacaagccccacagatagccctgtgcgtttgctcctgtgttctgggcctacagcaaccagtgagccaggggtgttctatccccgtgaggggtaagaaggagccaggagaaaacgagtcggctcatatcagttcaggttcagaggaggctccgagagggatcaggtggaagctggagcccaaagtgtgacatttggaccaggcctgaatgatgacaaggaacagacgtacccaggccctggggacagatgggcacttcagggtcacaacagcagcttagcagtgagagagagtttgtgtatccaagaacggctgcagccggggtggcagtgcagaggtggagctgcggtttgtcttgggcaggcagggctggggctgcagggactctgagagacagatgtaaaccaagtgcagggctgctggagccttgaggaaccccacccacagaacagggagccacagatgggcttgcctagcgctgaggagggaaggcagcactaagggtctgggcattctcttgttatgggacctgccatagagctctgttgttgctcccagatgagctatggttgtaactgagctgttagtacttccgttttagggcagaatagtacttcccaccaggtttggatggcttctgtgcttcctgtcttccagtggctggaggctcccgagtactcgtgtccacagagctctcagtgcccatcgcagaacctggctcctggtggccgcctggacctgttaggggcatgaagttgagatggtgaaggttgagtcttactagatgaggttggggggctggattgactagaggggaaaaccgtggtttgcagggctgcagaactttggtttcaccagacttacctggggcacatgagacattcccaggcctccatctgggggacagagtttagaaagggtcactgcctccttctttcctccttgcttattctttcaattaattttaaaagttagcatacatgatggctgtcgtcatggtatttagtgtagacctgtcattatgttttattacccagccctctcctcccacccctcctcctgctgctcccctccctccccctgccagccttggtttctaacataataaatatcattcagcacattaaaaaaaaaatccaagtagcccctctctgatggaatttaattagagctctgcctcagccgggaggtgtgcacccctacagagtgaaccgaaagaaaatgaggcaagtaatctctcgcagtgaaacatctttgggggacgcctgcaggctgctcagttccctcctgcagcttttagtaaacgtcactggctctcagcgtgcactcttcaactgtggtggcctcgactccttcccaaaaccccttgccttttaagtattggaaagatcgggaaagcaagggtctacaagctaagagtgtgaatcacggtgttattatcaatacttgaggtgtatgtttatacaatggaggcccgttaggaaggtgatggctcagttctcaagctgctttcctagctgggaagtcaggtaaacctgactcttcacctactgagagggtgtgggtgaggtgcccaggagacccaaagccaccgtctcctaggttatgaagtggggctattgccatgcagggcaacactgttcagccataaaaaagaatgaaccctggtgtgatacggcacgagccgtggacacgaagccaagtgcaagaagccagactccaggtacaggatgggccctggatcccacacaaatccatgcagacagaaagcagatatgtggaggccacggggctgtggagggactgccagtgactggagaaaaatgtcttcgaattagatagtggtgttggctgcagagctctgaatacattagcaaccacattagagggaaaatggcacagaactgaatccatggggcgattctgacatagcagtcgggaggctgctctgttggatatcagagttggatacagcctgagcatggatagtggtctagggtcaaagggtaagtttttcatgatgtgcagctccagggtgagacttgtgtgggatttaaaggggccgcagcgctttctcgagacccccaggtagtgccccagaagggtagtatcaggcacactgtgtgctttctctcccatcttcacagaaccatgaagaactgagggcaggttggcctgaaaactgacactccaacccttagtcatgctgaatgctctagagtctgtcttggagaaacattccattgattttaactgggaagcactgggcagtttctcaaaataaaaggggtccagtactctccccatgatgcccaggggcatctggtcccacacctgctagcccggggaattggagcctcagaatggtgccgttgcggcccatgcacagaggaggtttaaagggcaggagttggaacccagttcctgggatctccagactgatatgcgccccacggggctatttgcagacctcacagcacacttgctggttttggaacagaaaggaaatcagaacatgcagctgacaggcccccaaatgagtcagaaagccgggtgctggagtcttgtacccagagggctccggctgaggtttattagtgggcgtgttggccaagagagtgggaaaactcggttcagacagaaacatagtccagagttggaaccgtctgcctgcaagctccagtggtccctgcaccagagcgctcccatcttttaaggaaagatgaggatctagtaaggatcccacccattgagacacagcgaggtgattgagacccccaaacaatgcagttttagtgggatggggggcggggtgccaaagtgtgttggacagagacagaagtgtatgagagagaaagtaggaatagcaagcaagtaacattgacctttagtggcccttgttcactcagatagcagagggacaggatgggaccaaggaggacagggctaggagggccaggggcttgggctttggttttgcaattgtaatagttgtttacatttagatgccaatagaggtgatggcgtctccagcagctgccagggcttggagattcccaaataacaagaagacatgggacccagtgccttcagataggaacagagatgccccgcctgttgtgaggctggtaggttgggtgcagaggggttgctccaatttgatgcagggagttggagggtataaagaagacagacaaacaaatgtaggacatgttgacacttgctcagtgtggtgggagcataggagctgggccctcctgagcatggctggcctggagaagtagctagcagcatgatacattgctatgatgtactgtgatccggtcacagctcctgttgtcagtcagctggctggagttgcctagtgagggttggtcttccatagcttttatgtctctggttttctttttagcaggagcaggtagtgccccctagtgcatgcctctggtaaaaagaccccttgctctataagcatagccttgtggggccctggcactcaggattaaacactgactggcatgtgcttccaagtgggcctgggtatgggaatccctccgcccgtgatagcagccatccggcaccggctgggatgtgtctgaggcttttgtccctgtgggcctaacagctctcttgcccgcaaatgaccagggcctgcagcatctcttctcttgttctttacacctcatctcctctttatttcctcccttgtccctgtcccggctgctcctttaggtgttcagccgttgactttggcggtcaggcagctgcctgccccacagctcggtgcatggcttctctgctatcactgcttcaggcttgatttccatcacttccatctctgcttctttcctcagtgttcagtcctggtcctctctactggaagtaggccaaacaaacaaacaacaaaaaacactcaaagacttgggagataccacaaaagatccaagccgccagccagcttcacaccagtaacactggaactcggttgcaagtgaaggtttgtgcttgcacctatcacggcttgcctctttagtcccagccagggtcgtggagagttcacggaggcttgagatagcaaagagcccagtgccaaccgaaacaggcctggctggggccctgcctgatggagctggagcaagcggctggggtcgctgtgcagcttccccagggtagcatggagtgttcaggatggctgatgccggcataagggtagtcatggtgagcactgtgactgacagttctcttgctggaggcagccagggcagcaagagagcatctaacagcttccagctaggaagtcatgccccactccgtgtcattgcttatctatggtagaatgagcagcagcaagagtgtttacagcaggaacttagagaacctagcagtaagagtagtttaaattttaatataattttatgttatttagatatacaattagtataattttaataatttaattaaaaatttaaaattttaaatgaagagtatttcaaattaaaaattttaaagactataaacttaaaataaatttatgaaaatttaaaatagtttagatttttacataaattacattttttagataacagtgctcagaccctttatcctctccccatcacagcttgcctattcgggaatgaaagattccctagtaaaatttccacctgtgcctcttagaaactctggcatttgggacctctcaaaagctagagtttcccttaaggcttgttagagctgggagaggctttggataaggcctgtagcccgataaacttcctacaaatcctccctagacctccttgccctggaggtgctcccatctcagggatcctcccccggaaagcccaggaacaagggactctgtcccttaaaggtatgcctgtttcttaggtgggcagcctcccagaggctagaggatgccagcctgctgcagctcaggtggaggggccccagggaaggatcaggactaagaatgaggggctctgaagcaagcaccaggttccctctggtcatagcccagtccatggagattcggaccatgttcactgttcagtgggagcaccaaccccagggtggcagtggttgctgtgaccagcaggatctccagcaggctgaatagggatggtttcagctagtgccaggctccggtgtctgggtcctcgtattctctcacacacgggcctctgcccttgtcatcctaggtgaggtgcagcattggctgttgctctcagaagtgggaattataaggtccagggcttccctatcctgctgcgagtcttaagcagggtgccgccttcttgagactgtttggtcctcagtatctgctacttccctgaggctgtcctggggtgaagtatcacaggcgaaataccctgcagcactccaaattactgtggtgtccccatgtgcttgcttggccatggggtctggtggcaagcctggcagttatcccagtgtggcacccttggtgcataatggtgagatttagaaccctctctgggacttcaggtgagtgcagcagtactctctaaggccctctcttcattttgcatagcaagggagggctgtgtgccatgccacgcagagcagtagaggacactggggcaggggcagggacagggtagtggccatgtcctctagctcttctttcttcttctttttttttttttttttttttttttggtttggtttggtttggtttggtttttggagacagggtttttctgtatagccctggctgtcccggaactcactttgtagaccaggctggccttgaactcagaaatctgcctacctctgcttcctgagtgctggattaaagccacgcccggcttcctctagcccttcttgagcttggcctctactcaggatgtcggaacagctagaggaggagaggcctgaagccagaattggtctctgaaatccagcatgggacaacctcagcctcttcgttacagaccagggccctacttgtttcctagctcagcacacattcctcaggagaagcctccggggtctggagtgtagctcagtagtaggaggcctgcctggcatgtatgagaccctgggtacaatctttggtaccgagagtgagacttgggctctgactctgaggtgatatactttctcctcctgagacaccgcatacctccagagcagctgtagccaagacagtccacgtgtaggggctgtttcccttctgcccctgtgtcacccctttatcactagatacaggtgacaaaggcagcagattgctgttccgctttttgactcctgtttggggaccagagagtttgggagacagagaggagccgtaggattttctagagcatgagagcaagggagcagcaggctcctgcacatttacacacaagcgagtcacagagccaccccctcccccagcccaaccccagtgtggttggttccctgtctccctctaagctgccagagtccaggctcccgatgaccccacatcaaacaacttccagacttaataaccagaatgcaactgaattgcgtgtctgctcagcctcactcctgactcccgtctgtgacgtcaaaccccagctaatcccggaaaaacagattaagtgctgtaaactcaattctcccgccctccctcttgctcagggtgtctggaggacttgccctcttgcagcttgctccctttgcttggagccaaaccctcataatcctccccaagctcccatggatgccttcagttggcaggctctcccgtggagctgggctctgcccttcccctgcagttccttcatttggagaaggcctctgggctcctagcttaggttttctgctttatttcgagaggctggggccttgattcccagggtgacacccagcacacctccactctgcctggtccatgacctggaagcagcttatactctccattctgtcttaggtcccaccccagtgctgccgtggccttcctgataccacagcacgtgaccccactctgaccttgttgaaccatcagggacactgaggaatttgaggatggtttcctttctaggatcttaaaagcagggtctgaaacccaaaggtgtcagtaaaagccaggtcctgttcggggctccagagaatgtgactgtcttgtccgaatggctgaggtgtgacatgcggggatatgcaggtactggtctagctcccactgactggcctctggagacctccattttccatattgcctcttgctgtctcagattcccaacaccccccccccaaagttgtcctgtgcccggcaggaactataattttgtctatgctgtcatggctccagccaggacaagatggagcgagtgtctcgtgcccaggctgctgcactggatgtcaggaggttgcctgagctagggtttggctgaggtgaggccagggacagcagacacaagtcctgttccctctccacctgagatgctccctggcctcagactcagcagggacaaaaccagaggggctgtctggccagatcagggcaatgataatattaatcacacagaccaaggggacgatgtatggctgtcaggccagccgcaaagcacttgtgcagagcattcttccttgggccccagcctcggggttcaaatcagtgtgggtttagtgtctgctactggcagtggaatcccagccagggtggccatctgcccgtggctggccttcctgaccttgagaggccagcagcaataccagtggatttggtgctgtgacaatggggtgagacttgctcagcttgatcacacttcatccacaggacaccccaagagctgttctcacccctatttgtagaagataaaacaaaaggtcaaagacagtaggtagctgggcccagcatgagtcagagccaagaggggcaggtgcagccagcaaccttcatctctgcaccattgcccttctctgcccctttgcacacacagctccaactctgctaccctgtatcaagaagataccatgtagaagagcacaagtacgaggtaccccaaagtcgcccgacagcagcaagtccctcacaggcatccagcaaacatgcgtagacagacctgtgctaactgtaagaatgataggtgtggctttttgtcaagtttctaaatgctttttgaactgaaagccaggggcttggggtatgacacagcctgcccgacatatgcaaggtgactgtgggcctcagcacataaaagatcaaattcactttgtcagttttattttagcccacatgccatcccacctatttaaaatatacttgaatttagacagacacatctgtattagtcagggaaaagggatttggtagagtgacttacaggctggggctgtctctaagggaaagaccaagaacccaggagttaggtgtgtagtcctggaggctggatgtctcagctggtcttcagtgtactccagaatcccaaaggaataggctttcctgacagtaaaggaaggagtgcctcggcagtggaagagatgaactcgccagcaagatgagccaatcaagaaaacccttcactggggtgtgcccagccgcttgggcttcaggttgagaaccaagattagtcatcacatcttcacatctgtttgcgtacatctaaaataaataaaaaggaattgctaaacttcagaataatatttttcttcattgtactaacagtcaccaaagggttaaaaggaaaaaagtttttttttttaatttattatttttttcttattcattttacatcctgctaaccacctccctcctggtcatcccttcccacaatccccctccccctccccttctcctctgatctggtgggggcttctttgggtatcccccaaccgtggctcatcaagtctctgcaatgctaggcgcatcctctcccactgagaccagacaaggcagcccagctggaagagtatatcccacagacaggtatcagcttttgggatagccccagctccagttgtccaggacccacatgaagaccaagctgcacgtctgctacatgtgtgcagggaggcctaggtccagcccatgtatgttctttgtttggtggttcagtgtctgagagccccaagggtccaggttagatgattctgttggtcttccgtggagttcctattctcttaggggcagaaaaagacttttttttttaaagacgtatttatttatttattttatatatatgagtacactgtagtcatacaaatggttgtgagccatcatgtgctttctgggaattgaactcaggacctcttctcactctggccccgctcgctcttttaaaagatctatttacttattatatgtaagtaccctgtagctgactttagacacaccagaagagggcatccgatctcattatggatggctgtgagtcaccatgtggttgctgggatttgaactcaggaccttcagaagaacagtcagtgctcttaaccgctgagccatctctccagccccagaaaaagactttttaaaaataactttatactgtctaatcaggaacttgtcacaatttcctttcatagaggacttcataagagattcttttctacttctgtcatgtttaatgttccaaatagattttaaaaactggttgagtgcacattacttttagcttcagaagataccatgtatatatttaagaggcatttaactattgtaaattattttgatgacttaaaaatgtcaatactgagttgtatattttaaaataaatttcactaatttaataaaaatcttttaaaaataactttattgagatgcagttcaaatactcattccattaatgcgtctaaaatgtgcagttcagtggtcttagtatattatattttggattacctaaagtctcatagaggctatgcagcataaaactttccattttgaagggctgggatagaacgctgtggtaaaatgcttacttagcaaacacaggccctgggttttatcaacagccttgaagaaaaagaaaaaatttctattttaagcactctccagtattccactccacggtgttaagagcatccccaggggcctgcagccgtccccacagccacttccaaagtgtgttcttcgcccaaatgagaactgactattacacaatgactccctggtacccttggtgcttagtaaccactaaactgctctcacaaggaggactttaagaagtcaccgttattaattctttaaataatggattctattttaaaagcagttttaggttcacattaaaattaagtggaaattaagagtctggtaaggtccttgccccacattaacatcatcagtttctatcttcttacaccaacatggtcctttcaactatttactatcgtatgtgtatgatatatgtatgatgtagggatggacatgtgtgccgcacatgtgtgaagaatcgaggacaactgggtgaagtcagttctgtcctcctactagtacgtagatctcagggaatcaaacgttggccatcaggcagcaagcgcctttacctgctaagcagtctttcccacccagagtagtccttttgttacaactgatgaacaggcacatacgcggagtccatggtttgcattctttttgaagatttattttcattatttttaagtgtgtgtgtgtgtgtgtgtgtttgtgtgtgtgtgtgtgatacacacatgagtacagatgcccacagaggccagaagactcctgacactggagctataagctgccgtgagctaacatgggtgctaggtcctctgtaagagaatcaagtgttcttagccactcagcccttggttgtatattctgtgggtttaaataaacgtataatatcatgtccaccacatcatatgaagcagtttaactgacctaagagccctctgaatttgcctgttcatcccacattaatttatctatgcagcgaatgaactttcatgctgtggaagttgagacatttacatttccacctttattcttccagtgtttgttagttatattattatttgtgtacattgctggggttttcatatacttcagtaaccataagtgccatgattgcagaattgctttgtttacatcatacttttccgtggatgaatttttccatgacttatcttttagtttgttgggttttaataccagataatatttttaaagaagatgttatccatatcttagcccctaaattcatatttcagggatttgctgacatcacacctgaaccctttagctgggtagaaaattctggttcctaatattctgcctcttagaactctgcagatattactcatggggcttctaaaattgtgttgctataaagtcttattctccccaacccatctctctggactcttccttatactgtcctttaaggtcagtgatttttttttcagaatgtgccttgctattatttataacattagggtttttttttctttccatagaacatagaatatgagttactcaatctattatcttgttatttctaagaagttctggagacgctatggaaatggctcagtgcataaagtgcttgctgtgcacgcatggggacctgagttcagattccccagaactcccataaaagcccggagcaatggcatgcagcagtgctggagaagtgggtggatacaagaagctcctgggcactcactgttcagccactgagccaaaaatagtgagctccacgttcagtgaggtagactgtcgcaaagcatacggtgagagagactagaggaagacccctgatgctggcctctggcttcacatgctcacgtgtgtgcatagacataagccacggtgtgcataacagattttaataattaaaaaagaatggtttttatgacctgtttcaggacttagctcattcttctatcatcctgttttgctccgggtgcaccccagtcatgtctgtgagagagcccctgtcgctgccacggctgcatctctatctcagtcttctcctgtctgctctgtgagttcctcaaacccacccaccgcacctccagttgtttgttctgttttgcctgttcattcacagtttcgtgtaccttttaaaataagatgagccacgtttttttttttttccacattccccctgagcttagctagctttcttcatctctctttattgttgaattatttctcattctatccagtgtgctcacttaagtagagtatatactaagtttccgtgtttcttttcttccctccctcatagccacgcatcctaggggccacacaactaggaaaaataatgttaagctttgcagttaggtcccacagggcatgccaccctgtgactttgtcacattttgtcactttcagaactgagccctctctgtcgctgttgatcccttcctactgtctgagtgtctgcctgcctgcctgcctgcctgcctgcctgcttccatagttccttgcaagcacaacacagtccctgtgcttcagcctgagatggagctgccgtcttggtcttcactgtctgacagttctcagaatgctcttgtgactaagctttgcttataatctagctctcctgggttgtgggagccaccccgaatcctatgttggtactgtgtctctgtctccggttcccatgtggaagggtggacaccatctgtgtggttacagctcaccagggagcttgtctttggagagagtatcattccgttctttattttagagatgtgctcaccgagcctctgaaagccgagagactcctagtgtctgcagctggccaggctctaaggtctcatccctggacatcttgaagagtctgagacctttagagatcacgttttgtctaacctgcagatcctactttgaccctaggctggaagcctgcagccttgcctggtgggccaggaagccaagagaacaggtggtctgctgtgaggacacaggccagctctggtccacttctagggctctcttcccaagtgttgtgaagggtttctttctatcctattagcagatctgaggtttctcagccctctgggaatccatgtgctgtagagccatggcaatgtttaaatatagatgacccagagatactcttacccttaaccagccccaggccaccatgaaccatgactgcatggctggtgtgatcctgtccaaccccctcccccatctgggaaacctgtgctcagctccccacttaacaataccgaaccctctgaaatcaaccatggataccctgttcagggagcaggctcaccctttactacccagaggctgttgatgggagggttcacacagcctctctctcagtccttgggtagctcttcaagattgctcagcaaacaaggaaacgcaggctagagaggtaaggaatttgctccaggtcgttgttggtttgagagggttgagactagaattctagccttggctttcgctttcctctgttaacacacctaccagattgcagaaagtgactctcctattctctctctctctctctctctctctctctctctctctctctctctctctctctctctctctctcaggtcttcattgaattctgtcatggttgtctaaggaatcttgcctagaaagtccccacaagcacgcagctccctgccgcctggaaggcgtggactccaagatgatcataaaggaataccggattcccctgccaatgaccgtggatgaataccgcattgcccagctgtacatgatacaggtgagtccagagaggcggctgacccgggttaagctggatcagtcccagcctacactactgggtaccgcctgtggacatggactgctttcggtgtctgtgagctgctgcaccttagctgtacatccggcttctaactagacgacatcaggcccacagacacactggactttcatgggaccagattatcttgtcaccattatattctagacacccataacactagcaccctctttgcattcacagcctactgccttgtaggtcagctgttatttcagagctcagctctcaagcaccacagacgccccattactgcttcggaggtatggcagggtgggcttctgacaggaacctctctctcttcctgagtttcacgggctctcactttgggattgggcgtgtgatggcagtctttcttctacttagaaacacattaatcttggaggacctactcccatgatgccatataaatctaagcgatccccagatatacagcccccagagatcatcacattgggggttggagcttcagtggaggaattggaggagacacatttaagccccaagcctcatttcagacaggggatgagaggcaagagaggctaataggttgcacaggagcacacagcctggctcctgactcccagtttagtcatgcccactccagggaaactcccaggactctcttcagtgcctcagcagctgagaacacctgtcccaagccctactgtccactccaggtgcttctcatccaaacgccagccctctctagggcccgcattgccaggatactgacttactgaccagaagccttgctctccagacctttccattcctttacagctatccttctccctcgtcaaccctagagactttccctccatgccgagggcccagagcttctagaccaattataaggcatctcttggcttggctccagctcttgtggatgtatctgagcctcttgttcctgttgtccactgggacccgtacctgattggcttctctgtgtataaacccctcgtcattgcaccaccctgatccctcagtatttagggcggggggcagggggcagccttcagcgcttccaccccctacctgcgttgttttgtttttgtttttctagacagggtttctctgtataacaggctctggatgtcctgaaactcactctgtgaaccaggccagcctcaaactctcagagatccacctgcctctgcctcccatgtgctgggattaagggtggtgcaccaccatgcccagctttcccccctttctgataggcttgcaccttcagccttggcacccagaacccgtctaaggaactcaaaacaagcagagtttagcccgctcccacaggagaggtttggctgggaaatgagtaggaagtgcccccagcctctccgggggactgtttgctctgagcggcttcagaagcgcctctcaattccctcttgaaccacttaccccttaattatttctagagaacgggagggaaagagcttaaatcaggtcctagccctgagcactctagaaataactcagtctgttcaaggaccatactcatctgctgaggctgccatgtgtctgcctgtggcttcttagttccctctccagcagtgacccacagtgatggccgtgcagccccagtggcttcttgagttgggtattcagagtctggcagcatgacctccagccactggagtgccccagaaaatttttcaagtgtggagtcacggtttctcagcagctccaaaggccatcatttcccagcttcggtccttgtgtttccagtcaatttaattgtgaagtgacccacagcatctctatccgaaccacacgatccactgggccaatttatacttttgatgaatattgatccagtagccggtagtaagtagaagtgtctcctacttgataggtcacgcatatctatattgtcacaggtgcccctctctgctgctgtgagtttccaaaggccttccctgtactccttccagtgagcaagtgtatgtatgcaaaagacagaatggtaaacaagccagatgttgccacaagaggagtgtccgggccaagtgctaactgtcatgcccagagggaggctgagaagcctggctgacatatacatgtacagatgtgttcacgtgtgtacccatctatataacttgcactgtaatctccatcagcctgaaaggcccatagagctatgatatacctctctggaagctgcatggctttaaaactgggttgtttgtgagaagaccacacattctacccaaataactaaggttgtcttccaacctttcctcatgggccacagtggcagaaaagcaaggggagttgagtctctgagtagcaaaggctactgttttaaacagaaagaccgtgaattcatcttgatatgagggactctggtaaatgagctttctagaagtttaggtgtagtctgtttccagacaatagcacagctaacgatcttactctataggtggaagtgtaggctttcccagctgagcctggcttgagttcaggctctgtggaacaagtgaatcttcctgggtattaattactacttgttttttgttttgtttgtttgtgttttgtttttctttttttaagatttatttatttattatatataagtaaactgtagctgtcttcagacaccccggaagagggcatcagatctcattacagatggttgtgagccatcacgtggttgctgggatttgaattcaggacctttggaagagtagtcagtgttcttacccactaagccgtctcttcagccccctatgttttgtttgtcaagacaaggtttctctgtgtagctctggctgtcctggaactcattctgtagacgtaactgctctcaaacttagagattctcctgcctctgcctcctgagtgctgggatgaaagacatgcaccaccatgcttgacccctcaatttcttacataagctagtttcttaaatggcagtgccctggaaggactcacaaaagaaactttcctgtttatagatgggaaatttgagccaaatttggaacttagcaccccacctcccagggggtctgtctgctcctagaaagctttgggcttctgatggggtcaggaggaacccactatcagtatcagatatgaaggagcctttgctcgaccagagtgcaggggatagtgggggaagacaggaagtcccattcatccagaacagggagggaggcgcctgaggaggccgactctgccccgccccttctcctagatggtccttgttgagagtggagtgagctgtggccaataggcctaagggcagaacaagtggttcagcaagaggccagctcaggcagtccaaatgtgagggatggaacgtgggcacttatgttctcagacacccactcacagccagatttctatctggagactctaatcatctcatgtggccaggacataatttctgtacccagcattctctgctgctacagggcctgttgagtgcctctctcctagttcctgctcctgtctgcctctctgctcactccctctgcttctgctgtggtctttgtctcccatgcctcggaacccagagttcctgggggcctgtgcctctgcagggtgaatatatgtcacagtcacaggctgtacctgaatgtgtgcacagctcactgtgtgccagttgtaccacagtaacacggtgttctgtccccgcctgtgtgaagactatttcagggaagactgtagacgtaccaaacaaaagcgaggcaggagtggtaaaggctgagaaacgagacaggtctaggtaccccccaggtagatgctgtaagagccagagtgctccacagctacattcccagggaaagaataacaatgaggctcatctagcagcagctggagcaggctgtggaaaagacaaactcgagccattcttctgcttgaggggttctgtaccagcggtgtgaaggctagtggaaatcactgtgctgtcctctagagagtgatcagcaagacccttttgtcctggggatgggcagacggccttggcggtcagtaccctggacagttctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctctccttcttcaaccaagttgtttgcaggctcaaggctccaggggtgggcagcactgcacactgcttaggaatggtcatgggcaagaatgtgagagtggctttctctgtgggtaacacacagcggaagctaaggagagctcctttgtccggtctggctaagccgcagctgtgtgaggaatgtttcccccctcactactgtggtcagtggagacttaggggccagcctgtggagggtggcttaagtggaggaccccacattcagaattcctggggactatgaggagtagaccctgatgattattggttcatttggtcagcctttctctatctggtccatggagataccctagtgctctatgggtttgccgcatagatcccagcccttaaggcccgcaagtctccatatccatctcactgagtggctgcaacgatccatagcccacacctggcgatgtcagcagcgtgggtgccctgtgcctgaagtacaacaccagctttagcccctgccatgacctgcctgcaaagctggaactgttcctcctcctcacacacaaggcagctcagagatgtcagagagcttgttcagagctgaccgtaggaagccaggcttgctctggagatgcgaatggctgcctttctgcccttggagcatttggggatctccatgtctgccacatctcttccttctttgaagtcatggttttagggattggagcaggatgcctgtcacctccttgtcccatacatagcccccctccccccagaactccaatgctcatataacttgagggaagactgtagatggtaatccacccatagggtcaccactggggaaagaaaggcccgtgtggttgtgcaggagacacaaggaccactccaggaggcaagagagttcacctttgggcaggggagggaccaacacttagtgctgtttctctgactgacaggctgaaggctaaccacgggaggtcttgaagataaccacatagccggttggccagtgcccccaattcatattcacatacagcttcaagagtgcgacctcatctagactccagtgtgtacatatggaatttacacttcagagtttatactcctgagatttagggcctgccccagttgactaactatggtccctgtaagaagccaggcgttggtggcgcacgcctttaatcccagcactcgggaggcagaggcaggcagatttcaaggctagcctggtctacagagtgagttccaggacagccagggctacacagagaaaccctgtctcgaaaaaaaaacacaaacaaacaaacaaacaagaagaagaagaagaagaaggagggggaggaggaggaggaggaggaggaggaagaggaagggacagaacaactcagtgaggctttcctcccagggtgactctagcttgtgttaagttcatagttaaaactgaccaccatggaggttcaatatgttttcctatgttttgagtgtgttgagagtaaaaatcgctagtttgaggaatcactacactgtttctgcctccactagccacgtgagagggctcgttcctgttttcagatttgctattgctcgtctttgtagccatctcagtgtgttccaggtgctctctatctcactggtttgggactgggtttcccgtttgtgtcgttgagcgtccatttgtctgtcttctgtggagacacgactgttctagtctttggccgtttgggaagtgtgttgtttgtctgttgttgagtagtcggcattctcttgggtccagattcctagcgtcaggtattattgacatgttttctctttcattatacgagttcttttaactttctttctttagagcatgttatttcattaagtcctgtttatctggtgtgtgtgtgtgagagagagagagaaagagagagagagagagaaagagagagagagagagagagagagagagaaagagagagagagagagagatttatggttcttttttctagtttcctgctgaaggactatacttccagcttcccttgtggagtatggaggtcatttctgcccagttctgccctgtaagggagcgcatgccatccatcttccctgtaggcattttgcccttggcacacgtgggtgacaaggttcctccttgccttgaataagcatggccccgcctaagatcagaccatgcctcccctttcttcttccagctaagatggtttttaaaacaatcttaacagctttagtgtcacatttataaaccattgtctaatccaaggtcataaaaccttatccctactaagagttttagctcttgcatcagggaatgtgtttttaatgagctgtcaacagcagccagccagagagtcgtgtccattagggagtgtgtggtcctgtaagatgccaaaacctctgctgcctcctcagcttctctgtcactctagctgagtgggaggggtcacacttgactcctgctcctcaacgtgtccacgcatgaccactggaatgtcctcccagtaagtctttttgtccgtctgcccccgccaccccattagctttccctttagaccgattctcactgtgtagtccaagctgacctcagaatacagagcagtcctgctggctcagctcccagatgctgagagtacaggtgtaaggcactacagccagctgcaggcagctctaagaacattgtccttcagtcttgcccagcagagccctgaatccatgcgctcttggctcacacacacacacacacacacacacacacacacacacaaacgcgtgtctcacacatgtgcacggaaacgtcacacgtccatgaacatcctgaccagcagtctcggtgcttaggctctcaggggtcagatgctgacccctggacacataattgcacaccagcatcactcctaggtgtctctccagacagctccagctgtgggcctctctgaagtgaatcagatgtaacacttaagagtacatataacacagcattgctcgcctgggagactgagctgtacccagtagcgggaataccgagaagagtgacagctcaaagcagggctgatgtggtctagatggttccgaagacaagaactcagccgggcagtggtggtgcagtttctgagatccaagctatttgcatctgacagttttataaatgtgcataatggatttcagtcgtctttacccctttactgttagtgtttcaaatctgctccatctcaccgagacccttcttcttccatagaagtcccccccattttcatgtctattgtgtgcatgtggcccagtgagtttagtttactctcatgaggatgggtgggaaattctttcctgaagcatgggctacaccactgaagaaagtcacagcctctccccaagctgccattgactggcaatgccctgtaccactctgcatagtcattcggctgcaatgagttcatgaacacagtggccaggagacagctttttatggtatgctcccccttctcagtctattatgtttttttccatccccggtcccacggtattccttggatgggtgatgtctatgtcccaatcgcaccaagcactccagccatcagtctttacctttaatcagaaattttgctcgtgcagaaagtacatgattcgtagcaccactgtagcgggctcacaccaagtgtccttgagagcagtgccaggtctggaaacagaactttctcagcacccagcaaacctgtgtgtcccaaggatgcctgcagtcctgagcaaagtttcttttctttcttttttctttttttcttttttccaagacagggtttctctgtatacccctggctgtcctggaactcactttgtataccaggctggcctcgaactcagaaaatacctgcctctgcctcctaaaagtgctgggatgaaaggtgtgcgccaccaccgcccggctcacttctctgtttaaacatatttctgcttgttccaaatgctttttgaactgcagccggttctcttctcgtgttcttcagctctgtgtgttaattttgtgttctgcagcattgctaagctcatttaacgaagcctaagagacttaaagaaaattccttagagttttctatgtaaagagtatgtcctcaacaactaagtgggtttactttttctttcccagtgtggatgcctgttattatttattttcctgcctaattattgtggctggaacaaacagtataaacccgaaagggagcaggaaagcagccatcgaatgctggcgtgcgtgcgtgcgtgcatacatgcgggcggacggatgcttgtaatcccagttggaggctgaggcaggagaattgcagatctcaggctacacagaatgaccttgtctcaaaaggaaagaaaggaaagaaggacagaaggaagggaggaaggaaggaaggaaggaaggaaggaaggaaggaaggaaggaaggaaggaaggagaggccagatgtggccatgctcacgtctaatcctagcactcaggaagcagaaaaggcagatctggctccaatcagccagagcccctgtctcaaagataagaaaaaacatgcatcttggggttcactcctaggataggtaggagtcagaagagatgagttatgctttttaatactcggaccttaaagaggaaatccaggactcttcacttccatcaggaggcttggggtcgtagagccacaatgtagattcaggaggctggtgtgtcttgaaatgacccagaaggaaccagcctcaaggctaaagacctttcccattctcagtcctctgagccccttctctcatgcagagtactttgactgaacaccatcaacacttctcgccccacagaagaagagccggaatgagacccacgggcaaggcagcggggtagagatcctggagaaccggccctacacagacggccctggcggctccgggcaatacacccacaaggtgtatcatgtgggcatgcacattcctggctggtttcgctccatcttgcccaaagcagccttgcgggtggtggaggagtcctggaatgcctacccctatacccgaacaaggtgcgtctgcctgcctctagctcctcagcatgccatctgctggaggaactctcctggcaggttcaactcctgctcccctgaaagtatcaaactctgtctcacatatgtcccctaatggttcccagttggtcacatgcaggaaagggaaggatgcccctggatgcctgcttccagaaatgccaatggagaacatacaggcaggaattgaacaaaggccgccatctaggaaacttcggggaataaacattcattaagttccatatgaaggtagaccagatggtccaagatctcccacctctggagtactcagctgctatagcagtgcttaatacatcccatagtaagcaggacttttctcagaacccagtggaaaaccccacgttttacctctcagtgctagcttgcattgaccaagggcactcccctctagcctcccagggcttcctccccacaaaccctacacctggagagtgctgggagctagtttagggtttcagagagctcttctctatcccagagaggagctgttctattgccagagtgggcttcgtgcaggtgtcatgtgccatgtgccaggagtgtctggcagacccaccaactctatagcacaccgctattgtagctgcgtgtacattcccaccaaaccatactcacatgggtacctttgtggggcttctagaagctactaatgaagttcataagatctcatccctgtctctctctccccaaagctctcttggccattcttaggacaagatggtaacacaggaaatagatttcactgtcacatctttagccaacacccccctccccccgccttcttattgacgtttctactgttatgaagagacactatgaccaaggaaacttataggacttgcagtttcagaggatgagtccatgaccatcatcacagcagggagcacgctgaggacaggcagtgatggtgctggagcagtagccaagacctttcaccttctccagaagcatgaagcagagagagcaagcactaacggggatggtgtaggcttttgaaacctcaaagcccaccctcagtgccatactgctgccagcaaggccacacctcctaatccttcccaaacagttccatcaactagggaataagaactcagatacatgtgggggccattctcagtcaacccacccggtgacctggtcaccttgctggtttccagtgtggtccctccagggtgcagtcccaatggatgttctttctctcaggttcacctgcccctttgtggagaagttctccattgacattgaaaccttttataagacagacactggggaaaacaataatgtgttcaacctgtctcctgtggaaaagagccagctgataacaggtgagcgtgaaggccggagctcagcaggtggcactcccacctcaggccactctggctgtggccctctgcccttgcctgagctcctcctgagagtgcactggattctcagcttgggggtggggcagagtgaggcaggacaggcttccctgcccttgatgtgcatgccaagcctgttggctttttcctccctgtaagtcctggggtgcatgctgtttgagaatgccgtgggtgggctggcccgtattgtattgtctgtgcctggagtgacctgtggcctttgctgctttacttcctggctgatgttactgtgcagaaggctgcctgcatttgttaagctttgttgttgttgttttagacaatatctcactatttagtcctcgctggcctagaactcacagagatctgactggcctctgcctctctgcctctctgcctctctgcctcccaattgctaggattaaaagtatatactaccatgtccacctaattcttttttaagagaagtcagagatggagattttcatatgaaatttcccaattcttaaacattggtaaaatgaacttaggtctgtcaaagcaaacacacccgagggcctagcctggctctgcagcctcctctgtggggtcacccctgggcacggagtggtgtggtgatttgcttaagtgctggacagagcccatcctagagagaagcaactgttgcgtccagattctctgtcacctccacagtcgtcccctgtccccagcaggcaccccagtgtccctgagatcccacctcagtcgagcgccagtgctgcaggggccatctgagcccccagttctactcctttgtctaaaatgccaccctgctctggaaagattccaacaccctgtgtgcctcctcaccccactgttcttcatgaaaaccctcttccctttggttcactggctcacttaattgcactcgtagaccatgatttgttaagctgacttcagaaaaagccacaagacccaggccaggtagtatgatctgagatggaagaataacaagttcaaagcctccctgaacaactttaagtgtataaccttgtgtcaaaataaaaagtacagttaggattggtgatctagctcaatcatagagtgttcatatagcatgacagcatgggtgaggtcctatgtctaatccccagtgacacacatgcacacacacacacacacacacacacacacacacactcatatatgatgacccttggaccctgtaaggacttagggtagaggatcagtaaagggtggctagaagttaggcagacgtgaccacttgcagggtgtccccatagacatcatcgacatcgtcaaggatcctgtgccccccagtgagtataagacagaagaagaccccaagctgttccagtcagtcaagacttgccggggacctctttctgaaaactggattcaggagtacaagaagcggctcctccccatcatgtgcgcctacaagctctgcaaggtggagttccgatactggggcatgcagtccaagattgaaaggttcatccatgacacaggtgagctgtgcctgcctgcctgtctgcctccattctccccgtgctgtgattgtgttctttcagtttactaagagatgaccctgtattaagtcagggcttcctagagaaacagagctgatggatgagagagaatgaatgaatgaatgaatgaatgaatataaacagggtttattaggaagtgtacaggatgtggtccaagtattcgaacaatgaacctgatgaaaagttcaagaatccaatagttgttcagtccacgaggctggatgtcccacctggtcttcggtgtacactggaatcctgaaagactaggctctggtagcaatgaagatatggacttgctagtgagactgagggcaagtaggcaaagagcaaaagcctttttctttcatgctctttatttaggatgccacaagaaggtgtaactccaacttagggtgggctttacatgggctttaaatggtccaatcaagaaaaaaaaacctgtcacagatgtgcacagctgcttggactttagttaatttagatgtggtcaagttgacaagcaagaacagccaccaaagaccccagagcctgcacccacatccctttctccactctgccttggccatccaggaccagtatgcctgctgtctctgcagacacctcatccactgctcagaccttcctgacctggctgctgtatgatagcatagcctgcaccatactcgagccagaagcctttgcagacaagccccacccaccccccatccgccactggggcctctggatcctaggctgtccttttctctacctgagggggcccagactttagctgggccatagcgctgcctccttacaggctagaacatccagatggcagagcggctcagatagagtgcccttcacacccgcatggcccttccttccagagcaggtgtttaaggagcaggcaggctagcagatgctgggggctcccagccaaggaatgctgcccagggctttccttctctccccttggagccctggactcacaacttcccaggagcacccaggcagtcacccgaagacaccaccagccagggagacaccactgacagccatgctccactcgcttcatgttgactcagggttacccatgatagggaactgtcgccctgtttatagaggacggaatgaagacctcacacagactggacccagaatagacattctcaactggcagcggaggtggcattagacaaccccacgcagtgtggattccagagattgtgaaaggcgtttgtgccaccagcggagtgctgggctctgaggagggcacctcccacctggaagggcagaaatgacgtgtgtacaacagccttgatagtaaggggcagtctctccagctccgtgtccagggcagcatctcagacacattatcttctgctcccttcccagctggcttctgcagggcccatgacagttcagcaaaggtggcaggagacagatgggatttatctctgcagtctgcccaacctcatggtagctaagactgacccaagaaacctccctactacctcccctcatctctaactctgagacctccagccaggaggacagtgtcatagaggcagcctgggtatcagtcagcatgcccaccccactaggcgggcctcttgtctgtagttttgaacacaggcctcatctcataggtgacatgagagctgacaataggactgtggggctgccctggccgtttcctgtcttgctggcttgtcccacctttactgtaatctctccagtgtggcccacttggggctcctggttctggagatagtggttcccaagatctgtgggccccatgccctctcctgtcctaaggtaatccctgaggttctgacaaaacccagcttcctaaaagtcacctctctccccagaaaggaggacaccatggttgttaggacagctgtgacatgtagttcccacactgccatagcagcatcaatgttgcttctctgagtcccatcttcttatctgtgagggggtgtaatagtgccagttctgcagagttattgtggggtgtatcttggggtgcaggcctgtcggcagacatgacaccaccctgtcgaagcactgtgagcaccagtgtactcacaagtagccttggagaagtcactcccaaaccgctctcaaccgtaaggtgcctgaccccagctgtagtgcagtgtcccatcccagccagcccaagaggaagtctttccctggccgtgagcccaaaagacaggcccagaaaagcaaacagaagcttccttgtgctatctgagaccaccctcgggtatagtcagggctggctgacagagagcttggtcctgttccaccagcaaacagaaggcccacaactggactctcagagtgactgaaatcagaaaaggaggcatgggatgtaagcgtgggggagtggggaagcctgaggacaggccagagtgcagcctcttggaaggcctcctagaattctctgagaaagcagaggacacatccctgagacccagccatcacttctctcaaggatgctccctagaggcactcatgcccatttcaaaatgttcagggccacaaaatagaaaattatacatatgagccaaagaccccactagcagggaaagaacaaacaaacaaacaaacaaacaaaacccagtgtttcaaatgcatccatcctgtgccaacccctcatggagagcacacaagggtgtgggaaaggtgagcctcagcccgagaagcacatggcagaaacacagcccagcacatacatgtacatatcaccagccagaccattccaacacacgcgcagggaacacagctgcacactaagcccaggaacagagcaaccgacaaacacaaaaccaggaccagtgctgctaagcagcaaggagtcccaggtggggagggataaccctgacgctgggaacacggctgctttgctgggtggtgtggacatgaaggtttactgtctgttgtcctcttttttaagtccatgtatgtgcatgtgtgtttctgtgggaatgtgcatgtgagtacagatacccacggaagcaaaggaagacactgggtcccctgaagcctgggttccaggtggtggtgaccagcctgatgggggtgctgggaactgaacgctcatgttttataaaagcatgctgaggtcagaggacaacatcccgtccacagtatgggttccagggctgttccaagtttaggaacaagtgtctttacccacggagccctctcgctcaccgctgtttgtctttgaagaagggtcttatgtgactctggcctccagctcagcagtagccaaggatgcccttatgaccatgagttcctacctccacctcccagtggattagtgtgtgccgccacatccagtttgttgttgtttgttggtttgtttttggtttgggtttttggtttttggtgttttgatttcagatgggattttcctgtgtagctctggcagtcctagaacttgctctgtagaccaggagaggctaaaacctggagatacgcctgcctccgcctcccaagcaccggaatcaaagatgtgcgctggggctcgagggatgactcagtcagtaaagtacttaccacagaattgtgtgcacctgaggttgaatcccacataaaagaaccaggctcagtggtacacgccattagtccaagtgctggggaggtagagacagagttctctaggttcaatggaagaccccgcctccaaaaataaggtagaaaaatgatagaggaaagaacccactgttgacctctggctttcatacacacacaccacagagaaatagacagagaacgcaacccattttaaaatctcatcttctatggaaaattcaataggcaggagacttttgggaaatctgatgccacttcccttagaggcatgaatcccctacaataaactgtgacctctgaccaaagccttgctctccaggtgtacagccattgtgaactcctgagaccactgggacccagttctctaggttgacaataagaggaacgggaggcactgatgatcagtgactctagtctgacctacagctttgccctggtgcctactgcctctgctatgagcttcccctgtcctctggctctgttgcaggtctgcggcgggtgatggtgagggcccaccggcaggcctggtgctggcaggacgagtggtacggactgaccatggagaaaatccgagagctggagagggaggtgcagctcatgctgtcccgcaaaatggcccagttttcggaggaaggcccctcagaactaagcaaggacagtgccaccaaggaccaggcatctggaacaacctctgatcctggcagcaaaaacggggagcctctggggcggggcctgaagaagcagtggtccacctcctccaagtcctcaaggtcctccaagcggggaggtaagctgggttcctgccttctgatgcaagcaaggccttccttcccagtttccaaggtagccaggccatggctgtgtccccgttgctctttttctttcctgtgaaggttgtggagccacttttcctttctaagtggtaccaggtgggtcttccccgtgaagtgaacccagccttttccaagcagcatccccagacttccctataagccccaaacagtctgtgactgaggaaatcctgggagtaggtccaggtagacaccctcccccttcccagtgagagaagatagtttcagggtatcagactctgggcaactagaggaagcatggtgtagccagtcatgcccctggaaggtgcccccaccgtgagtggccagttgtgcccctggaaggtctccccatcccgccaccccgtgagtggccagtcttgccccttccaagcccaaggtgccctgggcttacagtgtgggatgaggtgagtcggtgcctcggtctcccttcccttcctactgccctgcagccagcacttatttgtcatctctgctgtggtcaggtttaaggagttgtgtatggtcaggtacagggctcatctgagctcctgtcctaagctcccaccctggacaaggatgcagagttcctgaggcaccaggccactcccctcccccagaaagggccagacagttctgctcaggtggatcctggacactccaccctagtctcttcatttctgtctatggcaaacttctctggtgatgcccacccagccctccaagatggccttactgatccctacttgctgtggctggctcaacagagccctcctctgcaggccagaccatcacactagggttttgcctttcagccagcccctcccgacatagcatctcagagtggaggatgcagagtatcgccagggactccgacgaaggctcggaagaggagttcttcgatgcacatggtaagcaggccacccatacagctggtgggctcttcctgggtcaggtgggaagaattgtcaaaggatgtgaagcacctatttctatactgttcctgttacctgtccccacgctatcacagcagacagcctggggcttgggggtagagtacatcgaatgacactggaaagccaccactcttgagtctcggggctgaattataagtcaggactcaaagcctggaaggagggtgccattctcttgaaccccacctcacatggcacacagttctactgaagcatttcccagatgaatttatctccgtaagaaatatgacttagtcctcaatgtttgtgcttggtttattgtttgttattacttttcttcattaaatgcaaattaatatgcatctaatgtagatgctttagaaaaagcaataaagaggaactagatgaactgcctatttcccactaatcgaaaaatacgcacaacggcacacagccaattgctcacctgtgctggaagatgcaagcaccacctggctcacatgggaccacaaataagctctcatagaagtcagaggagccagcagacaggcccagaaaccacgatgggcctcagtgcatgctggcaacacagccagccccagatcatgtgaagggtagaagcttagaacaatgggaacaggccacaacttaacagcaagcttctgtcattctgccatctcttggaggggcataggagctgcccgtggcatcttaattaactgcgtagccagactgtcagtgagaaaacttggagagtcagtattcaacaacaacaacaacaatgcggttggttgacttgtcctggaattaaacaacccagaaacgggtggcaggagatcctgagccaacctctgcacttgaaggaacagagaagggtgtctttggtgcctcacccctcttagctggcactttgtccttaaaagaggaaatacatacctgtcattttgctaccgctataaatcttaatgtacatgcctgttattcggggtatctgatatgcggcccccgggttgagaaccactgctgtagggaaaaggcacagctcccacagcagcaggtttctcagatcccacccaggagcctgtcctcagcaaagcaaggagaaggccagcctcgtgccgggcagctggggtcctgggcatagttctagaggagcagaaacgggagtccaatcctgggtgacgcagtcacagtcatgtcctcactgacctgggatttctgaatctcaaacctcagctgtggacagataaacaagggctctgatagatccgtaaagggaaggaaatagcacccttccctgcagagcaggtacgacctcaaaagcacagcactgtgagaactgtgaggctagccgcggaagacattctcagtgtgtgactgtcactgagaatgtccagacaggctaaggcctcaaggagaacaactcatgctgtgaggcccgactgcttgggattgagctacggggtttacattcagggtgatgagaatgttctggaattagatagtggtgatctctgcagcatcatgaatacactaaatgggacagaagggtagctggtctgcagctgccggctaagatagggaaggataaggcagagctgagaatgctgggcgcgtggactccagaagtacccaagtccttcttcctccccagagaacctgtactgcacagaggaaaaacaagccaaggacatgaccaagtggaactccaacgacctcatggacaaaatggagagtccggagcctgaggaatcacaaggtaagcagcgttggggaggagggtgcagctcacccctgtcttacccaatcaccgcacagtggtgggacacggggacttgtagcattcctgagtgcctgctgttacagtgtggcctctgtgttgcagatgaaatctaccagcagagtggctctgagttcagggtggcctccagcgtggagcagctgaacatcatcgaggtgagtacctaccctgagaccgaggctgtgggcaggggccggtgcaggctccagaggcagagctctccagagccttgcatccacagagaggccgggggtcccttttttatggggacagcagacagcctccaaggaaaaccttatccaagttccacctttgggaaaataaaatgaaaactttgtaaattccagaaaaaaactaagacctacaagttcccatactgtctctggcacaagaagacaaaaccaaagaaggaaaagtaccaagagccgcctaggcagaagtgatgtggctgtggcccagggctgcgtcctgccaggcagaactcagtgtgaccaataaagctgtctttgtagagcctgtgtccgcttcaggggttctttgctggacctcacgcccctcccacctgcaggctgtcagagctgtttgcactggggccggagccaggctgggccacagttgtgtcatgctatggtcatacgcactgccctgctctgtctccaggctgcccaaggtggagatagcacctctgtgggaactctgcccctcctcctggagggcctgggagaggcaggcacacctcttccctgcctgaggtcttctgctttgaggtctgaggtggaggaggacttttctagaagggtgagggaatggttgtcagttgctgcttgatgttagacaaagcaagcagaggccctcccaactaagcgcacacagctctgactgtccccaggagaggggcagagcccgaggctcagggtctgccttgggatacgcagttagaggagcccagcactgcttctgggccactgccatcccaagtcagaccctttgcccatactattaacccccaaactggaacctttcttcatgaaagggtggcttggtagaagtctggggttgccctggccctccatcctgctggcttcaccactcttgtgagctctgcttccactagagtatagggcagggggagctgctgtctttggctgagtgggagggagtgagaaaaaagctgtgtttctgggcctgtggtcatccctgaaaggctaaccagtgaggggccgagccggattagtgcacaaagggtagtcccacctattcccaggtgacgaggttgcttttatagacatttttccatagccttctgcccactgtattggagaagcacctatacttgatcatgatgggagtggctgccattccctgtgcccaggctaccctgtggtgggcgatccctgcatgtgtagttgttcctaccccagccccaggaagagagcaagcccaagacaggtatcatcagggacgagtggagccttcagagcaagactacttccctagccctgactgctcccaatgacccctatgattccagaccagcattgcctgactgcttgagtcaatcccaacctacacctaaaagcagacacttagcaggcatccagaggcccagcagctcaaacagaagctgctgcctgcgaccctgaaggtagaactggtgatttctccagaagatacccttccttgagtctgttgtgaccctggttgggctacatcactccatctccagtctctggtccttgcaggggtccaagggaaggactgaggcagtgaaccccagaccctataaccagataaccaaaatccaggtctctcaggctgggaatatagctcaggggtagaatgcttgcccaccacatgtgtgagttcctaagttcaattcctagcaatacaaaaaaaaaaaaaaaacaacaacaacaacaaaaaacacttgggcacctggggcctggcaaggacttcatgcccaccactgcccatgcaggatgaggtgagccagccactagccgcgccaccctccaagattcacgtgctgctgctggtgctgcatggaggcaccatcctggacactggagcgggggaccccagctccaagcagggggacaccaatactatcaccaacgtgttcgacaccgtcatgcgcgtgcactaccccagtgccctaggccacctagccatccgcctggtgccctgcccacccatctgtgctgatgccttcgccctcgtctccaagtgagtggcacatgctttgccagcacccaccatgccccacaggaagaagcagcaacgccccatcccccacctctggccctgagcattgcatggctccccggtgtcaggtcctttctccagggtgtcctttcccaccacctcagtctgaaggcagcagagcccatgcagacaagataaggtcagatcctaagagtacagtccccagctgagtccgcagttgaatgttgtagagtggaaatgctggcctgccttgggacatgagtctactcagtggccctggcacttagaactgcccttaggagtctccatgggttctttggggcaggcagtagctctgctcggcctgtttcctagatcaggggagggccattgggtcaagctgagtttacctgccctctgctgacccagcctctccccaccccccacccccccagcctcagtccctatggccatgatgagggctgtctgtctagcagccaggaccacatccccctagctgccctgcccctgctggccacttcctcaccccagtaccaggaggcagttgctacagtgattcagcgggccaacctggcctacggagacttcatcaagtcccaggaaggtgtgaccttcaatggtcaggtgagtggcgtcaggggttagggaaagatctttcagggtgggctgaccagaggaccaaattgtggggggcagaggggtgcttctcctaattagcaacccggcaagcagggtgaagactcaaacttctgccttttttacctacaggtctgcctgattggagactgtgttgggggcatcctggcatttgatgccttatgctacagtggccagccagtgtctgagagtcaaagcagtagccgccgaggcagtgtggtcagcatgcaggtacctgagcgggggcagagggtggggcaccctttggtcacaaacctccactcaggccagcagtctctcatattccatggagactggctgcctttcctgatgcaggccaccaagccatcatctgacctgcactgtgtcccacaagcaatgtgcccagccaaaaccccaagggactgactcggacaccacagtccttgccctctctatcgtgtcattcaacaatgtccaaagcccatgaggcccagcaggagttcccctctggagcaggagatgagagggctaggagacacatggccagtatatgcgctgggtctcaggctaagtcagccgcagctcaaaagagctgaaagtgtccctcagcatctcccaggagacaaatgggaaggtcaaaggttgctggtgtgggtgaccacaggtggcagtgtgaagcttggggtttggtgaaccactgcagtttgtccaggagagcacatggcttcacacactaggctctgcactgcgtggcacagctctggtcctaggaggtgagatggacacaccctgttcccctttgtctcaccctgatgtcttctgctgtagagtggccaccacctgggagagatcactgtgtgccaagccagttccggactgaaggctgctaggacttagccagtagtctgaggggcagtgggagacaagactttcccctctagttgggtgagaagcctgcagccaggctagtggccagcagggcctgcagtcagagcactcaagaagggcctaggccagggaccacctggcagtgagcctccgtggccattccaggacgctgacctgctgtccccgggcaccctggcgaatgcagcacactgctccggtggcagtggcggtggcggcagcggaggctccagcctggagagcagtcggcacctgagccgcagcaacattgacatcccccgaagcaacggcactgaggactccagaaggcagctgccccgcaaaaggagtgactcgtccacctatgagctggacaccatccagcagcaccaggccttcctatccaggtagggctggctgtaccactagggggagagaggcccagcatgagggaccaggccactcactccttcaacagtcagatgccaattgcacgtgttgggttctgggcattcctatctggagggcttccagtttactgggtactgtggtcctctatacaacaagggctatcctcggctactagaaacacattgtcctgagggtgggggcaaggtgggggcgagcagcatgaagcagtgggctcccctgaagagcctgtgatatgctgtcattaggattgtcctagtaggtgctgggtagccctgatctcaggacagtacagggcctagtccctaagggagccctaggaagctgaccctgggtgacctgcacgtcccccctctgcagcctccacgccagcgtgctgaggaatgagcccagctcccgccgctcaagcagttccacgatgctggacggtgccggggccctgggcaagtttgacttcgagattgccgacctcttcctcttcgggtgcccgctggggctagtcctagccttgaggaaaacagtcatcccttccctggacggtaagaagccgcagggagaggacaggctacctgagctggacgggggcctccatggaccagtcacaagggcctggtcacatcccagccctttcaacatctctacccaccaaaggcactgtctgtccctccctggctcttcagcagctcagccgcctacccatcccctgaaacctgctgcttcgtatttctccctctaaggtccctgaagcagtggggatgcacagcagggtcagggaggtcagataaaacacacacagtctctggtatggggtccacctatagggacagatgtggccatagtgcctcatggtccccggcattgagaggtggggcagtgtccaagcatcccagtaatccctgatctctgccagtattcaccagcacagccccagaggtgcacgtgatccccacagtagctgttatatccccagtgtcagagaggaaacaggctcagagaggctcagacaggccaagagcaggtgaactatggggccagattaaaatgaaggccctatactcggtgccccaccaatgcctctgctccttgtctacaaggtagaaatggcagctctgttgctgaggggtactctacaactgagcgttctcccagggagcaggccttgctcagaaaagcctcccagcttcccatgtacatgcagaggacattctgtggtatccccgccaccccaaggaagaattaggtgggattatgcgtcctattgtgaaaaggccaagttggtgtgtatcctgtgggtgtggattagaagggacgcctctgcatcccagggaaggcacctgcttgacacagtgccaggccgcagcctaggagtgggctagcactgctggggtggccagcctgggcaagcctatgctacctagttgaagatgcacgcagagcctcacaggggattctgggctggaaggagtcccccaccctgctgtccaacacacctcctcagtgcctgaggagggtgttcctacctgtgtgactatcatctttccaacttaaaagaaagattggaattgggcacagtggcacacacttgtaatcaccacccacaggaggctgaggcaggaagagctcaatacaagcaaaggctacatagtgagaccccgcctcacaaaataaatctattaataaaggaaaatgatccacacagaccccaaattgatgaaaacacaaggcaaaggcagcctgggccccaggccccccgcccactacctaaagtctctctctgcatccccccactcccagttttccagctgcgtccagcgtgtcagcaagtgtacaacctcttccaccccgcggacccctcagcctcccgcctggagccgctgctggagcggcgtttccacagcctgccgcctttcagcatccctcggtaccagcgctacccgctgggggacggctgctccacactgctgggtgaggctttcaggaaggcgggcgttggtttctaagtggggggataactgctttctatgctatatagcccctgacatacagtgggtctctgctcaaagggaagccgaggtagacacctgtccacagtgcacatctgcagataaagaacgaggtgcagctgtagccgtgctccccacccctgtggtacagatgtagccgtgctccccatccctgtggtacagatgtagccgtgctccccatccctgtggtacagatgtaacagtgctccccacccctgtggtacagatgtagccatgctccccacccctgtggtacagatgttccccatccctgcggggcaagagcctcctgagggctccccagcaactgccagggtcatgctttctcccctactgcccagggcctccaacctaacagggaaggagctgaggcccttctgcaagctggggaccttgtagcctgggttcattgtggtaggcagctgcccagagatggctgggagtatgggaggggctgccctcagaatggcccaccccctgctgcagcgtgtatcccctggcatcttgtcgtcgtgtcctggtcctcaaggagccttgtttgtgtcagcacatgtgcagatggcccacttgagtgtctgttcttgtcctctgctctcttcccgtctgcctccagtcgagaccgtgcagagaaacccagagctggtcctggagggcggccccctggcccccctcccccacggggacagcttcctggagaccagtatccctgttcccgcgctcacctggcaggatgggccccgccagagcctgggctgttctgagtgtgtgtaccccccactcctagtgactgatgtctgcttggctgccaccccttggcccactaccctcctcatgccctctctggccactcagtctgtgggactttgatagcaatgacatggccatgggaagttagtcttggtgactccattctgtaaatgatgatccagaagctgagacaaccctcatacacagtagtcatggcttcccagagatggacagaggctgtccccctgtcagacagcatgtgactttccaaggcttccctttgacctttctgaggctgcagggagcagacatagagtggggtgaggcctcaggcagtcacctctcagcctgcagctgtgttagcaaggagctggggcctctgggtctcagtccttaccttcctgagaatgtgcaggcctgatatgtcatccaaactggctcctccagctgacccctgttctgtcctgcctgcaatggaccttcagcacctgcctttgtcctcagatgccatcaggggctggctagagcctatgtgtgtggggggggcgctctggggtcggcatccctggaaagctgcccaatgcccctgcccaaggtcatgctcatattctgtgggctgctccaggatagtccaagagagcatctacgtagccaaacctggaaaagaagtggccaaggagggcaggaacccattccttgcctccctaccccatgtctgtgtctgtctctgtccacccttctctgcccagccctcccctccctgcctcagctcaggcccttcgctctcaagaccctaaaccagctgtaccctggtgcacgctgggcccagcaagctggcctctcccatcgctgggagacctagggtcaggccttctcttacctgaatctctgctcctttctccccacagcggatgtgcttcagacccacaacacagtcttccaagagcatgcagccccctcgtcacctggcacagcccctgctggccgtggcttccgcagagccagtgagatcagtatcgccagtcaggtgtcaggcatggccgagagctacacagcgtccagcatcgcccagagtgagtgggggaccctgggaagagggtgatagatagtggtgtctatctggcaggaagtgggtcctcaccctgcagggccaggggacttccactacagtgccgatcagcagtgccggtctgtgctgacctcactgggagggtagagatgaggctctgccggtgagcagctgggtcaagtctgggactgctgtagggatggctgagacttcagctgtcttaaggggcttcctttgatgggtcctggctctaccccaatatcctgcctggtctgctcccactgtaggagccctgggtgtgtgcgtgtgtgtctgaatcataccccttgttcttgctcctcagagggtccctcgtcgctcaaccacacccccagcatcaggcgcctatccttgctcgccctgccccccccatcccctaccacccagggtccccgtgccagggcaaggcaggtgagccccaacctggagcgggccccctgcctccctgacttggacatcggagaaggtaccccctccacggcactctaactccactctaactcaagagcattcaccgctgccaggcttgtctcactagctcactactaggtcccacctgccacctcctgctgaggctgacaggagacacagctttgggtgggaggagagagcaggactgcctagggtgctgtcatgggcagaactccggggagctaaggccgtgaagcaggcaccaggcacggctgtcccaagctctatctcccttgagagaggacagagttcctctgtcatgaaggctctaggcctcactactcaccctgctacctttgcagcaggcaaggcgtgggaaaaaggcaacagttacctggagattctagaattgtcaaaccaaggtgtctccaaccttgggagcaggaagaatatagagaacctgcacagggtctagggtaggggccctcctagatcacccacactgagtcaactcatcctgctccagaaatcctcacgcccctcagcactgccacagagctgcatatcccccacagcaggctgcctgtgggcatcttctacacttacccgcttgcctgaactagcctgagagaaaacccgctttgactgcacccggcagggagggggaggactagtctgagatgaacaggcctgcgtgtcaggtgacccccttagagtctccatccgggagccccacagggcaatcacaacccttcctcctggcagttgctgccaagtggtggggacagaagcggattgactatgccctgtattgcccggacgccctcacggccttccccacggtggccttgccccacctcttccacgccagctactgggagtcaaccgacgtggtctcctttctgctgagacaggtacctactgcccagatataactgggccgagagagtgcaagggctcctccctgtcccatcaggccaggcgcctggcacccagggcatgctgcttgagtgtacatattcacggcaaagatgggagctggctgcggctaggatgggcaggcgagaccagagggtttgataatcctgccgaccctgccaggtgctcactgccagcccggggggacggctggtccctttcccgagcagccgcccgggtctgagcctgccctatggcctgcctctgtcctgcaggtcatgcggcacgacagctcgagcatcctagagctggacggcaaggaggtgtccgtgttcacgccttcacagcccagggaaaggtggcagcgcaagaggacccacgtgaagctgcgggtgaggctcttcccggcgctcaggctcacagccatcatcccatggagtcccgtgccatcaaaagctgtgtcccaccgccgagctgtctcatctgatcagtgaggggagagtcgggagctgggagggaagagaggacagcaaggatggctccctctctgcctggcctgactaagttgttggctggaccacagcatgggctcaaccccccagtcccactcacagaggtactaggtgagcccagaagaccctgcctctccattcctctcctcacctcaccttgcccttccctcccctcccccagaacgtggcagccaaccaccggatcaatgacgcagttgccaatgaggatggcccgcaggttgtgacgggccggttcatgtatgggcccttagacatggtcaccctgactggggaaaaggtgaggatgtggctccctgaggtgacccaggggtaaggactgaggccaggccatggcccatctgtaaccagcttccctgggctccaggtggatgtgcacatcatgacgcaaccaccttcaggtgagtggctgcacctagacactctagtgaccaacagcagtgggcgcgtctcctacaccattccagaaacacaccgcctgggggtgggcgtctaccccatcaagatggtggtcaggtatgtgtcccggggtgggggggcacgcagagcagggccagcctcctgggtatagnnnnnnnnnnnnnnnnnnnnnnnnnngtgaaggtgagagggagggagggagggagggagggagggaggaaggtagagggtggatgctctggcctgttctgacgagttatccttgacaaccaggggagaccacacattcgccgacagctacatcactgtgctccccaggggcacagagtttgtggtcttcagtatagacggctcctttgccgccagtgtgtccatcatgggcagcgaccccaaggtgcgcgccggggctgtggacgtggtgcggtgagtgtggcggtcagaaggtgggtggcacccggtgccaccactgactggtgtgcccttgaacaagctgttggcatgcccgatatcaggccagttccgaggatgccccctttgagggtacctaggataaccctcccaacaagctcagtgccgtcgaggctttgacactgccgtgcaccctcagtgctgctggccaggttatactctgtatgcagtgctaggcactgaacccagggcctcactcagacaaggcagtattccactctttgagacagggtctcaccaggttgccttgaacttgctatcctcctgccttggcctcatgagtatctggggattacaatcagggcagcctgggcacaaggctcagctgaagaggcattttacagtggtgcaaatgagctctagctgggcaagaaagggagactgggggaccccgggggggggggtagggggaggaggaggaggaggagagcagccacgggacaccacgcctgccccttgcctccacagacactggcaggacctgggctacctcatcatctatgtgaccggccggcccgacatgcaaaagcagcgggtggtggcatggctggctcagcacaatttccctcatggtgtggtgtccttctgtgatggcctggtgcacgacccactgcgcccacaaggctaactttctgaagctgctcatctctgaggtggggcttgggaggactgggtaaggaggagagggctggaaggcccggcccgtgcccatggttgtctcatccacagcttcacctgcgcgcacatgcggcctacggctccacgaaggatgtcgcagtctataactccatcagcctctctcccatgcacatctacattgtgggccgccccaccaagaagctgcagcagcagtgccaggtaatggggcacagtgaagggcacacattccttggggaaccccaggacacttaacagcctgcccctgtcactcctttgcagttcatcacggacggctatgcggcccacctggcccagctcaagtacaatcaccgggctcgcccagcccggaacacggccacgcgcatggctttgcgcaagggcagcttcggcctacctggccagagtgacttccttcgctctcggaatcacctgctccgcaccatctcggcccagcccagtgggcccagccatcggcacgatcggacacagacccagatggacagcgagcagcggggccagcgcagcatgagcgtggcagccagctgctggggccgagccatggcaggccggcttgaaccaggggcagccacgggacccaagtaggacactctcaggaggcgctgtggtctccatggtgctaggccagggcaccggccctcctgggaggcctggcctgggcacacacgtcagtggctggggacatgcacagacatggcctgagagcgacccagggccccttggaagacatggccatgccaacacagccctcccagccttgcctgatgccctaggctctaaggagcccagctggttatgggatctggcaggatgtccagcccatgatggaagaggagccaggatcggccgcctagcccagcctgggaggcattcctgggcatcttgctccgtgttgatctctcagcctcctggtgccaggcgtgggtctgggccctgcctgccacctctctgtccactggcgccccttcccatttggtagcggctccaatgggtccagtccacttcttgttgactccagttctcaactgtccaacctcactggttttgcactagtttttgagagtggagacccgttaccatctcctggctccagacatgttgacatgcatgaaaatccagtctctgctgacccaggccagggcctgtcaccacacagagtagtccagtgtgggaaatcttcacgcaagcaggagagaaaggccatatcgtaatttctgctgcctgcccggtctgttgacaccacggcagcccagtggcagtcccagactgctacccacccgtccacctgccccacccagagctcagtgcagtcccggaactgatgtcactccgggctgtgagcacagcacaggtgtgaggccagccacgtgcacagctggctcttggtagcccaccttgggcagctggacctggagaagcctggcctccaccgacgctcccgcctgctcaggggcgggcgggggggggggtccccatgtcatggctgctgcccactgcgtttctacgcctttctacttctccatctggtttctataaggttttttttaaacaggcaatcttcggctgcttccttttcttaactcagtgtcagcgcagcctgctacattaggaacacccagcactgtgacagggccccactcagtctggcctgtgggccctgcacctggcccacaattccactgacttcctattctggggtgggtggggctcttaggttttcttaatgccgttcgtttaatgtcgactccaggaagccacagctcactctccagcctaagggcacacagccatcttattgctccccaaatacggttgggcatcctacacactgggtctgagcccctgccttccacacagcactgaccacacctctcctgcaccttccctgcattggctgagcccatggagctccagccctgggtccagcgatggggctctgtgcctgagtctgccaggccagactcagatgcagggccaagtggctgggcccaacaggtgtacaggagacactgactctgctgtgtagctgtgtacagcacaggcgtgtgggactcccgccatggcgggtctacacaagaagaaagctatttattttgtgcagaggaaaaaaaaaactgtctggaggggtgagaccttcagggtcttctcataaggtgtagctttgtgttgtttccagcgttctgtataaagcagtgattattttatggaccaagattccatggaactgtcacagtaaaagtgcaatatctgtcccaccactccccactgggggccccacaggaagctgctggcccgacaatcactgccccaccgggggtccccgggggccagggcctcctccctcagccccacccgtcttgcctcagcctaggtgaccagccattgtgagaagcacctggaagcctcaagccacctgcagtaaaggcagggggggcctgaggtcagtgggcttggtctctcccctgggcagccccttgtggctctgaatgcccatgcctgcccagctgtcagccatgccaaggacaacagcaatagtcccctgggctctcccagggccctcagccatagatggtgagacgggcagcctccctccaaaaccttactccagtctgctttttgtctcccttaagatttcctttggctcgttctcttgaggaagccccacttctacagaaagtaagagaggaaggaaggtcaaagtcctttaaaaataccaaaaaaatgtttacagtgtcaggtgctgagctgcagggctcaggcctggccatttgtaaccaaagggtgaggcagatcttgctggctgccacccaccccaggcctgttagaatagaagccttagtcagtccctccccatccccagtccccaggactgagccttgatgccacccatcaccaaccacctgccttctctttgatttctaaagaaggattcagccaagttcccccatcccctttcccggctctgtgtgagctagcccccaccctgccccgtttcaccttcacatctcagacccctcccatctgtccttgtactgtcttgtttctcccgaccattgtgtaaactgtgtcctgtccccaccccatgctgtctggccttagtgtgctctctgtataccgtgtcacagtctgttacaccaattaaagaagcaggaggcttccttctcgtctcattactgtggcggcacccatgggtctcctggtgtgtgtgtgtgtgtgtgtagggggtgggggatgagcatcatggttctgacagtatgtgtgtgaggacaccatcacagaaagtgacacatgctagccactggaacgtgagcctgacagcccttcccatgcacagacctggggaggtaggtctcctggcctcccccctccccagcggacacagccaataagccagagttggactcctacctgaccaggctcctgtctgtcatgatgtatgggacaggagacaggccacggcctgatgagctcgacctaaggaccaaggctgaactgggactcagccggggcaggggcgggctgggccaggtgggatcaattaaagagtaacgccaggaatcctgccagctttccccagagatgaacacatctctctccagaagtcaaatggcaacagttccactcctcagcacaaaatgcaacacaacaggaactctgtgaccaagatcatttaatagtgacactctgctgtccaatttgctgtccaatccactgcacccaagaggatgctgggctgtaggaaaggcacctggacctattagtctccaagtcaccaacagcagttcacaaacctgggatggctgagccctcagggaagtaggcctgttcgcatctggaaggccagcccatcccctcgggtggcttgctgaggaaggaaacaggtgggaagcgtgagaaacttacgtgtagatacaatgcgggcagagcacaggcagagtggtaccaccaaccttgttgatctctctgtgtcgttctttggttacgatttcctctaaaacctcgccgtctcccttgatgagcctggggggttggaggtcatcagcttagcacgagagagtctgggactctcatgccatagcaacagaagcagacccacccaaggaaagggatctcggggctcaagcccagctatcttgagaagggggtgcctgggcgctcctcccaatcagttaccgcttttgggacagaatggagacgggccaggtaggctctcccttgtcagcctgcaccattaacccagaccagccaacaacaaccatttgaaaagcatcaaggccctcctggtactgtaactcctcaagaggcacagggggtaacagctgggatatcacatctcaagtgactatttcccccacactttgttataaaaatggtgacagctccccaccagagcacatcctgggccaatattctgaattggaccgagggcggggctagctggctctgccttctgtaccacaccttgtgcgtcctgtctctgggtccaccacctttcgaataacgctctgtcgggcatcccactcctcctttgtcatgggtttcatggcctggatacgagacttctgctcatctgtcaggactggaagggaatgtggaggacgtgtcagacccagggagaggaccctttccccacagcatgctggcccgccatggtacctgggccatcattgtcctccccagctgatctgtgccactgatccagtgaggggccgggcagagcctcggcctggtgcaccgccactgccttctccttgactctcttcttcaacttcttcttccgtttcttcttcttcttcttcctcttcttctccttgtgcttcgctcgcttcttccggccatcactggaggatgaggacgaggcggagctagaagaactggaagaggaggaggttgaactggatcgcgatgtcctctgggccttgtgcttgcttctctctgtgatgcagggagaaggtaaggcctttgtgccctgctctagtggtagggaccctcccaatgggctctccaagagaacatctggaaccttcttttgggttctagaagtcactatgtgcctggcaggatcctgaccacgctcaacctcgaagacccaaagcattcaaggcatgtataaggcacaccctccactcaacagaactcttcacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctcctcagtcagagctccctaggggtcatgtcttttcctgacttcttctcttcctgggcctgctccactccaaaccctcagtacttcatctcaaataaggcttgctacagatcacctgtccaaagaatgacccaaaagtctgcgtgtccttttgacccaaggagtggcacggctgcagactttatttctgccctccctgcccacaatggcaagttttcagcatcaacacctctgggggagaaccaggctcaagtcaacacacagacatccactgtggtgggctcctcccgggtaaagccgtcaccgaaaccctcatcgtccaccagctctggcttctggcagcacatgggacagaggcgatttcgaacagcagatgcccgcagccacacgacgaggttccagcgctctcccttacacaggggccgagccccgtgcagctggccgccacggtgcaggataccagagcccaccacatgctccacttccagggtctccttcaaggctgcgggtgcctgcagaggctatggttcaggctggggcactcacacctgcccaggccccacctggtttgcctcactcacctggaagaggcccccaaaatacagggcaccccctgtgaagtccttgcccagagccacattgagggtaagctcagcattatcgtagtgacagcccagatccaggtcctggcccagtgcgtacttgaccacaaaggcacggtgactgtcgaggtagcccccaccgtagtctgggtacaacaaggccatcagtggcagcaggaagcgttcccgcagcggggtcaccagggggtcatccaggcctagttcatacatcagtacctaggaaggatgcccgggggcttcactgcacatccccatatctttgccaaagatgttgctaagggcaaaagctgtctgctttcatggtggtctttgggctcagaatggggcaggtagcctgcccgaagcatctcagaggagactcccacctgagctgcccccactccctacattcacagggaaggcctcacccaccccatggttgttcatggtgttgggccttcccttgggcatgtccgactgctcaaaatgctccagctcttccagcagggtctggcagaacttggccgagaacactggcacccgatagatgcgcttctcctctggagaaggaggggcaggtagtgaacccggagctgcgactcaacgccctcaggaaccagcctgtcatcttacggcctcaagcctgtttctgtttcctctgggcaatggggacagtgacttactgccctgatcctagctagatggtcagtgaatgaatggatgaatgaatgagggatgaattaatgaatgaatgaaatgccctactccaggccgattggtcccactggtcttcccagttcctcctatttttagactagaaatgggaggtaaagcactcagccttgcctggctttgctggcgcacgcctttaatcctaacactggagaggcagaggcaggaggatctctgggagttcaaggccagcttggcctacagattgagttccaggacagccaaggctacacagaaaaaccccgtctggaaccccttccctacaaacaacaacaacaacaaaaaaaatcacccagcctcccaaatctaagtatctcaagctccctcgacccccacccagtgccagctggtgatggtgccttacctgacactgtctccaaacgctggagaaggccctcaagatctgcgcctggggacgtactatattcagctgcagccataaactcgggggccagagcagcatcctgggagcagaacatgggtcagctgcgcaaacttagcccccaccagagcagcctccgcctccgccagcccccaagctcccaggccggcccggtgtacctgcagtgagctgtagacctcaggcctagccgggtggtaggagctggcaatgagagccttcctgacagccgattcctgtcccagcctgcggcggcgcccgacctcctgctcaagctgggcccgcaaaggcagttagtcacaaaccagagcctgtcacctccaaggccattgttcatgtgaagacacgaggcccaggaagaccaaagtgaagtgtaacctaggctggagggcaagtctccctatacttcttaaacctgacactgcccactgcaggtgtcaaggcgacctgacagctgaaataggggtgatggccccgtctgtcccactcagctgttgagagagggatgctgtaggcaatttagtctttctcgatcctgggccaggatctcggagtgggagtgtgtggaagcaggaacaggaaaagaaaggactaagaagtctttcagggtcgaggactccagagaaagggctgacggggtacgttacctcctccaagagttgctggaagtccttggaggtgacacaaccacggctgcgcaggagctacgagcggaaaggccagttagcgggagggactaacgtgaccctaggcgagggaataaacatctccgagcctcagtgatacccctccccccacctcttgtcacggagatgagagtgacagggtcaccgaaagatctgctaaaacttctgtccactgtcctccgcacgcgtgctctcagctactagggagctgccatcctgcagcgacaggccaggtgtgcacacttgggttgcacactcgggcaaagccattcctgatgtccgggcccctcctctcctgcacttgctgtcgcctcccactccaccctaccccgaccctcacctggccgtagtcacggcgcagctgatgctcgtcccggaagcgcaggtgcagcccgtagcgcgccacgtacaggttctgggagcagaagcaggcgcagcggcagaagcgccgctgggcggcagtcgccatggcgaagcggccgcgccagcctccgtagcgagtccttccgtaaacgtcaccgccgagggctccgcgccaggcagcaaggggccgctgacaattcttaacttcggagggtaacgaagactgggcaggcccgcgtagaaagacgtcttcccgggaagaggtggagggtgtccccagcacggggtacggacgagtggcccccgagtcacagcggggtgagatgggacggtcacaggacgtagacagtgcgggactcactgccctgtctcctactagaaatctctttgcggagcctcctgacgcaacgtgtaagacaggacagttatggattgagacaagaccgcggcgccagctgtacgggtgagctcgggttgggcattcaccgctcgtccctggaaacgctgcgtcacgtgtcacaccctgcccctctcctataggaggcagtgtgggcgggggagggcgtgtctgtggcagtcacgcccctcctcccggtcaagttcaggttatttttgttgaaagtttttactgggcgtgcatcctcacctcagggagtcgcagcgctcgctgtgaacacaaagggcatcacccgagcaggtctgcagagcggcgtggttcatgggcaaccaaggtgcctcgaaaagatgaagttgtgtcgcctggaactgagccctggcccctgctcggcttggaatgagcatggaaatggcagagttcttatcccagatcagctcccagctttccagcccccaccccatcacgaaaggtaccagcctgtcatcatgaaaccactaaggctcggggacgcaggtctggcccacgcatccagtcaggagctagctgggatcttctcacaggttgattgatggtgtctttgggctctctgttctgtttcactggactcttgacttctgccagtgccacagtgccttggtgactgaaatcttcatagtaacttttttaaacgtcctatattgatatttacttagtttacgtttacaaagtgtctttcctgaatatgattttaaatgctgcacgcatgcagtacccatggaggccagaagagggcgctggatcccccacggaactggagatacggaaggttgtgagccatcttgtgggtgctgggcattggacccagctcctgtgcaagagcagcccggggctcatagccagtgagccatctctccaaccacctcattccaccatactccttcctgttctttctttttttcttgcttctttgtaacccaccgcaatacataaaacaatagctgcaataatgccacactcaccagactcctccctgcccttggggggcggcggggggggggggtcgtcattcctttgccctcttcccctcttccatgattctccttgagcctcggtgacagggtgttgggagccgcgcccacattcgccgttacaagatggcgctgacagctgtgttctaagtggtaaacaaataatctgcgcatgtgccaagggtatcttatgactacttgtgctctgccttccccgtgacgtcaactcggccgatgggctgcagccaatcaaggagtgacacgtctgaggcgaaggagaattctccttaaaaagggacggagtttcgttttctctctctcttgcttcttgctctcttgcttcttgcactctgctcctgaagatgtaagaataaagctttgccgtagaagattctggtctgtggtgttcttcctggccggtcgtgagaacgcgtctaataacaattggtgccgaattccgggacgagaaaaaaactcgggactggcgcaaggaagatccctcattccagaaccagaactgcgggtcgcggtaataaaggttcccgtaaagcagactgttaagaaggattcaactgtatgaattcagaacttttcagctggggaacgagagtaccagtgagtacagcttttacgaggtaagcctggccttgaactttctaacgaaattcaagacagtctatcagaagtaaagtggaatatgtttggccttgaattttttctggtgttaggagcccttttgttccttttcacatgttatcaagtgattaagatagggcggattctagatgaaattcaggacaagctatcagaagtaaagcggggagagagagtaggagcaaagagaaaatatggtacacaaaataagtatacaggcctttccaagggtcttgaacccgaggaaaagtttaggtcaggtaagaatacctggagagagattagaagaaaaagaggaaaaagggaaaagaagaaagatcaattagcggaggtctctaggaaaaggagcctgtgctcatcgctggatgagctcaggaagccagctcttagtagttctgaagcagatgaagaattctcctctgaggaaacagactgggaggaagaagcagcccattaccagccagctaattggtcaagaaaaaagccaaaagcggctggcgaaggccagtttgctgattggcctcagggcagtcggcttcaaggtccgccctatgcggagtccccgccctgcgtagtgcgtcagcaatgcgcagagaggcagtgcgcagactcattcatagccccaagaaagaacaaaggcttacaagactggctcagggtctgtcgagagcttgggggacctcttaccaatgcaggcttagcggccgccatcctccaatctcagaaccgctccatgagcagaaatgatcagaggacatgttttaattgcggaaagcctgggcattttaagaaagattgcagagctccagataaacagggagggactctcactctttgctctaagtgtggcaagggttatcatagagctgaccagtgtcgctctgtgagggatataaagggcagaattcttcccccacctgatagtcaatcaactgatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctactaatgcctcaaatgagtattcagccggtgccggtggagcctataccatccttgcccccgggaaccatgggccttattctcggccggggttcactcagccttgcagggcttagtagtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 674 - DNA, 6618 bp, Mus musculus
ggatgctggcacatgtgtcttggtccctgactcccttctgtggacacactgatcattcctcctcctgtggtggagacgtcgagggagctgctcagatctacaggtcttcattgaattctgtcatggttgtctaaggaatcttgcctagaaagtccccacaagcacgcagctccctgccgcctggaaggcgtggactccaagatgatcataaaggaataccggattcccctgccaatgaccgtggatgaataccgcattgcccagctgtacatgatacagaagaagagccggaatgagacccacgggcaaggcagcggggtagagatcctggagaaccggccctacacagacggccctggcggctccgggcaatacacccacaaggtgtatcatgtgggcatgcacattcctggctggtttcgctccatcttgcccaaagcagccttgcgggtggtggaggagtcctggaatgcctacccctatacccgaacaaggttcacctgcccctttgtggagaagttctccattgacattgaaaccttttataagacagacactggggaaaacaataatgtgttcaacctgtctcctgtggaaaagagccagctgataacagacatcatcgacatcgtcaaggatcctgtgccccccagtgagtataagacagaagaagaccccaagctgttccagtcagtcaagacttgccggggacctctttctgaaaactggattcaggagtacaagaagcggctcctccccatcatgtgcgcctacaagctctgcaaggtggagttccgatactggggcatgcagtccaagattgaaaggttcatccatgacacaggtctgcggcgggtgatggtgagggcccaccggcaggcctggtgctggcaggacgagtggtacggactgaccatggagaaaatccgagagctggagagggaggtgcagctcatgctgtcccgcaaaatggcccagttttcggaggaaggcccctcagaactaagcaaggacagtgccaccaaggaccaggcatctggaacaacctctgatcctggcagcaaaaacggggagcctctggggcggggcctgaagaagcagtggtccacctcctccaagtcctcaaggtcctccaagcggggagccagcccctcccgacatagcatctcagagtggaggatgcagagtatcgccagggactccgacgaaggctcggaagaggagttcttcgatgcacatgagaacctgtactgcacagaggaaaaacaagccaaggacatgaccaagtggaactccaacgacctcatggacaaaatggagagtccggagcctgaggaatcacaagatgaaatctaccagcagagtggctctgagttcagggtggcctccagcgtggagcagctgaacatcatcgaggatgaggtgagccagccactagccgcgccaccctccaagattcacgtgctgctgctggtgctgcatggaggcaccatcctggacactggagcgggggaccccagctccaagcagggggacaccaatactatcaccaacgtgttcgacaccgtcatgcgcgtgcactaccccagtgccctaggccacctagccatccgcctggtgccctgcccacccatctgtgctgatgccttcgccctcgtctccaacctcagtccctatggccatgatgagggctgtctgtctagcagccaggaccacatccccctagctgccctgcccctgctggccacttcctcaccccagtaccaggaggcagttgctacagtgattcagcgggccaacctggcctacggagacttcatcaagtcccaggaaggtgtgaccttcaatggtcaggtctgcctgattggagactgtgttgggggcatcctggcatttgatgccttatgctacagtggccagccagtgtctgagagtcaaagcagtagccgccgaggcagtgtggtcagcatgcaggacgctgacctgctgtccccgggcaccctggcgaatgcagcacactgctccggtggcagtggcggtggcggcagcggaggctccagcctggagagcagtcggcacctgagccgcagcaacattgacatcccccgaagcaacggcactgaggactccagaaggcagctgccccgcaaaaggagtgactcgtccacctatgagctggacaccatccagcagcaccaggccttcctatccagcctccacgccagcgtgctgaggaatgagcccagctcccgccgctcaagcagttccacgatgctggacggtgccggggccctgggcaagtttgacttcgagattgccgacctcttcctcttcgggtgcccgctggggctagtcctagccttgaggaaaacagtcatcccttccctggacgttttccagctgcgtccagcgtgtcagcaagtgtacaacctcttccaccccgcggacccctcagcctcccgcctggagccgctgctggagcggcgtttccacagcctgccgcctttcagcatccctcggtaccagcgctacccgctgggggacggctgctccacactgctggcggatgtgcttcagacccacaacacagtcttccaagagcatgcagccccctcgtcacctggcacagcccctgctggccgtggcttccgcagagccagtgagatcagtatcgccagtcaggtgtcaggcatggccgagagctacacagcgtccagcatcgcccagattgctgccaagtggtggggacagaagcggattgactatgccctgtattgcccggacgccctcacggccttccccacggtggccttgccccacctcttccacgccagctactgggagtcaaccgacgtggtctcctttctgctgagacaggtcatgcggcacgacagctcgagcatcctagagctggacggcaaggaggtgtccgtgttcacgccttcacagcccagggaaaggtggcagcgcaagaggacccacgtgaagctgcggaacgtggcagccaaccaccggatcaatgacgcagttgccaatgaggatggcccgcaggttgtgacgggccggttcatgtatgggcccttagacatggtcaccctgactggggaaaaggtggatgtgcacatcatgacgcaaccaccttcaggtgagtggctgcacctagacactctagtgaccaacagcagtgggcgcgtctcctacaccattccagaaacacaccgcctgggggtgggcgtctaccccatcaagatggtggtcaggggagaccacacattcgccgacagctacatcactgtgctccccaggggcacagagtttgtggtcttcagtatagacggctcctttgccgccagtgtgtccatcatgggcagcgaccccaaggtgcgcgccggggctgtggacgtggtgcgacactggcaggacctgggctacctcatcatctatgtgaccggccggcccgacatgcaaaagcagcgggtggtggcatggctggctcagcacaatttccctcatggtgtggtgtccttctgtgatggcctggtgcacgacccactgcgcccacaaggctaactttctgaagctgctcatctctgagcttcacctgcgcgcacatgcggcctacggctccacgaaggatgtcgcagtctataactccatcagcctctctcccatgcacatctacattgtgggccgccccaccaagaagctgcagcagcagtgccagttcatcacggacggctatgcggcccacctggcccagctcaagtacaatcaccgggctcgcccagcccggaacacggccacgcgcatggctttgcgcaagggcagcttcggcctacctggccagagtgacttccttcgctctcggaatcacctgctccgcaccatctcggcccagcccagtgggcccagccatcggcacgatcggacacagacccagatggacagcgagcagcggggccagcgcagcatgagcgtggcagccagctgctggggccgagccatggcaggccggcttgaaccaggggcagccacgggacccaagtaggacactctcaggaggcgctgtggtctccatggtgctaggccagggcaccggccctcctgggaggcctggcctgggcacacacgtcagtggctggggacatgcacagacatggcctgagagcgacccagggccccttggaagacatggccatgccaacacagccctcccagccttgcctgatgccctaggctctaaggagcccagctggttatgggatctggcaggatgtccagcccatgatggaagaggagccaggatcggccgcctagcccagcctgggaggcattcctgggcatcttgctccgtgttgatctctcagcctcctggtgccaggcgtgggtctgggccctgcctgccacctctctgtccactggcgccccttcccatttggtagcggctccaatgggtccagtccacttcttgttgactccagttctcaactgtccaacctcactggttttgcactagtttttgagagtggagacccgttaccatctcctggctccagacatgttgacatgcatgaaaatccagtctctgctgacccaggccagggcctgtcaccacacagagtagtccagtgtgggaaatcttcacgcaagcaggagagaaaggccatatcgtaatttctgctgcctgcccggtctgttgacaccacggcagcccagtggcagtcccagactgctacccacccgtccacctgccccacccagagctcagtgcagtcccggaactgatgtcactccgggctgtgagcacagcacaggtgtgaggccagccacgtgcacagctggctcttggtagcccaccttgggcagctggacctggagaagcctggcctccaccgacgctcccgcctgctcaggggcgggcgggggggggggtccccatgtcatggctgctgcccactgcgtttctacgcctttctacttctccatctggtttctataaggttttttttaaacaggcaatcttcggctgcttccttttcttaactcagtgtcagcgcagcctgctacattaggaacacccagcactgtgacagggccccactcagtctggcctgtgggccctgcacctggcccacaattccactgacttcctattctggggtgggtggggctcttaggttttcttaatgccgttcgtttaatgtcgactccaggaagccacagctcactctccagcctaagggcacacagccatcttattgctccccaaatacggttgggcatcctacacactgggtctgagcccctgccttccacacagcactgaccacacctctcctgcaccttccctgcattggctgagcccatggagctccagccctgggtccagcgatggggctctgtgcctgagtctgccaggccagactcagatgcagggccaagtggctgggcccaacaggtgtacaggagacactgactctgctgtgtagctgtgtacagcacaggcgtgtgggactcccgccatggcgggtctacacaagaagaaagctatttattttgtgcagaggaaaaaaaaaactgtctggaggggtgagaccttcagggtcttctcataaggtgtagctttgtgttgtttccagcgttctgtataaagcagtgattattttatggaccaagattccatggaactgtcacagtaaaagtgcaatatctgtcccaccactccccactgggggccccacaggaagctgctggcccgacaatcactgccccaccgggggtccccgggggccagggcctcctccctcagccccacccgtcttgcctcagcctaggtgaccagccattgtgagaagcacctggaagcctcaagccacctgcagtaaaggcagggggggcctgaggtcagtgggcttggtctctcccctgggcagccccttgtggctctgaatgcccatgcctgcccagctgtcagccatgccaaggacaacagcaatagtcccctgggctctcccagggccctcagccatagatggtgagacgggcagcctccctccaaaaccttactccagtctgctttttgtctcccttaagatttcctttggctcgttctcttgaggaagccccacttctacagaaagtaagagaggaaggaaggtcaaagtcctttaaaaataccaaaaaaatgtttacagtgtcaggtgctgagctgcagggctcaggcctggccatttgtaaccaaagggtgaggcagatcttgctggctgccacccaccccaggcctgttagaatagaagccttagtcagtccctccccatccccagtccccaggactgagccttgatgccacccatcaccaaccacctgccttctctttgatttctaaagaaggattcagccaagttcccccatcccctttcccggctctgtgtgagctagcccccaccctgccccgtttcaccttcacatctcagacccctcccatctgtccttgtactgtcttgtttctcccgaccattgtgtaaactgtgtcctgtccccaccccatgctgtctggccttagtgtgctctctgtataccgtgtcacagtctgttacaccaattaaagaagcaggaggc

SEQ ID NO: 675 - protein, 1151 aa, Mus musculus
ILSWLSKESCLESPHKHAAPCRLEGVDSKMIIKEYRIPLPMTVDEYRIAQLYMIQKKSRNETHGQGSGVEILENRPYTDGPGGSGQYTHKVYHVGMHIPGWFRSILPKAALRVVEESWNAYPYTRTRFTCPFVEKFSIDIETFYKTDTGENNNVFNLSPVEKSQLITDIIDIVKDPVPPSEYKTEEDPKLFQSVKTCRGPLSENWIQEYKKRLLPIMCAYKLCKVEFRYWGMQSKIERFIHDTGLRRVMVRAHRQAWCWQDEWYGLTMEKIRELEREVQLMLSRKMAQFSEEGPSELSKDSATKDQASGTTSDPGSKNGEPLGRGLKKQWSTSSKSSRSSKRGASPSRHSISEWRMQSIARDSDEGSEEEFFDAHENLYCTEEKQAKDMTKWNSNDLMDKMESPEPEESQDEIYQQSGSEFRVASSVEQLNIIEDEVSQPLAAPPSKIHVLLLVLHGGTILDTGAGDPSSKQGDTNTITNVFDTVMRVHYPSALGHLAIRLVPCPPICADAFALVSNLSPYGHDEGCLSSSQDHIPLAALPLLATSSPQYQEAVATVIQRANLAYGDFIKSQEGVTFNGQVCLIGDCVGGILAFDALCYSGQPVSESQSSSRRGSVVSMQDADLLSPGTLANAAHCSGGSGGGGSGGSSLESSRHLSRSNIDIPRSNGTEDSRRQLPRKRSDSSTYELDTIQQHQAFLSSLHASVLRNEPSSRRSSSSTMLDGAGALGKFDFEIADLFLFGCPLGLVLALRKTVIPSLDVFQLRPACQQVYNLFHPADPSASRLEPLLERRFHSLPPFSIPRYQRYPLGDGCSTLLADVLQTHNTVFQEHAAPSSPGTAPAGRGFRRASEISIASQVSGMAESYTASSIAQIAAKWWGQKRIDYALYCPDALTAFPTVALPHLFHASYWESTDVVSFLLRQVMRHDSSSILELDGKEVSVFTPSQPRERWQRKRTHVKLRNVAANHRINDAVANEDGPQVVTGRFMYGPLDMVTLTGEKVDVHIMTQPPSGEWLHLDTLVTNSSGRVSYTIPETHRLGVGVYPIKMVVRGDHTFADSYITVLPRGTEFVVFSIDGSFAASVSIMGSDPKVRAGAVDVVRHWQDLGYLIIYVTGRPDMQKQRVVAWLAQHNFPHGVVSFCDGLVHDPLRPQG

SEQ ID NO: 676 - DNA, 114615 bp, Homo sapiens
  misc_feature (1)...(114615): n = A,T,C or G
agtgtgaacagagttcttggaggattctgaggtagagagtagcataatctcatttgtgtttttattttaacatgctcacttgggccaccttgtagaggctggagtgaaaaggagggagactagttagaaattctgtattgctggctgggcgtggtagctcccggcactgtgggaggccaaggccagaggattgcttgagtctagcagtttgagcccagcctaggcaacatagcgagaccctgtctctgcaaaaaattttaaaattgcccagggatggtggtgcacacttgtaatcccaactacttgggaggctgaggtgggaggattgcctgagcccaggagtttgaggctccagtgagctgtgattgtgccattgcactccagcctgggtgacagagcgagaccctgtctctaaaaaaaaaagaaaaaaaagaaattctgtattgcagcagcctaagagagtcattagttaagagatttgtagtaggcattttttagaaagttgcattgagggctaggtacggtggctcatgcctataatcccagcactttgggaggccaaggtgggtagatcatttgaggtcaggagcctggccaacatagcgaaaccccgtctctactaaaaaaattagccgggcggtagtggcatgcgcctgtaatcccagctactcgggaggctgaggcaggagaattgcttgagcctgggaggtggaggttgccagtgagtcgagatcgcgccactgcactccagcagtctgggcgacagagtgagacgctgtttcaaaaaaaaaaagaaaagaaaagaaaaaagaaggtttcattgagggaaattcattccctttgagagggagttggaagcagcttgcccttcaacagggtacacagagtctcccataagtgtgcagggcccgctatttctagtccctggaaggatttgggtctctagttgtctccaggctctctgagggtctgaggaatgcctcgtaagccagaacatggagatacttcttccctttagtgccctagccttggttctgaaggagttaattgcacccttgggtgctaatcacagtggctgggctgagcagaactgagtaccaaggtcttgggcctgagaagaaccaggccagtccaaccattctgtgggcttccctgagggacctgctctgagacctttccctaggacttccagaggctcatgtccggaagtcagagctgtgcaagccggctgtaggtctgcctctgcacgccagagactcttctcagagcctccttccacacttcccttgagataccctatggaacagtggtggccagctcaggcttggagccagatgactagaatttgaatcggggctccactacctcttggctgtatgtcctggggcaagtcactaacctctctgtgcttcagtttcctcatatgcaacatggggacaaaaagattcaatcagttaattcacatgctgagaagagtagttgtggttgtggtctggcccgactggccccttcccctgtcttcaggatcgctgacccacacctcctggccagcattaagggattaatgttgtacttccattataatccatgtatcattaccatttaccgacctttgaccatgtcccagccatatgctaaacacttactatacatcatctcattgtagtcctcagaaaagcccaagagacaaacactgtcttcacccccattttgtagaagagaaaaccgaggtttagagggttgaaggaactagccaaggcccccaagctggtaaatgatggagccaggacctgatgccccctgcaagctgcttttctgtagccagggagcaggaaggtgctggcatgtcatagtgttggggccctggctttcctgttcttgctcacggctaccttgcctggctccagcaaccttcccggtatttttctaactgtagatggtcagagaggacctccctgtgaaaacctaaataaacgtaggaagcaggttacggaatatcgggaagtgcatttcaggaaaagggtgcagtgaatgccgagaccaggaggtgccttccagggaggtgtccacagagacttctcagcccctgcctgccctgtggcatctggctggccgccagggagacagggcatcctggcttagtcatgctggctcacacaaagagcccttctctgaaggtccctggtgttcatacatgacaagacaggccctgtgagcctctgcgctgtgctttaagcattgagtctgtctgggggcagtttgcagagggtcccaccattgtccctgtggagttattggccatcctgtatcttcaagttgcattttggagagtgggcttttttctccttgtatttttttttattgtggtaaaatatacataacataaaattttctgtgttaaccacttttatgcgtatagttcattggcataagtacatttagaatgtgtgtaaccatcacccctatccatttccagaattttttttatcatcccaaacagaaactgcacccattaactaacaactcccaacccttttcctcacccccagtagcctctgccgtactctttgtctctatggatttgcgtcttctagatgtttcataggaacagagtcttgcaatatgtggccttttgtgtctggcttcttttgctcagcatcatgtttttgaggtttgtctgtgttgtagggggtgggctttttgaagcaaaggggatgtcagcactgtgtgctgaccctataccaggtgctgccagggagcaaaagaggaagagaagcccaggtcctgcccaggagcccccatctgggtcacgcagatggcgctagctcacacctacttagttactcctcagctcctggatctacctgtttgcatctctccagacaggtgcccctcgaaatcaaggactcagttccacatgtagcactctacggtgcatgccacaactctaggttcatctcagggcctgatttctgtgcttgggcacctgacatctctcagccttgtctctcccatctgtggaatggatctggttctctattaagagccatacttggcccgattaagctggcttcccagagtcagctcagagctgacccttgatgggggaggggggtgtgtgggatggtgcttcttagattatgacttttttatttattaaaaattaattcagggactttgatgtatcagactttaaaaggagttgacaggtcacatggtctctgaaagcacagggctggtaatccatttaagaaaacattttcttcttctttttaatttaatggaggaaatcattagctgggaaattggtagaactgatttattcttgttttggggaaggggagtggaagagaaaatctgctttaattgctgctggtgctagaaatatctcagcaaaatattcccatcagctgggcctggcatgagaggaggtagtaggctaagcgttcgtctcttcacccatgctctgggggcagcggaggggctctttctggccccaggtgggtggccacgatgtcagcagtggcaaatgttcaaagttgcagccttggctccctggtgctccagttcctcccaagcctgaatgcacggtgtggttctggtcgggggctgggtcccagagagctcatgctcaagccttattcccagggaaacaggaccaggacccccgtctgggaaaaaggactacgtgcctctggggcttcatctggttccaaggggaggcaactgggttcaccctaaaaataaccgaagatgcaaacagcttcagcatgcaaatgtttttcatatctgtgggccagataatttaaaggtacagctgtttttccactgtcccaatctgtttgtttttcctgaagcagggaggaggcctggggtgagctgagcccttctggggtcaccatcgtccagcatctctggctgaggtctgcctgggtgcccagctgctgccctctctttagatgccaccttcccggggtcaccccaaccctgtgactctcagcaggccctcaagggtccctgtcatggagcaggagctgccagcaggcctggcctgagtgcagtcaccccagcaggcttgctgaggttggggaggtggtccacctgatttcaattcaccaagcttgttaagctcagaaaaatgggtgaaggagttttcagagagagggaggctataaatagcctggcaggacgaggaagtgagaggttagtgattgtcaaggttgtaccccagctcctggccagctgccacatctccaggtctcccgaatgcccccaggctgctgcccctccacgatgtgctggcttcaggctctgttggccaaattctggtgttccaggaccttcctggcctccatgcctcttcctggtggctgctgccttgtgaggctccagggcacattgtcacctccatggctggggactctcatctacccatgtcataatcctcccatagacatgttacatctgggggaaagactcgaagcagttagccatctgggagaagcctaccatcaagtggggcgtcctgccacgctgagcaccgctacctctcagggatggtaggcctgtggcttcagttccaaagccgtagggtgggaccaggagttagtctacagtgggggtgagggacataactccaggccaggcacagacatttgaggcattgacctatacagggtcttcattcatccatccatccattggttcatccgtttgtatatttagaaattctattcagtgcctgctgcgtgccagtgctcttccagcccgaggatacagccaaccaacatccctgccctcgtagagactccattctagtaggagagacagagagttaaaaacttttttgtttttttttagagatggggtctcactatgttgcccaagggggctgggctcaaactcctgggtcaaacaatcctcccaccacagcctcctgtagctgggactacaagcgtatgctactgtactgtgcctgggcaggcaatattttaaaaagaacatgctacgacacatggatgaacccataagacatgctcagtgaaagaagccagacacagaaggacaaatactgtatgattccacttaccatgattatatgatgaggtccctagagttgtcaaatgcacagcgacagacagtagaacagtgagtgctggggctggtgaagagggaatggggagttattgtttaatgtgtagagttcagctggggaaggtgaattggttctggagaaggatggtggggatgttgcacaacaatgtgaatgtgcctaatgccatagaactgtgtgcacttgggagtggctaagatgggtcaggcacggtggccacgcctgcaatcccagcactttgggaggccaaggcgggcggatcagttgaggtcaggagtttgagaccagcctgaccaacatggtgaaaccccgtcttactaaaaatataaaaattagccgggcatggtggtgggcgcctgtattcccagctatttggaggctgaggcatgagaatcgcttgaaccgggaggcagaggttgcagtgagctgaaatcgtgccactgcactccagcctgggcaagactctgtctcaaaaaaatgaaaataaagaaatggctaagatggtaaattttatgttacatgtacaatttttaaaataaaaaggaaagaagaaagaaaagtaagtcgggtactagataacgatcaacgctctgaagaaaattagaaagggtcagaggaatgccagggttagagtcagggccaagttttacatcagggtgtcaaggaaggccttagtgagaaggggcccttgagcagaggggagggagagtggcaagtacagatgccccaaggcaggaacttgcccacggccttgccagggcggagaggtggcagggcagagcctgcaggccctcactctgagtgggtggagagaggccattcagggctttgagcatgtcctggtccttctggccagtctgttgagggagccaggagaaggctttgcagggtgggggtacaggcccatcctcagctacagctcccacctctgcatgactcctacctgtttgtgggctcagcacaacaggagttaatgatgctttacttagtggttgagtttaaatttttcctgtttttctggagtctccactacccctcctttcccagctttggtgggttcaggtgggtctgggacaggagaggggtggcttgctcagtcttcagtccctgctgtctgggctttgaagccacacagctgccaagaagcagacagacttttgcctacccggcaagagtgcacagtgcccccttcccctgggtctgctcccgagacacctctcaggaggctcctgcagggccagcttggtggggtcgggaccctgggcttcagaccccgccctgttggagaagttacctccctttctgagtctggatttttgcatctgcgaagtgagagggctgggtggcagtcaggtctggattctcatcctgacgctccctgccagaggagcctgagaaagcagcttcgtggctatgtgaaactccctgagtgcccagctccacagcccagccgagaaccaaggccctctgcatttcccctcaggggtctctgccaccacattaaggagtggggggggacctattccaattttacagcccctgcccagacattccagggataaccgcaggagttgctaggggaaacagcagttgaggggttctagaacagggcagaggagaggcctgcagttccagacccacgtcattatggagtctatggtgcccactccccagttggtatctatgctgttccctgagagccccaccatccaccttctctccttttagaggtgcctctggagctaggctgtggacagagcctgctcccctgcccagacactgtggggtaagtaggagaggaggggttgagggaagagaccaggagctaggcctgggcctggaccatgcgtccttttacacttgtcatctcctcaggccttagaactgaccaccagtctagtgtgactatttaagttcaattataaattaaagtgaaataaaatggaaaagttctatttcccactcccattcatcacatttcaagtgcttagtagccacctggggccagtggcaggtcacggcagctgcactggatagtgcaggtgtgtaacatgttcatcactggggaaagttctattgggtggcgccagcatcatctctagagcaaacccatggggtagagattgttgccccattcacagctgaagaagctgaagctcagagaggggtgatgactggctagtcacgtagtcagtgagtgccagtggtcctggcaccgggtttcatttgatctcaaagcatgggtgtggggttggcacatgcatgtgtctccctgcccagctgactgcttacctgggatgggttggaggaggctggaggcccacttgtgggctacacacaggcttttaggatctctgccttgggccccagggccagctggagcctcccttacttggtcacccatggggagcattgctttagtggaaaggcagggtgagatgagcactcagtttggggcctctgggcctgcaactttgggaacaaatcccttaggaggggctctggaatatttcactgggctctgaagacttcattttaaaagtgagaagctgagcacagtggcatgaccctggcctgtatttccagatactcaggaggctgaggtgggagaatcacttgaatccaggaggtcgaggctgcagtaagctataatcacaccactgcactccagcctgggcaacagagtgagaccctgtgtcttaaaaaaaaaatgtgacaacaatagccaaaaggtggaaacagctcacatgtccattggctgatggataatgcataagcagaatgtggtccatccatgtactgggatatgattcaatcataaaagagaatgaaggactgacacacgccacaacatggatggacctcgaaaacaggataccgagtgaaagaagccagacacagaaggccatgtagtttatgagtccatttatatgaaatgtccagaataggcaaatccatagagacagacagagagtagattggttgttgacaggggctgggggagaggggactggagagagactgctaatgggtctccttttgggatgctgaaactctggaactagatagaggtggtggttgcacaacattgtgaatatactcaatgccactgaagtgaacactttaaaatggttaaaatggtaaattttgtgttatatgtattttactgcaataaaaaaagtgagaagaagcggtagaatctagatggtgaatatatggatgttcattataaaatgttttcaactttgccatatgcttgaacactttcatcataaaacagtgagagagaggccgggcacggtggctcatgcctgtaatctcagcactttgggaggccgagatgggtggatcacctgaggtcaggagttcaagaccagcctggccaacatggcgaaaccttgtctctactaaaaatacaaaaattagctgggtgtggtggtgggcgcctataatcccagctacttgggctgaggcaggagaattgttttgagcccaggaggtggaggttgcagtgagctgtgatcataccactgcactccagcctgactctgtctcaaaaaaaaaaaaaaaaaaaaaaaaaaaaaagaaaagaaaaaagaaaaagaagtgaaataaaacactgagggagaaagcgatgggattgggctgtgccccaacttagatgtctctgtgtcagggcagctgggcctggtaggctctggtgccggatgcagacctgctgtagttttagtcctgaggagtctaccaagtgagcagggagagataggaggctggaggatgctgctactgtgctcccagccctaaggagaccgcagctcctgagatgggcccaggacagcactagtgcctgccctgagccttccccaagtcctgccacgtctgagtgcctgggagtgccagttggtagaacgtggtatcatctctgtctgtaataaggagatagaagctcaaggaagtgaccagacttgcccctggtcatgtgatctccaagaagagagactgcgaccccactgaggtctcgtggctttcttcccagccccatttcgctgctcccagtatgagtggggccaggtggctgaagccagtatcgaagctgggacgtgggcagctgcagcagtgaggctggcacaggcgtgatgggagatgccacccagcgtggggagcctgggagtccccatccacctgccagtgtgtccaggagagccccctccccctgctgtgcccagcagcctcccttctcctctgcttcccacatgggtggcactgggccatcggagcccttccataggtgggtatccccttatccctgagggtgggaagatgtgactcaggatttggcaacagatttttagaaacagggaggccgggcaggtggaaatccacaacgcctcccctaacacaaggtatcacctaagcccggggagagggtcactttagtctctggggtcccgacttcaggctctggctgggcatcgtggcgtgagacggagggcccaggctcttggggcagcggagcaccacgagccaggcgagaaagcccccatctcctcccttttccttggcatggtggtggccaccagctgctgcttttgcccaccggtctggccggtacccctccccgcctggccacctggaccctgaggcctggtatgggggaggctgcagcagcagaactgtgggattggctctctgctgatgccttccctctggcatatggctcctccgcccgccttgggctctgccagcggctcccctttctccatggcaactcagctcagtggtcccagtggaggagagaaaatcaattctccctccttcccgccctccctctccgctccccaccccttcctctccggcctgcctttctcccttcctccggcatccctgcccagtctcccagctcctccgtccacccatcctggggacacgcgtgctcctcagtgtcctctgtctccaggcatgggctgctgggagagctgcgtgctgggggcggccccctgaggccggcagcatggggagctcagcggacctctgcagggatgggaggctgctgcgcgaccccagcctggctcctgtggtgcacacctcctggctctgatactttgtccccccaccccttccctcacattggcttcctaaaaggtaattttctgctccttctgaaacatgtcacagcctcaggatgggtttattagcaaggaaggctctgtctggtcacgcgggctgcttgctttctctccgaagagctgggatggagggagagagagagggagaggcctcacctggcatgctcagaactcagagggggcacagcagagtttgggtgcgtggagttctcctctagggagtctgtgagtagctcgactcctgcctcctggtgcttgggtaggtacagcactccattgtacttccattttccactgtgattgccacggggcatagaaaatctgctttcctggactgtggttggaccaaggaaaggggaggaaattcagaggcatgcacgtgcgccctagatggggcagggctctggagtggtgattgttggccacacgttggctgtctctctgaccaatccttcattatctgaaaatgagagttcagtgaggaaatgttttgtccctctccacccctgataacaaggggtgtccctccccaccccgatatcccccataaccaagatttccaagaaggtggtgtagggaggatcgtctgctggctggcttcaggcagagcggccctgccagtgtgtctgtctggatagcaccatctgtttgggacagcccctcggcacagtttggtcaggcaggatttcaagcctgctgcccagtgggtcaacattctgcatcatttcttccccatccccagtagatgcattcagaatgactcttaagtggctttcccagagggaatctgtgaggctaacccctcagcagcgcagcccggggagacacactccgacccatgcccggcacaggcagctcccaccgtgacctctgcttcctgtgcagcaggcaatggaaaaaagaacccctggttgtcaacaagaacagctcccgtgttgatggaaagtgagggccaaagaaaccggatttagcacccagttcttagaagttatgggtttgaatggtgtctgagagtaacccctctctgatctttaaataggaagtgttacaccaagtagccctgtctgactcaccagggagcttcagagttcaggtaccagggaacccatagtcaactctgaaagaggcactcaacttggagggctgactgcagagaagtctagatgttccagtatgtgtctgtgtctcagggtgcagtggggattgagggtgggaccagaattggctcacaaagtgaatagttgaatataggacttcagcctcatgagcacctgattggattctgttttttgtttcagcattctctctgtcagattgttttaataacagcatcagagccttgaaggtggcctgagacaggactccctgtgtggttctgtggttgggcatctttaaactatgtttatctccccaaagccctgtttctttaaaactgcctttgagccccccagagaccctcaattcttggtgcttctctttgagcaatcagatgggttacaactgggcaggatgagaggaatgcttttgtgtctgcacaggtctgtgctgtttcttcctctgctttggggctggagaatcacccagaccctcctggcatctgggcggtgtgcaggcttcttaacaacattacgggcatctggattctggttggttgctgggaattctgatgggtttacgagttatgtgatgggcggggaggccatgtgctagttttgtttagtttggttttggtttgctagtgagcggaaaatctgatgtgacaccttaaaggccagcccacaagtggcagcacctgatcgtcatctctgctctcagcctctatgggaggcacccggccctgccgttgctgctgggcttcctctgccctgagggctttcgtgtgagctcagggcaatgcaagtgtgtgttcagttaccaagcccaaaagtcaaaagaacagccagagccaagctggcttttgaggagagaggccggctcctccagcctggctgcatttgcctgaggtagatcgtgagtgctctgccccagcctctccgccctcctgtgtcctttctcagcggctgctctgaagtataacttcacgtagtggtgacttaacttgaaaggagccgcagggggcgtgagagcagcttggagaggtgggagcctgggccgccgatggctccagcctgtgaaagtgtggaaagctcgttccaggaaaattggaataatcacctcattggctggctttcaggcggtgagtggttctttctttaatttgacaggagcgctgggattcagggaagggcgtggtgggaagccctgtggttcagacagaccccacgaagccagtgaagctcccaggagaaagtctgatttatttttccctggcctggcttgcagcatggtggaatccaccacccaggctgtgctgggcaggacaggccgctctgatgcgggtcagagattctgggactcagaacatctgccttggcccccgcccagcccgtgcctagctttgaaaaagtctgttggtggtgttgcatgatgacttaaactgcaggaagagagaagctcatgaacattaaactctcccccagtctctcttgtgagtttcctgaacacacacgtacttatacatgcacatacacgcctttgcccacaagtgcacatatgcttgcagatacacacacacagcctccccacatgcacactcacacaaatacatgtgcacatgccatgcaggcatgcacatgcaactcacaagctcacacccacatgcacgcacacacaaatatgttttccctgcctgctagcaggggtgtacctaccatttggcattcttctcatgctaacatgatcccatgtaaacggttcccaggattgttaagatcagacagctgtcctttttatgcattgctttacagctcagtgtctcacctgagtgagacaactgtccctgtccacttctggaaagagctgcctctgttccctcttttcctccctggtgctctgttgcatggtctggtgtattacagggattggcatgtttgtgtctgcaggggagcctctgggtgctggctttctgtccagggcttctgagggccgccagcccaaagggaagggattcatcagagactgataagcttagggtgtactgagctgtgaggccatatgtgtgtgtttgtgtgtgtgtgtgggtgggtgggtgtatgtgtaggcatgtgtgtgtctatgtgaggtgtgtgatgtgtttgcatatgcgtgtgtggtgtgctcatgtggggggtgtatatgtgagtgtgtgttgtgtgcatatggacatgtgtgtatttatatgtgcatgtgtggtatgttgtgtgtgtgaggtgtgtgtgcatgtgtgtggcatgtatatgtgcctgtgtgtgcctatggggtatgtgagagtgtgtgcagtgaatgtgagtgtggcatttgtatttgggcatctttaactttgcattctgcttctcccattttctgcttcaattcccagagcagggctcagcaaactccttaacctatgtctgcactgggatcttaaatccacttcacagacactttcccaagtctcatctgatttaacagtttgcagccaccctagaagtacttggcgttgctcccattttacagataagtagaccgagtctcggagggttgagtagcctgcctgtgaaggcagaaccagaacttggatccttggctctttcactccttcgctccctccctccctctgcctcactcattagttatacatgcaacctgctctgcaccgggcatggctgctgggctcttggcctgaagactatattcagcccttgtccttcagcgggtgctcagtatgggaggaggccaaggaggttgggtgaggagagctggggggtgctcactctccctgcactccacggccacccaccttagttgtctgagaagagaaaaggaaggaattagagagaggaaggagcaggcagcctggggatgagctggaggagagccccctgcatctgccctaccactcacttgccccagggcttccacccagagtacgaggccactctacactgtggaaaatccgggtcactctgatcctgatccactgttattctgctataggagcagagtggctccctttcttttaaaaattgctacatcatgtatcatcagaaagacagtctgcatcgtggggtctatgtgttttaggctgaggatttcagcattggtggctcagggtagtaggagcagcactgcacatgaggagatatgtgcctcagtttcttcatctgtaacatagagataacactgtctacttcatgtgtctcaccacagagaacaggtgtgatgtgctaggagatgaaccacctgtgtaggcggtggcgaatggtaggctgttgttagagacaaggcattcccataacttactcttcaatgggtcaggagtgtttatgcccagagatgcacacagagagcaggagggacacagatgcaaggcagatggaacaaaagggaagcaattgctgcttttgggtagtgtagaggggagttcttatgttagttttgcaatttttccgtagcttagagactatatgaaaatgaaatatggaagaaaaaaggctcatccatttaagagctcttcctaagaggttgaaagtataccgatgtaacaaatagcagagggtttgtaccttaacgacccatgagaagccaagtgaataaaacggaagctccatcctcatggaagctggagacagctggccatccctgaaggggatagggagctctggggaggggggcaggcgatggaatcacaccagccaaactctcaagaggcagggctctccctaaacaccaggcctcggaagtcaggctccttccctgatccctgttggggctccggattctggcttggatgacttccccagggcccttgcctggtggccacagcctcttcttccagagctccaggtgagggaaagttgtatcttatgatggtttcctgactgggtgctggttttatttggtccaacgttcagttgcaggtttacccagtaggtcagctttgtggccctctctgctgccttcggcatcctgaaagcccctttcagatgaatgtttaacctcaaaaccttgagcagctgttgacagggagcactaggcctggagtctgagagtctggggtcccagctctgccccagtggatctctctgagacctgactgtctccctgacaaagccaagtttggtgggaatgaatgaatgagggacttgaacatgctctgtcactctgcaaatggtaggtgtgtcttgggagaagacaggagagggacaattgccagccttaacttgctgtctactttgtgcctcactttccccaccttgttgccatagtgagaggaattttcctcatcaagtccccatcacctttctctaagcaagactatgctcaggggctggagggcaggggagaatgcaagttagaagaccttgtccctgtcccctgtctaccatcagcctgattataagatcttggagaattcctttgacctctcggagcctcagtttcctggtgtgcacagcagagttagcgatggatgccctcaggagaatgggaaggacaaatggatggtgtgtgcccagcactttgtttcatgccagcgtcctcacttttcctgtcaccctgtgcccttgtaaagcacttcacagctttctaggcgtgggcacaccattatcacagcctgtggctgtgaacaggctttgtcaagcctgtgcagacagagaatggggaatgggtaaatttaaaacactccttccgcctgacttcatttgcctgctgggcctgtgctaattgcatggctgaagtcccctttccaggactctagattcctgagatggaaaggatcgggactgggctgctctaggaccttcctaagctggtagaagagcaaaacttggtagtcatataggctcgggttttgagtcctggctgtgtgacccacagaagctgcttaatcccattgcacctcagtttcctattgtgtggaatgggagtgatggtccccccatgggcgttgtgtgagaattcaagattctgtgcttcttgcctgcctcgtcgcaggagcgtgtgaagcggatgatcgtcttgtggggctctcctccagtgtcagattgctctgtaccagaggctgtcctaggatcagggccaggccaaccgctgcttttcatgctcccaaatgtttggagagccagtgcggtgtcttagccagcagagctttctgtcaggaggtgtgatcatcgagccgtttgtaccctgccagccacctgaacccagagccactccctggactgagcttgccctcaggggaaggtgggcagcagagttatccagcctgcgggtctctctctggctgtcctccaccctaggaagcacaacacgtggtcagcagtgtggcttatggggagcacagggaaaagatgagcagctccatatttcatggctgaaacttggatatggctgcagtgccaaggaggggcctcccctggacccagaaagagcaggggctggaagttatgcttgagacaccagctggcagcttcaacttagagaagagccggcatgcctgtccccctctgctgcctgcagccctctgcccaccctactcaagagttcagcctgttgctccctcccaagcaacagtggacactcgaggatcccaggtcggacctgctagatggggacactgagccaggcagacccagggcagctttcctgagttccttggaatcacactgagctgggccagctggataggctcctggaggcagaacggagttcaactccctctctctgctggcctccttccctgcatccccctgtttgcagctaggaagggctgacctggtgactcggtgacatcccttccatgtggccccaacatgagtcacacgtcacggcattctctgagttgggcagatgcgcgaaggggcatgttgatgtggggcccttagggctgcccccacaactagcctggtctgaagaaccggttggtcctgtggggttatttagaaggcatggggggcaggcctaagctccccagctcctccttggaagaggcctggcctgtgtaagctgttactgcctggcttgaggaagtggcacaccgaggagcatcctgtctcatagggagcccatcccatgggcagctctgctcctcagggcagccagtggagctgggaggggggacatcgcctgcttcccagactcagcgtgtgtcatgttcctctgggctgcccggcctgggtgttctaggaggcctctgtccagaggagcagaccttccctgatgcccacaccaacatgaatgcctgccatgaggccctgagggtgctgatgacagcagctgtgacagcggtgccattgcccacacggtcctggggcccttggatacggtccagctcaaaccccttcactatagctgggacactaaggcccacacaggccagggacctgcttcagctcccaggcccttgttaccaccacttgatgtgatcttctgtttgcagtctgatagctttcagggcccagtccctgctccccacagtggacatgggcttagggcatgatttaagccccaagagcagtgaagagagctgggctaggggccagggcatggcgacctcttgccccaggctcaaggctagtagaacctctggactcgtctgtccctgggctgtatcttatcagcagactctcctggctgggtcttgccaacctggggactcttagctccttgccagtcactcagtgagcccctgcttgtcatatgagcaccgggtgcagagccccactgctgggcagcttcctgagtgcattgcatctggcttttcactgtcaccttgggaaacggtcagggcagatgaccagaatctgttccaggaaggggcctggaagttgggtcacctgcccaaggtcagacaactgttctgggacagagtttggaattaaaatcttttatctaacaaatatttgctgggtacctacctttattaagcaactgctgtggccgagccctggggacacaactttgaacaaggctcgggccctgagctccaaggcaaacatgtggctacagtgcagtctgataaatgccaaaaggaaagtgggcgcaaggtgcccggggtgctgactcggcccacggggcttgggaaggcttccagggggcctggaaggcgaggaagcttcacctgggggaagggctctttgagcacagaggactctggccatctgattccaggcctatagggaccccagcaagcccaggagaggtgtggactctggccttttctttgctgcgtggcctgcagcaatccctgtcctgtctccagtctctccatctgtctgcaggggagattgtaccaggccccgtgtttcattctctggagggcttcctgataacctcaggagatgtgtttaaaacgcaggttctgaggcctctcacacagaggttctgatttagcaggtctgggagcagcgcataggaatctgcatttttttccttttttttttttttagagagtaggtcttactctgttgtccaggctggagtgcagtggtgcaatcatagctcactgcagcctcctgggctcaagtcatcctcctgcctcagtcccctgagtagctggttctacaggcacaatccaccacttctggctaatttttaatttttttgtatagatggggtctcaccatattgcccaggctagtctcaaactcctggtctcaagcaatcctcccacctcagctttccaaagtgctgggattaagggtgtgagccactgtacctggccctggaatctacattttaaacaagctcactgggtgtttctaaagcagctcatccctgtacttcagtttgagaaaagctggacttaaccatcttggctctgacattatcaatcctacagttgtcctgaccatgtcccttgaagtgggcagagcctatggtgttggggtggtggaggtgcctggggttcgtaagtgctggagctctctgagattccaaactctgcagaatctcagagaaacccttggtcatagtcctaaagcttccaaaagtcttggccaactccctcagctccccattatgggagggtctccaaaagtggagacaggtaggggatgctgagccccttggggttagggggctgttaagtatttctcagatctcgcttcaagcatttctgattagaaagacctgcagtccctgcgttagttcttaaggctgtctgcttagggctggtgtgcccaaggattatttttatttatttatttatttatttatttatttatttattattttttggagatggagtctcgctctgtcgcccaggctggagtgcagtggggcaatcttggctcactgcaagctccgcctcccaggttcacgccattctcctgcctcagcctcccaagtagccacctcacccggctaattttttgtatttttagtagagacggggtttcaccgtgttagccaggatgttctcgatctcctgactttgtgatccgcccaccttggcctcccaaagtgctgggattacaggcgtgagccaccgccccggccgtgcccggccgtgcccgtggatttttagcaaagctgagctggcctgacctgacatgggggcctagaaaaagctgttcaggtaccatgtggggaggtggagaaagtggggaggctgggcagggggaggccagtgcactttgggccacatgactacttcccctcaagtgtcttaagagcctggatgcagacgggtttctcaccgttggctcctcgcatgccctgagctaattgggctgcagccctgctaacagcctggtgacaggctgcctcagtcctgcccagatgctagtgtcacccttccagccaagagacccattggctgttctcctgcagggtgcccggagcaggagacactagctgacctatatgtggtcagctcagagtgtgtcctgtttcccaatgccacaaacccaatgtactagtttcctggggctgccgtcacaaatgaccacaaactgcatggcctaaacagcagaaatttattctctcacagttctggaggccagaagtctcagatcaagctgtcagcaggaccacactccctctgaaagctccaaggagaatccttccttgcctcttgcagcttctggtggccccaagtgttccttggcttgtggctgcatcactgcagtctctgcctctgccttcacatggccttctcctgtgtctcctgtgtcctctcctcttcttcttttgcgtgtgtgtgtgtgtgtgtgtgtgtgtgtgtgtgtgtgtgtgtgtgatggagtttcacccttgtctcccaggctggagtgcagtggcacaatcttggctcactgcaacctctgcctcctgggttcaagcgattctcctgcctcagcctcctgagtagctgggattacaagcatgtgccaccatgtccagctaatttttgtatttttggtagagacggggtttcaccatgttgcccatgctggtctcgaactcctgacctcaggtgttccacccaccttggttcccaaagtgctgggattacaggcatgagccaccatgcatggccatggctgtagactctctcctcttcttataagaacaccagtcattgggttttgagcccatcctcaatccagtatgatttcatctagaaatccttcactaatcatatccacaaataccctatttccaaataaggtcacattctgaggctctagttagatgtgaatttggggagggggctgcactattcaaccccttgcacccagcaggcagaatgtcaccagataaagggcaaacctactgcactggccggggagtgtggcctggcagcgggtcccaggaaacacacccagggcttttagcagcctcaggccctgtcatcagcaagggcgactttgcctccacgagtagaatcagagagcccagagcagccgagggggtccagtaggcagccactgtggagagggtgtactagtcagacacgtattttaaggtgtcctggaggagaaaggctgcatgtggctccaaaaagtcaatcaagaccccaggttgagtcccagtggggcaaactgttcagtataggaactttctctaatagcagtaccttgtagcccatcccagggggtggttaagcccctctcacaggatgggcattgcagagaggagtctgtctgtctcccagctctcagtctgtgcttgtctcagaggttcatgcccccacccccaacagctgtggggtgaggtcacggactcactccacaaaggcagtggagatgatggtggcatacatagccagacccctgctcttgctcctggctggctcatgagtttgtgggttgtggggagtacccacaatgctcagtcttcagggcatctacagtgacggcccctcaccctctgcccctgcctgcaccagcccactccgtgtgtttcccagcttggtcttctctacccctcgtcaggccctccccttgctcgatcttgacacttggcctccttcctggccaggctgtctgcctgcatccagccctggctccctgagctcctctcggatacatcactgggcacatggtggagtggccatttcaacacatggcacctgcaagagctttcatctccttcccctggcccatcgcagatgagacacactgacacctcagctgtgaaggtgacatttgtctacacacacgcacacaaacgcatacagggctggatacaacaagggacaaggcttaggcctgctgcagaccttgggtgagtctctgccccacgtctccagcagttaatgaaagacaatcttgctctgggaagcacttcctgcatctgacttctagaagtctctgctgtccaggatgacagagggtgcccctgaatgcaggaagtgctgagtgttgccagtaccagtgcccctgtggctgcctgaccaccatccattccttcccatcctcctgctgtgagagaaccaacagaccaccttggggatgatgtcccctaaggctcccaggccagcccagggtgcctgttggggagctgcctcctcatcctcacacccacaggctttacatacaattaatcatttaaaatgaacagcccttctgagcttgctggcctcctgcaagtctcacaccaacttgccaaaatcctttcccttttctgggccccttgcttttacctgtcaaaaagacataatctgctgggacaaggtgtgtcagctgctcccacagagcctggtgccttggaaatgccccataaatggttgttcctgtcttgcatcctcctgcctctcctgccagccccgttggttccccattgactccgtctccagtgtctgctgtgcacctgctctgggcagagccctgtgcgctgtccctggcaccaggtggctctcatgctgcccctgcaaagcagcagctagagatgagctgagtcctgctgcctgccccatgacagtgactggagggctatgggggaaccctggatgccatcggggacctcttcaccctttcttctggttttttggatgctctcggaaagccttctgggtggccccttgagcttgacctcacagaccgatgaggcagctgctccaggctcagcactgcagttgcacaaggatggacagggccttgtgcagccgtccaggggcctccagcggctgtgggtggcaagtgcctgcagaatgggggctgtagctcagctgtcccaatgggagactctgagcaaggctctgaagggtgagcagggcatggcaggcccaggctgaggacatctcaggtgcccagtgcctcactgtcacctcatttaatcccactcaaccctccaaggtgggtggtggtccacaaatgggtacactgaggcctggagcaggtaaaggacttgctcaaagacaaggcttgaatgtgaacgtggtctggccccagagctagtcactccctgtgtcctgctgcatctgattcattgtgttgtttgtttcccactagcttttttttgcagggtgagggtgatgtgcttacccccacaaccttccctgattttctcctgttcctgctgttgtatttggggctgttcagtgcctcctcacttcccaccctgttgacacaggggtgttgctgggctcgttttgtttttgacccagtcagcctggcagggaagtggcgggctgtgcgcagagcttcccgaaatagccccaggctccccgccaaagatagaggagccagactgtgcgcgatgggcttgggccagttgaaagatgtcttggttccctactcccctcagctcccctgccctgtgccacccccagcccaggtcttgatgctcctgcacatacctgtgccccgtggtggctgagagcctcctgtgggctgcaggccttggggtgctggttgggatcggtttggtgtcaccctgggcccagaatgaggagttctcatcccttccctgctactgacttgcccgatgaccttgaccaagtccctgtcgctctcttggtttccattttccaatttggagtggggagagtgcgtctgtctgcctgctggcagcgttgctgggagggtcgaaacagtgagcaacggccccaaccctgggaaggctggcaataatgcatagtgacaaaatgatatcaatgatttgtttcccctagtcctgactgttttgagtgtggggacacagttctttagcagggctgatccccagcatcaccatcaccatcaccatcatcattatagtaataatagcggctgctgctgttgcttgggtgttgtgtgctgggtgctttacattgattgtctgttaatttattccccttactaccctatgaggtgtgtgtggtattggactaggtccacatacctataaaatgaaggtccacataccttcacctataaaatgaagaactgaggctcagagagtttaagtaacttccttaagaccaagtgaggggtggagctgtgtgatcagagcaccattctgatgtcaaagcctgagttctgcctgcaatgctgtgacccctcctccaggggtccctgctctaggcttttccttccagacctggagcctggtctcgtgggggctgctcttggcagccagagcatccagtaggtctcatctgcattctgaccagagagccctggtgtaggacagagacccacaaggggctctgcctccaaagagagccctgggggagagggagacgcttctgggactgaaggggccacttattttagccccctcttttaaatattatgcatttaagcaacgtcacagaacagagtcagcaagcacttcctaagcaccagctgtgtgccaagccctgggggctcctgtgtgcctctcaccaagcccaagaggcctgtttcactcagactttgcaggtgaagaaatgcagcccagccaggggcgcaggccacctgcccaaggccacctatctaaggccaccggctgggcagtggcagtgctggtaccagagccaggtctgcctggcatacctgccccttctccacactgcagagatgaggaagctctcaaccaccaagccctgccgtgttcctcattcctgcctacccttgcttgcccagtcacaggcctggaaacacaggccttgccctgagcaggggtcagcgggccctggggcaacacaggttccgtcagcagagctgggctctgcgtccttgtggacctatgtgcccgcaggcctgtgttatgaatatatttataggcattgctgtttgtgtgtgtgtgcacatttgctttcgtgtgtgactcatctctttggactgtgttccccaaggtcacagggcctggtgagttttagaggcagagcacatgtcacccctcatctgtcctgcattggtagtggggtgaagcaggggtgatatgcagttggttcacacagatatgtggtgaaaacattgatgtgcagatccacaattccttatcctcaattccaaaatccagcacactgaaaaccagacacttttttgtaactcatttggcagcaaaatttttcctgaactgaggtgaggctatttatagtccaagtgaggctatttatagtctttatgtattctatattcatgtctttcactgcagagagttcaatgtatttgtttattggatgctgctgagatatgcagctttacctgtctaaagttcaggatattctgaaatcctagatacatctagccccaagagcaagagtgctgtacttttttttgctggtaaatagcctctgcccctgccccgtcccccttattgtcccttccctgggatttctggagctaagtgggcaatgctgtccacaggcacctccaggattcccccagccccacagccagcagcagtgcccaggggttagatatttttagtattcctgtgggtgacagaacacatcttggttgccaggcatagtgttctaccccctcactggacgtattaccacctccctttacagatgagtaaaccaaggctcagttgcaagtatcagatctaaggacggagagatgagaagtgcaggcgctggaccccaaactttcccttccacctggctgcctgtctgggagggagtctggggactcaggaacctgtctccctggatttgttgaaatgggaagcagcaagcatcagggtcccaggtgcaccggaggggagcagacagatgcaagccaggctgctctacttggcagggagaaggaggaggaggagcaggggcccctcagttgctgcagggcctccctaggaacttaccgcctacctctacaccgtagttcctgcttctcagagtccctttgttagaacacctgtgccttcctccgcacccaactccatctcttcccagcagccagccctcatagctgctccggctcttgggtctttcctccagaactctctgaagccactggcacatagggagatggcataactttgtccaaactctgtcggcagctgttcttggggaccctgctagcagccaccttctcctacaaccttcagaagctcccttggatgcaggagctttgtcagggcctgaaagccccaggcttccccctttttctgactccccagtgtacaagttctttcccatttcctgtgagacgcatcatcttgtgatgaccaatgactcccaccatccaccacattgaccctggctcagaagcctttggtctgagaagcttcttgcccactgggacgcctcctatccaccctgcccaagccatgcctgacgtgccatagtgcagtgagagggcctactcttggacagtggagagatctgggacagggttatggctgtagtggttaaccatccttggattgtaggcacgtcagcagacctctccagagcttgtttcctgtttcctcatctgcagagtgggcttagggttggctgccctcacagagctgttgatgaggattggccttagggcaggcatcctgcatagaccgtgccttgtcatgagccctgttacccttcccccattccactagcagggtctttcttcctgtatacccattaaggggtcagaaagtttcccagagctgccgtgagtgtaaagaagtcaactgtgacccgttgtgaagacctttgggtttagaggcagaggctctgggctctagtcccacccctgccctatgtagatgatggatggatgcatgggtggatggatgcatgggtggatgaatgcatgggtggatggatcagtggatgcatgcatgagtgaatggcgcggtagctacatgggtagatggataggtggatgcatgggtgaagggatgcatgggtagatgcgagtagggatgcataggtggaaggatgagtagatcaactgtctgcccttttctgggccttaatttttccatctacccaatgatagggttggattgcaagttcttcagtttctgaggtttgtgaccccacctatgtcaacctggcacccttaaggactgctgcccccttaggtggtgacctataaggaggaccgtgcctatacccagggaccctggaaccctctctgagctccaccttccaccctgccttgggccttcccagctctgacttggtaccctccttgcagcctctgcgctcctcatccctttccaataggagtgcagttttcttctggctcttttgttgacagaatcgcttgtttatttgtggtgggagagtctgtatatcctgtgtgcagtcacttccctccaggccactctgcattcatgcaggatgagctgctgagtgagcattgggtggaagtgtcaggcgctgggggcttggcagagggactgtcacagggtcagggtggctttactgccaaggtggctcttgagttaggtcaggagctaggtcaacttagtaggtcagaatttcccggtggaggtggagacccaggtgatggcacccagacgggctgggtcctcacgggtgagggtgtcagttcaccagcctgtgcaaagacttccagtgccaaggcaaggagctcagggtgctttggtgaatgaaggtgaattcttgaagggttttaaccaggaggtgacccagtcaagttccttctcctgcagtatgctggagcatctttggttaaaaataaaaaaataaaggtcaacatggaaaactcaccctcgatttgtgctctgagcccttggggcctgggggttgataaaaagagccaggatgctagcttgcagaaaagggagcgctgccaggacttggagaaaaaaaggaaactgatacttggagttctgcctgacctttctttcctcgtttctttttaggtgaaattcagtaagcttaaacatgttaaaagtgcacaattcggtggcatatagtatgcatacaagattgtgcagccaccacctttatctagttctaaaacatttccatcaccctgaaaggaacccctgtcccttttaagcagtcacttcccattcctccctccccacagctcctggccaccatctgtctgcatcctagctctatggatttgtctattccggatgtttcatagccacagaatcaggcatacaccagactctgggccctttcttaggctctgccttgtccctgctgtgctacaagctcaccatttatttcctgctctatggccctcaagccagtcctgtgtgcagcctgggtggagctcccagcttcccactgtccaagagagaagctcagatgatatgaaaacaaatcagtcaagcttgttctgggggagaagtgggcctccacccttctgggggcattagtgggtgtgtatggccaggtgctaaagggccagaaggtggtaaagctgggacagtactcctgactgcagagagtacagaccgaaccctggaagtgaagtcacagagccttgtgggcatctggcttcccaggcagttcctccctgaccttctctgggccctctgccccacatccgagaccttttaccaaattcaggctatgtagctcagtgctgctacggaaaggggcaggggctgagccacacaggaggtggctggttgactcactgctctccagatggcccttggaagagcccccagaaaaggtcccatgcttgtgagctcctcctctctgactggaaacacatgggctcttcagcctgtgatatccttggttggccttctccctgcctggttctctccctgcctagatgctgacctctgcccccacagctgtgcctctcctaagtacttatggagatctgtagagcacctcgctgtgggcttggccctgaagatgcagaaatgaagcagatgcgggtgctgccctgagcttcatggtttgggcccagacaatgggaatggggtgtggtgggagctggggctgaggtgctctcaatgcacctgggcactcagctttgcccagagtagtctcggagggcttctcagagtgagtgctgtgtaagctgattcttaatagacacttcgagaattttccaggtggaccccgtgggaaagggctttttccacaaaagaaccagcaggggttgagcacttgagcaaatgcctcaggcaacagttaccagcttctacagcgcttggggccttgagcaaatgcctcaggcaacagttaccagcttctgcagtgcttggggccgaggtgtaagaggcaggtgctgctcttgagggctttggagctgaggaccgcaaacagggaacaacaagaatgacagcagggaacagcaggtgaatggtggagtgagagaggccctggagaggctgtgggtggggcatgatggcttccagtgacattctggggagctggcaaacatggttgcatctgcattgggaagatgtcctctaatggtttctagaaggaggatttcagaggaaccaaactggaaacatagaggccaattagaaggctgtctctgacacccagggagtgctggtgagggccagaatcaaaagggatggaggcagaaggcaaattagagggagacatagcaggtgttcttcccatggctcagccatgggtgacttggaattcttggggaggggaccccatggtggcattggagacggagacctggtatacaccctgaccacctccctggcagccctacaaccttggctgaattgtctgatctcacctggccttggtttatccttccgacaaaatgcccaaaaagaagaagtgaagaacgtgggttcgtaagtactttgaagagtaaaaggtcaggggatgaaggcatagtttgttttttgctgcctagtggcccagagaggaggtagcacctgtcaggtgtacaggaggggtccctgggacttggggcccagctggcacggagggtcacattccaacctctggatcccttggatctgcaaaagggttccagttcccctctccaactctgagagcagctgcacctgattcccccagggccttagctgtacctcctcctctgtggttaataattcaggacaagccagatggctctgctttccccctccttctttcccatagcctcctagggcttgttcctcaactaggggtgggcgtcgcggtggggagcccaggaggctcagccgcttgtaactcagatgaaccgtcaccaccagagcctacagcctctatgtgccctggggcttcaggttctggccgggcgccccagctttggtgtccataggcccattgcctggggaagtggagagagcacttagaaaccacaggtcctgcctcccgcccagctctgatttcagatgcggtcttgtctacggcactttgtaaatacttgtagggtgaggagaccaatggtaccatttgcaccctcagagacattctttccttagttcttctgaatgttcctgttaggaagaagttctttttgtttgtttttgaatttaaatttttttttttttttttttgagatagagttttgctcttgttgcccaggctggagtgcaatggtgtgatctcggctcaccgcaacttctgcctcccgggttcaagcgattctcctgcctcagcctcccgagtagttgggattacaggcatgtgccaccatgcctagctaattttgtatttttagtagagacggggtttctccgtgttggtcaggctggtcttgaactcccaacctcaggtgatccacccgcctcggcctctcaaagtgctgggattgcaggcgtgaaccaccacgcctggcctgaatttagatttttaacctgaagttgccctgaagatatgctccccggttaggaaggaattctcacacacactcagacgcgcttttctctttcacatttgggatccgaggcttctgagtactctgacttgtccaaggctgagcagcagatcggtggcctctactcccagttcacacctgcttggttcccattcaaggccaggggctagacctcagtgaactgccacctcctgggtctgcaaagtcctgcagggacctgcaggttgtccccattctctgtgattcttagcacccatcttgataggatcttgggcacaggacccctgattgggctgggtatggagagagccaggccctgaggctatcccagcccctggcctggggcatcccgggagaggacagggacagtgtccagtgtcacccagtgcagggagagactttctttgtcaacccaggagggcttgttagaagaagagggccgggcagctcagctctttccctcttcgtgtccggcagcaggaggccactcctgggtctgggcctcctggagttggcaagagctgctgactgagaacctgacccaggcccatgaaggcagtgtccaaggtgagccagcacagtggccgtccacatacctgtatgctaaggtgaagccaccgcagtgagaagctggtgcagaacattttggggcagctctaaatagaaaaggattttgtctcccgggcaacgtggacatgagacataagcctacacgcctccatgtaggctcccagactgcctgaaagctccggctaagttctccagagcgctcaggtgatagctcttcttctcagacgagtactctgaggccactgtcatgccagacatgtaagtggccaagcttggcctgacgctgcagtcactttccactgacctgcagctgtgactcatcaccactgccttgacctcagggccagagcctggaactcaagctgcagggctcctaagagtgaactcaaggaagcccaactgggcttgggactgggcagtgttctaggatccaggtggagcagaggtgagattaacaccacaggaaagaaccccagggagaggcagaggcaggacattggctggtggagtatgaacacatcataaaaaggtgccactctatttcttttcgtcgtgctttcactaacatcttgcaagtgtgtgtgtgtgtgtgtgtgtgtcttcaaactatgatattagtatattggggatgcttttatggagggggcttgtggggagtcaccgttccctctgccctgtttgcttctgctggggaagggagcaagatgtgggtggcttaagagagcctggcaagaagaagaattctcacccagaatctgttgaaaggatctggttttgaagctgaatggaagatcccatagcctgagctaccctcacagtggtccagaaacatgtgaatctgagccaagtctactgatgtgtgattaatttacaaataggcgtgcagagcagaacggtgtgtacacaggagcctgctgttcctacaaagctgcatcaagatgtcactgagttgggttttattttagttccaagtattgtatctgtttagcacccagccagcttggtgccgtgtgcacgctgggcaggctgagctggtggcgtatactgcttccttagacgggagaagcctttgaggtagttccaggccccacgtgctgggcccagagcaactcctcagattcacagaaagagctcatatttcatgggtggtcatttggcagaaagagtctgcacatgatgaaagggtggcacgttgggaacactggactttatgtcgagctgcatctgcccttttctccaaccagctgcagcgtctttctcctgaccagattcacaccacgtcttctgtggactcagaggacagacttcgagacttcagaaccatcatacaaagagaaaacaccttaacttatttggagttttcaaccattttttgaccttggagtaaagtaaaatgtaccttttcttttcttttcttttcttttttttgagactgagttttgctctctcgcccaggctggagtgctgtggtgtgatctcagcccacttcagcctctgctcccggattcaagtgattctcctgcctcagcctcctgaatagctggaactacaagcgtatcccaccatgccgggctaatttttgtatttttagtagagatgggttttcactgtgttgtctaggctgatcttaaactcctgacctcaggtgatcctgtcgccttggcctcccaaagtgctgggattacaggcatgagccaccatacctcagcataaatgtatctttctgcccttcaggaggaaagggtttgctcagcaagtgaataacatgcagaaggtcaaagcaagatgtatcatcctactcttagtcaggacctttctgagtgcaacagaaatccagtttgaactcaggcaaaaaggagacctaattggaatgttcatgttcaccatccgtggaaggacagcaactgctggagcccaggattctcttggactgcatggaagaggacacagctgccgacagcttccctgcctttgccaccagtaaaggattgacccacattctctctttgaccccaagtttaaaaaagaaaatccctgggaagtgtaagcaggagtgagatcatggctgcagattgaggacatgctccaaatccctaaatctgatagaacaaatattattaaaaacccatatccatgcaggcaaacaaatgcctttaggggctaagaaatcatgcagaatcctgaaaaggtgtagtgaaaatgggattcaactgaaaaaggaaacaatagccaagattgtacccaggaggtagaaaggtttctaggtgtggatcgctcgagcccaagagtgtgaggctgcagtgagctatgactgcgccatacactccagtctgggtgacagagtgtaagaccctgtccctaggataaaaataaaaataaaaaattataaataaataaattgatgatatagcaagtgaaaaatgacagatatggagtgaataatgtagagttttaaaaatccaggataggtgttttattatacacacaaacctacataagtgataaaattatatggaacttaatacatgcacacactgcacacacaaataaatacaagtaaaactggcaaatctgactgaagtctatagagtgtatcaatgtcaatatcctgatagtaatattgtagttttgtaagatgtcactgcctgtaatcccagcactttgggaggctgaggcgggcagatcacctgaggtcaggagctcgagaccaacctgaccaatatgcagaaaccccatctctactaaaaaatacaaaattagccgggcgtggtggcacatgcctgtaatcctagctactcaggaggccgaggcaggagaatcacttgaacccaggaggtggaggttttggtgagccgagatcacgccattgcactccaggctgggcaacaagggcaaaactccgtctcaaaaaaaaaaaaaaaaaaaaaagatgtcaccattgggggacactggacaaagtatacaagggatctctttgtgttattgcttacagccacatgtgaatttacaattatcaataaaaatttcaatagaaaaatctcttgagagtaacagattagttacaaaaatctaaataactgttagtttaaatggggatgtcaaaatgaaaattttaagcgactgtgtttgaactaaacggcagtaagaacactggatgtaaaaacctatgggatgaagccaaatcagtactcaaaggaaaatatatagccctaaattaatttattcagagacaagtcaagttaaaaattattgaacccagctttcaattcaagaagctagaaaaataaattcagagggtttaaaaagggccaggcaaggtggcttacacctgtaatcccagcactttgggaggctgaggtaggaggattccttgaggccaggagttggagaccagcccttgcaacatagggagaccctgtctctacaaaaaataaaaaattagccaggtgtggtgtggtggtgcacacctgtagtcctagctacttgggaggctgaagggggagggttgcttgaattcaggaggttgaggctgctgtgagctgtgatggtgacattgtaccccagctggggtgcagagttaaaaaataaataatataaaaataaatgttacaactcttttacaaggaaccctgttaccaaaatcaaaggagaactcagtaactcaacaaaactacaggctggtttcacttaaaaaaaaaaaaaaaaacttaaataaaatattagcaaatttcattcaactgaatatattattacagcatgaccaaataggatttattccaagaatggaagggagattcaagagtagaaaagaattttcatctaatttattatattggctgttttaaaattttattttattttgttattgattgagacaaggctcttgctctgtcgctgtagctggagtgcagttgtgtgatcatggctcatgtagccttgatatcctgggttcaaatgagcttccaacctcagcttcccaagtagctaggattacaggcttgcgccaccatgcccagctaattttttaaattttctgtagagatgaggtctccctgtgttgctcaggctgatcttaaactcctgacctcaagaaatccaccagccttactgacaccttcatttcagacttctggcctccagaactgtaagagaataaatttattttgtttaaagccacactcagtttgtggcactttgtgatggttgccctaggaaacaaacaaacccgctgtctattccggggtaagaatagaatggaaaaactaggccaggcaccatggctcacactgtaattccagcactttgggaggtcgaggcaggcagatcatctgaggtcaggagttcaagaccagcctggccaacatggtgaaaccgggtctctactaaaaatacaaaaaaaaaaaaaaaaaaaaacaataaaattaaccgggcatggtggtatgtgcctgtaatctcaactacccgggaggctgaggcaggagacttgcttgaatccaggaggcagaggttgcaatgagccgagatggcgccacggcactccagcatgggcaacagagtgagactgtctcaaaaaaaaaaaaagaatagaatggaaaaacgagaaagatgaacttacatgacctgctggttcccactaacctctacctgagaatttagagtgatcgcagatgggtgttaactcaggcatttgctggagcaaatatagccctctctggaaaaacagaccctcatcctaagcctcaaaagaatttctacaaatatcttccacagaaagtgagcagttcttagtcaaaaataactgagtagaagaagagataaagcactaagagccagagccagcacgaacaatttacagcagaaacagactctggagacttcagatgctgcaatatttaagcatagccaataaaataactgttcagtgcatttaaataaataaaaggcaaagttgagaatatgtgcagagaattaaaagctctaaagaatgatgaagcagatttgaacaacgaaacagaactttaagtcaaacgtggagaaatccagaatacaacactggaagaaaaggaagctgcagagagaataagacacatacgtggagaaagtctaacatttatctaattagagagccagaaagaggagagaaatagaacaaagtctacgtaagtgggattcagcccttaaaaggtggctaatacttctctctagtcctgggcttagtgcttgatttcagcccagccagtcaagtggctcacgaaatagatgccaaaccctttgccttgactcctccccaaccttggtcatttcctcctgcaagaggggtatcaatgagaagtttctgagaactgagaggcctaggacaaggtgtcagcgaggggtgggccttgaggatattgaagacattgcgcaaaatcatgcaaggtcctttccctgcacttcctaactcaagggagtgtcattcatattgtagtacatgagaatggcatcgcttggagttggacagtgcatagcctgtgcaactgaatgcagcaacccagctatctctgatgccttttctgcccaagttatgtgcccatggggctttccaaatttgaccagtggtttttttcctttgtgtttcgtttcttccctgtttccctccctggagaaggatgagatctgtcatcggctggaggattttatggcatgatgaagggaagctaatagctctgtaaagaagagccagttacctgggaaactttccaggcatgttgtgtttctggcagccctgggaggctggactgtaaaggccacaccgctcacaatgctgtggagcaaggcctgggtgaagttgtacagacacgtgaatgtgcctgtcctcacatcccctaaggacactggctgggcctttcgttgtcctctaggtcctctggctctgcctgcttgctcccttctgagttaagcatttggacctggttattggtgacctaagacgcctgggtttcctgctcacctaagagtacagtagatcagtcctgggtcacagcccaggagatacagagtctggtaccattctgccctgactcactgtatggccttgtcaaatgactcagtccctctgggcttttgtgttcccatcttgccctgactgcttctgagcattgagtttccagcgagattgttgtggcagagtgtttataaactgagctgcactgagtgtgtctgagaggaggtggtagttatactaagggcatttgggctgcctggcattgccatatctcattcagggcccagcttgtctctcccaaacctgcccatcagaaagggctgagatgacttcagatacccccacccccagcccacaccatgggcagcaacatccagttgtcctgtttgacgtttatgccctgcacatgctcttgaggagggcaagtctggctccatgaaaagtctgagtcacagacgctgtcaagaaacagggacatggcagggagcgtgcactattcttggagaatcttagctgcgctaaggaacagctaacagagcagtttgtaattagcactttggctgcttggcggcagcgttatctgcctgcagagggtttttttgtgaacatttgccaattacccttcttgagtacctactaagtgccaggccctggctgcctagcacctgctgtgaatggagagacaaatgaaaggtgttatctttttctcttttgtgcaggcaccattctaggattatctactgggattatggcaacaaataagacagacaagttccctgccctcctgtcacctgtgctgggatggagggaggcagtcttcaagtacacaaatcagatcattgcaaagtgtggcaatgggactgaactgggcaggagaggaaatctacactgtagaagggacagggagggcatggcatttgtgcccagacctggttgatgccagggagtgagggagcagctgttccctggcctggggaatgggtgcttcctgggcatggcagcagctggaatggagagctaacatagtgatttcctagcaaagcaagcagccatgtggctggagagtggcgatggaggagctatggctcacgagcaggcagacagggcacacgggatctcacagacctggaagctggaagtaaactgagttgagggatgcacaaagttctgcgggcaacagacaggatcgggaggagacaaggcagggtgaagggcgtcctaggcatggaaccctcctggacaagcacgcttgggagctgctgtcaggtccctctggttatggaaccctcaggcagcacctggcttctccactgtggctcctgtcagagcttttgtaggaggggtgtgtgtgtgtgtgtgtgtgtgtgtgttttagagacagggtcttgctctgtcacccaggctggagtgcagtggcacaatcatagctcggtgtagcctcaaactcctgggctcaagagatcctccagcctcagccttctgagtagctgggactacaggtacatgccaccatgctgggctagttttattattttttgtagaaatggggtctcactatgttgcccaggctggtctcaaactcctggtctccagtgatcctcctgtctcagcctcccaaaatgctgggattatatgcatgagccactgtgcctggccccatgttgaccatttttaagcatacagttctgtgacattaaggacattcacactgttatataaccataaccaccatccatctccaggactttttcatcttcccaaactaaaactctgtcctcattaaacactaactacccagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatgacgtgaaccggggaagcagagcttgcagtgagccgagattgcgccactgcagtccgcagtccggcctgggcgacagagcgagactccgtctcaaaaaaaaaaaacaaaaaaaaaacactaactacccattctcctttccccaagtccctagcacccaccattctactttctgtctctatgaatttgactactttagggacttcctgtaagtggaatcatgcagtatttttccttttgtgtctggtttatttcactttgcttaatgtcttcagagttcatccatgttgtagcatgtgtcagaatgtccttcttttttgaggctgaataatatttcccatcaggttccccccaccctttttttctcattaggttttgatgactcatgtgatgtctgtctgtctctttttttttttttttgagatggagtctcactctgttgcccaggctggagtacagttgtgcaatctcggctcactgcaacctccacctcccaggttcaagtgattgtcctgcctcagcctcttgggtagctgggactacaagtgtgcaccacaatgcctggctaatttttgtatttttagtagatacggggtttcaccatgttggccaggatggtctcgatcttctgacctcatgatctgcctgcttcaacctcccaaagtactgggattacaggcgtgagccattgcacctggccaattctgtctctttttgaggctaaatagtgtttcccctcaggttccccccaccctttttttctcattaggttttgataactcatgtgatgcctgtctcccctggagcctggaggctccctgaggcctgtcttggtcccctgtatccttagcacccatcatagaacctggaccctaagaggtgcttaatgaacatttgttaggtgcatggagttcagagtgactagaattcttactgaaagagggggttggcattgggatgacaatattaaagactttatttgccagactgtggagctttggcttctaggcaaatgtttctgttgatctaagccacctaggggacttgttaaaaattcttattcccaggtctttcccttggcaatgcagctgatttgggctggaaccaagacgcctgtattttgaaagagataccaacctttatttcctagatcatttaagaacattagaataaaaacaagtaaccactctgataaagtttaagtggggctttccctcagccagaaggtttgtacttcctacaaaatattctgaaagaaaaaaacagaaattgtttctctaaatcatgcatctttattaaaaagcattaaagcagctgttagcttgtgttgtatccagagtcaggtgcagccacctttcacgcatcaatacatagctttagcctggaatataccgcttaaattttgggggctttcatttcttccaaaaatgggagcattgttaccttttccaccttgggagatcattctgaagaagcaagaataaaaaggctaaaagaatttgtaagtcataaaatgctattatcaatgctaggggtgcatatgtatataaattgatttaagtatagaagatgatggttcaattcttaagctatttactatcctggctgtacagtaagatacacttgactccatcacttactgagtaataggggcaaggtaccataatgacacaaagccctgggtctccttagttataaaaacggggctaatagccttgcagcacaatattattcagtcataaaaagcaatgaagttctcgcaatgctacaacatgaacctcaaaaacatgatgccaagtgaaaaagcccagacacagaaagcacatattgtatgactccaccaataggaaatgtccagaataggcaaatccatcaaaacagaaagcagcttagtgggtgccaggggctggggcaacgggaagtgactgcttaatgagcttaatgagaaatgggctttctttttgggtgaggaaaatgttctggaattagataggggtgatggttgcacaactctgtgagtatactaaaaaccactttaaagtggtgaattacatggcatgtgagttatatcacaataaaatacttaaataagtggggacaatacatctaactcgggggagttgtgaggattaagtcacttacaatgtattaatagggcccaagtgtgtaaaaccatgggccagatttataaaccaagtagcaagaagaagagtctggttgccaagtgtgcctgccagagggtgggggctgttgggatgtggggtctgatgagaccctggcaccattttcaggagggggccattcacactgggaataccttcaggaaaggcaggactgggcagactgtgtattttctcctacaccctcctcctcacaggatgcatgaaggatgaggggccagggtcggggtggggactaagtctctgactgttagctgccctggcatctgtgtctttaaggagttgactgttgtaatgtggcaagtttgggaaaccctgtcttaggcgacacagagagctgtgggcaatttctctgagctaaagggctgtgacaccctcgctgggacacccagggacggctgggtctgtaccccactcagccatagctattgcagaaggagtcacgggggctcagagtggtgggctggtgcgcctttggtaccatgagtagggtgggcttaaggagacaggactagggacactggctactgacactggctactgagactccagcatggcgtttgtgcctctctggacttgaggttagccccacagcgctccttgcaggctgcacaataccagctgttgttttggagcaacaaaaattcataatttgcagctgataactaacaggcacccgagtaagttggctgacagcctcagtgctggaatcttgcacatggtgggctccaagtggaagtttattgggaggtatgttggccaagtaaagaggagaaccttgtccagggaaaaactcagtcccagcgttgtgcccacctgctcacaagccatggggaggcatctgcagccaacattcaatccatttgtgttaaatgcaggaattaaggaaagactgaatttgatgagaattgtctgccgacttagccacatggaggtcatttgtgaccttgaccaatatggtctcagtggagtgggggtggtcaaagtgggttggaaagagatcaggaggtgagacaatggaaacagcaagtatagctaagcttgaggaggatttgctataaaggggatcaaagaagcgggatggtgccaaggaggtagagttgaggggggctgtggcatgttgttttgttttggttttgcagatatatgggagctataacttgcatgtttgaatgctgatggtgaatgaggaggtccattagggagacaagagaggggagcatttcgggagaaggtccctgaatgacaagagggcatgggccccagtgacagagagttggccttcagtaggagcagagccgtccatgcattgcaacagcagctagtggattggtgcaatgggttggtccatttgatgatgggaatttgaggaaacaaagaagactggagccaggcatggtacacatgcctgtggtcccagctacttaaggaggctgaggcaggaagatcgcttgagcccaggagttggaggctgcagtgagctaagatcacgccactgtgttctatctagcctgggtaaagagtgagactccatctccaaaaaaattaatgataaaaaagtaacgaagactcaagatggagagaaggtataaaatcaggagtgggaaatagtgaaggaactgaatcactgaagtaggactgcaggagctgtgccctcctggagtgtcctgtcagagttttgaaggctggcccagaggagtaagcactcaggggcctttgtattctcattatgtatctactctgtcatcacaagggcttatcaccagttcaggagtaacccaggtgaaaatctcagcagtgcctcttatcaactctggtgtcttggatggttccggaaagctctgatttccctggagaattgattgagctgagttttgctttgggacagggcctgcagcacagccagctctctgccaacaggctctcagcctctaagcatctcagggggccctcccttctgcatgccccagaagctgagacctttcacccctaaaggactggccatttctaaggccagtggcctcctgaaaagccctggcacttcttatgtaggaggatggtctgggtgctgctgctgaaatggtggtggcctcagggaggtgaccaggagtgagaaaggaaggcccctgagcaaaccccagcctacgattttgtagccacagcttagaccctaactgctggggccaaggtcccctctgggcttgtttctgttgtcacatctaagcctcccgtggcattttgtttaagggcccagtcttatttcagccatactcagtgttaaattaggggagcaccaaccctggaggccagtgtggtggtggtagtagctctgtgaccagcagggtccctagaggaccagggtaggaggtgagttccaaataattctccttcatgccatgcttatcatcttggaggctctgagtttcaagcttatttcctcacatgcacatttgtgcccgtttccacccaactgaggttgctatgctgatagccacagccagggaggaggagtcataaaaacagggcccccttgccttgccgcagtccttgagcaggatgcgccctctcggagcctgctctgtggtctgtaccactgcttccctgggtctgttgtttgggttgaggcattacatagcgatgcctcataacttaactctaacatcccactcctgctcctggagctgcagagcactgcaagccccacggtgcccccaggtggccgctgtgctgtgggatctggtgaccaactcctgcagtggcttggcagttgccccagcttggcactccaggtgtacaatggtgagatttatgactttctgtgggatttggggtaactgccgcagtgcccagggctttaaagctctctgggaccccctcttcactgcccaggccagcgttagaggaaggagtcaggtcctgcttaaaggtgtcaaggaatctgtggggggtgggggtaggagctgtgtcctcctgctcaaagtctccttggtccttgcccttccagcctggccacccctgcctcatgaacctgaagctctttctgtgtcacttttctcctctaatgcctgggagtttgtggctgggtggagggagaagctgggagtcagggtcctggttcccaacccagctctctgcctgcttcctgagccttagtctcctcatttgtaaggggagggttggcctgcagcagggtcctctgcttgtttcttagcccagaaatcctttcttcaaaagaaatctctgctggaagcccagtgtctaacacataaaggtggaactactctggggcagggattggacgattctgtgggtctgtgacctctcctgctttcagctccaggacacagagaggcagctgatcagtgctaacctcataacacacaccttcagagcagccacacactcctgcaaccccagcccaggcataaggggatggttgctggacaaagaacagccccttatccgtctgtgctgcctcccattcatccagagctttgggtccctggatacacatagatggttaggggaggcctggggagccttgtctggctgcatctggagaggaagtacttttaccattgcctgcttcagctcctgattgggaaccagtaggtttgggaagcagagagcagaaggaagctctcttagagcaagaggagagggactcaagggaggcagaaggaggttatggatacccacagtcctgagtcccaggcccccagacctgccggtggctccctcgcttcccactactgcaaaaaccggggctcccgctggcttggcttggagtagcttccagacttagtaaccagaatgcagctgaactgcgttgggatggattccatccccccttaactttgcacagcctcactaaattccatctgtgacgtcagacccctgctaatcatggaaaaacagattaagttctataaacacaattctcgtgcttcccctcccagtcagggtgtctcatggcctccgcttaaaggagctgtccacgtcgcctcgtcctgggccaaaccccagtaatccactttaagtcttcatcacatgcctccagcctggccacccctgcctcatgaatctgaagctctttctgtgtcacttttctcctctactccctgggaggttcaggaagatctttgggctccagcctgggaggcccagctggtgctctgtgtcttggtgggaagccatgcccttgattctttgggtgacatccctcacagctcttcttggtcgtctgcctgtgcctggaaccctggtctggatgcatcctgcacctcgcgccttgcccacggctggtctcttgctccatggcctccctgagtggccccactctgacacggtctggccaggtgtttactcaaagacatcagtgaacatggggctgggggttctttctagggtcgtgaatgccagggtctggaacctgaagacttttctaaggccagggcccaggtgccacatttgaagcccagggaagggtccctgtcatccctggagcagagccatgtgggctgtgcatgtgggcgaccacccagaccccttgcctggccttcctccctgaagggcctctggagacctgtatgtgtttttttttctctgtctgtgccaggccccaaaagatgccctgcagacagcagtaaaacataattctgtctaacccgtcacgactccggcagagacgagatgaaatgtgtgtctgtctcgctagcacccaggcagccggactgggtgtaatgaaattgtctgagtgaggagggttcagcttcgggccaagggggctccagggagaggcagacacacaagtcacactgctctgatacgggagggtctgccatgctccctggcctcagctcaaccagggagaaagtgaggaggaccctatctcaccccagtaggtccgtgcctggctgtaaggccaaccagcaccacagcagggctgctcctccttcaggcctaggtttattgtctgcacctgggggtaggcagccctaccaggaagcccacaggccctatatctcagggacccgccttccagaccctgctagggacagcagtgccaccttgttgttcactcttgctagttgaacactggttggaacagggctgagcacttcatgtgcatcacctcatttaatctacagacaccccagctgggcaggggtggttcttacccccagaagacaaaatgaaagatcaaaggattaagcaatttgcccactgtcacagctaacaggtggcagaaggtctagctgattgttttattttaatcacaacactaccagcccttctctgtctgtttacacacacaccactcaaatgctacagctgctgccttctgaaacatcaggtaataaagtgcaggtaaaagttgcccacaaattccatccatctgatggaaccctctccagcattcagtcaacgtttattccacactcttcatacaaacagacatgtacagagtagtaataatctttttttaaaaaagtatcatgttctacatgaatttttaaagtaaaaattaaatttaatcttttttaaaaaaagtatcatgttctacgtgatctttttttaaaaaagtatcatgttctacatgatctttttttaaaaaagtatcgtgttctacatgatctttttttaaaaaagtatcatgttctacatgagtttttaaggtaaaaattaaatttaatgttatttgaatttaaccagacaaatgtatcaattttcatgtatctcaagtgaaatgggagttgctaaactgaggaaaaagatttctttattgtaagtgataatagtcctaaaaggttaaaggtgagagaaaagcttttgaaaatagcttgattgaagtataataacataccatacatatactcatttaaagtatacgattaaatggttttggtatattattgatttttttaaattgtggtaagtatatatataacataaactttgctattttaacagtttttaagtgtactatttcatcacagtaagtatattcacaatgttgagcaaccatcaccactaccacttccaaagcttttttatcacccaaatagaaactctgtaactattaaacaactactcccatttcctccaaccccagcccctggtgacctctaatctattttctgagagaaaaacttttaaaaggttaaagtcattaatttttttttaataataaactttatttattttttgagatagggtctcgctctgttgcccaggctggagtgcagtggcacgatcttggctcactgcaacctccacctcccgggctcaagggatcctcccacctcagcctcccgagtagctggcactacaggcactccaccacacctggctaacttttgtattttttgtagagatggggtttcaccacgttgctcaggctggtctcaaactcctgacctcaagtgatctgcctactttggcctcccaaagtactgggattaaggcgtgagccacctaaactttattttttttaagagctgttttagattcacagcaaaattgagtggcaagtacggagttcccatatgccccttcccccactctcagcatcacacatcaatgtgccctgtttgttacaatgaatgagcctgcagtgacatggcatcgccctaagtccgtagattacacaagggctcactcttgatgttgtactttctgtgggtttggacaaatgtatgaggacatgcatccgccattgtagtatcccacagagtacttttactgccctaaaaatcctccattctctgcctgttcatctctcactaatttttctacctacttaatgaaccaacttctatgctatggaagttgaggaaacgatatttctacctttgttcttctccaaatttgtcttagttgtattatcatttgtgtacagtgttgaggttttgatagtcagttcaatcacataattgccatgatttcaaaatatcaatgccgtgttcatcaggatttctccatttattacctcattttgacttatctttttggttagttggatttcaacatcagataattttttctttttttttgaattttatgtatttatttatttttgagacagggccttgctctgtgattcaggctggagtgcagtagcgcaaacatggctcactgcagccttgacctcctgtgctcaagccatcctctcacctcatctccccaggatgcagcccggccgtgccaggggtgcatggtgggaggccactcgatggagccccatgttcctgccctggggcctttgctcacgctgttccttcttactggattgagtccttctcacacctaccctcagctctgcccttagcctccccaagtgtctggattacaggtgtctgccgccttgcccagctaattttttttaagtgtatgattttttgaagagacagtatctcactgtattgcccaggctggtcttgaactcctgggctcaggtaatcctcctgccttggtttcccaaagtgctaggattataggtgtgagccaccgtgcccggccaggtaattattttttagatgactttaaggatgtctaagcccctaaactcatgcttcagagagccccacctcatctccccaagatgcagcctggccatgccaggggcacatggtgggaagccactcaatggagccccacgttcctgccctggggcctttgctcacgctgttccttcttactggattgagtacttctcacacccgccctcagctctgccgagcagaatcccatggatctcagagagcctggctccgccttccatgaagcctttcctgagacccctctggactgagcaacttatcttgttttcatgacactcatggtaactccagaagtcagatagtattatccccattttatatatggagagaccgaggctcagcaggtacaggggcttttccaggaggtcacacagctggtaaaggcattgtgaggctttgcagtcagatcccagagtgagctccaaactgtcacctcccgtcacattctgtgtcactcttagagttctgagtcctctctcctattagtcacccgtgcatttaactgtaagatatagaacgatttatttgttttttccttcttcctatccatgtatgtacctacttacttacctctacagctctttagttccttgtgggcagaaacacggttgcttttccctaagccagccttgatggaattgcatcctgagcacttgcactttctgatgctcttccaccatgtggctgctgcccttgcacggtcctaagctttgccccactccacccaggtgccaggagcctccaaggggcctctgggccctccaggtgtgtgttccctctctgtctctgtccctctgcctgcacgcaaaaatatcccagcggagctgtggacagcacctgtgcaattaacagctcacctgacagcttgtccgtgggggaacatcattaggtatctgttccagacatgtgctcacagagcctttgaaatcagagacccaagccagtgtctgggtgctggctcaggctgcgagatttcacccctggttgttatttgaggtgatggagacatttaaggaacattatgaatctggctcagggggtcctaccttgctagtgcctggtgagcctggaatctgagaggattgagaaaggactgatttgcatggggatgagcagggcaggtcatgtacgctggaggggttaagactcccaaagggcagaatgcttagactcgtaaggtttctgaagaacatttagagtctgtgtctgaccatgttatttagatgactaaatgagacttgcccactctgggtcactgcatttgccccacagtaaaggagcccacctgaggccccacagaggcggagtgggtgctgcacgtcacacaggtgtactgcttcacaccaagcacctgctgtgccttcctagttgggcgatgctggggcttcaatgaagaaccacgtgaagaagcttcagaaacaacccccattgaacttcaattttcccttcccgtctccaaccctaatttcctccaacttccctcaaacataaagctctctctcctttatgtatgtaagtttctcagatcaggtgcctgtgctaccctcccagccagctggaagtccatccaggtgtcagacttgggtcccttgctacttcggcccagccagctcttgtttcacacctcacaggataaggtgcagcctggggactgtagggccattgcttctctctcctgtgtcctcagcttccagccaggtgtgagaatagacatgtgggcctaggcggagctgagtctgggagtatggggaagaactccacagggcctcaggccctaaacttgcaggtcccatgggctgttagctagacccattgaccttgaagaaggtcagcaatggtcttttttcacttgagcacagcctctggggagctttggggttgatcagggatcagaaaggctggtggacaggtcgcaggagaggggaagcccctcctagcaagagtccttatggatatagcagggcctggggccaccccaaggaggggaacagggcaaggaaacttcccagagagaggggagctagaggggatttctgtgtccaggtgatgctgctcagcagcaccatggggagtctgggtcagagacctccaaggggcagttggggtctgggatccagggttatcttatctacagccagcagatgttgggtgcagtttctggggtatataaagtatctaggctctaatcggctaaaaaagagcttcacttggactatatttaaagcaactggatgtgagaattgggttcttttttaatagagaggagggtcttgctatgtttcccaggctggtcttgagcttgcttgacctcaagcagtccacctgccttggcatcccataatgccaggatggatgtgagaatttgaatgggcttcgggctgacgttcctacctgctgtgaactaaacaactgggagccgctgttttaggctagcacaagggatggagcccctttatcagacctttcctctctctgtctttctccctaagtggcttatttaagaacttcttttaaccctgtctactggtattcctgagagttctgataaatgtttttctcaaccttgttagctacccagtaatgctttagcacctgggtgatactccaatgcccgatagagagccgtgccctggggaagttgcctgactggccaggcccttgcttttatcacttagcaggagtcctgcccatggtcactgtgaatcctccctggctgctgtccttggagtagtcttgctaaaatactaccgttagccgggtgtgggtggcgtgcatctgtagtcccagctactctggaggctgaggcagaaggatagcttgagcccaggagatcaaggctgcagtgagctgggattgcaccactgcactctagcctgggtgcagagtgagaccttgtctctaaacaataaataaatgtaaaatttatttatcatccatcctgaaaaccttcacttggcttcatgttaacagcatgtgacctttggaggtgaccaaatgatatttatggcaaagcttcagccatctggggcttgggttttaaggggtgatttcattttccggataactgagtatgcgcctcttccaagcaccaagtttttgtttttttttttgagacggagtttcactcttgtcccccaggctggagtgcaatggcgcgatctcagctcactgcaacctccgcctcctgggttcaagcgattctcctgcctcagcctcccaagtagttgggaccacaggctcctgccaccacctgcggctaatttttgtgtttttagtagagacggggtttcaccatgttggccagtctggtcttgaacgccgaacctcaagtgatctgcctaccttggcctcccaaagtgctgggattacaagtgtgagccactgtgcccggcccagttaaaaaaaaatgtgattgcttagggacaaatcttcatcaaatatattctttgtcacttaaatagaggtggctatgagcacactctctgcttatcttgtctcatctacttcccagacatagcccaatggaaggaataaaatagatgccaataaatgtttcttattggattgaactgaaaccaaacgttaaatcactcagagtctcccccttgggatgtagtgatgtcatctgcccctaatggcatggctcagactgctgacttgtgaatgtctcatgtctgtgctgcttagttttatttgatctgcctgcttttccatgaccagctatcattactcactgtgtcagtaccggggaaatagatgctgtaccttgttaggattgtgagtaaaacaagagcacggtgttcttaccctggcccttgtttatggagtgacaattctttacttccccgtggctgtttgttgatcagagagcttacacatagcctctcacttgtccttttggtagctgttagcaaacaagaaaaataaaggttggaaaggagagaacctgctcaaagttgcaccgttggatcatgcctgatcagaggccacaattccagcctcaggtgtagaccgggcctttcctctgtgctatggtattcaccagcctttgcagaaagtgactgttctgttctgtcctctctgtctcccaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacaggtgggtcgtggggcaagggtgggtcatggggtgagggtgggtcgcgccagcgcacagacaccacatgtgggttaggtggagttgtggccttcacagtgcagtgcctgccccagaacttcctggtaagtgtgaattgtgctggacccctggcctctaggcacgatgccaggcgcacagagcacaccatgggcgcacggcatcagattgctttccggcactgtgtcccgccgcctacaacgcgaacacttgcccttgcgttcagcaccattatctccctggcccagacgttatccctatgttttcctatgtttcagtttgcctgggctgccatcagtaaataccacaaactgggggcgtagaggaacacacttcctcacagttctgggggccggaagtcccagatcaaggcctggcaagtgcggtttctggtgagggccctcttcctggcttgcacatgggcgccttctccctgtttcctaacatggcagagagtgagcaggctctggtgtcttctctttttctttttctcctctgttttttatttgtgtaaatgtataggatacaactgtaattttgttgcatgcacagattggaaaatggtgcttgtagggtatctatcactcaaataccctgtactcattaagtaatccctcatcttccacccttccttatcttctaaggacaccagtcccattgtgagggccccacccatatgatctcatctagccctgattaccacccaaaggccccatctccaaataccatcacactgggggtcaggccttttagggggacagagacattcagtccataacaccccattctacagacaggaaggcgtatgaggcccagagatgttaaatgccttgccaaggagcacagggcctgtctcctagctcccagctccatgctttcctcaccaccctgactgcttgcaaaaaagcagtgtcagacatgtggctcacttacagacgcacacaggagtttgaggatgacaggctcctttgacgagccagagactcttgcttaggagacacctccagtctccctactcagtgcctgatcaacctggaacacaagacctggctgcctctggctgaccccagatgggaccactgctcccacttgctgcagtcctggctgcagtcctttctatgtagaggttccatcccagctctcctgctggccttctgtccaccctcagtgcctggcatggcctagcccggcagcttccctccaggctgagggtcttcgggcttcccacactgattatgaacctgctgtcagcctggctctggctcctctgggcatatcagtgcctccagtccctgtgacccagtggggcttgccctcctccagcttcttgctgtacaaccccttaattacagcatcagactgagtcgttggtgtgggggaaaggcttcagcagggcctccacctcccatcactggcttcgcctattgggctcccaccttccacccaggtcaggggaggtagctgtgagctcgcagcagagcctgcagccccagctgccttctgggaggagcttgaggaagctgcaagggtttgtccaggctcccctatgtgggagccttggctgggaaaagaacggaaggtgaacccagcctctccggggggctgtttgctctgagctgcttcagaaggaccactcaattccctcttgaaccacttacccgataattatttctagagagtggagagagaggaagcagcttaaatcagccccccatctctgagcactctggaaatagctcagcgtgttcaaggaccaggctgatctgccagtgctgctgttgtcttactgcttctcaattcccacccaagccagggtgaacccagaccacaggagcccctcagctccacctggcctcccggtggctgtcaagatcgggaggactgacctccagcccccaggagatcccaaagctgttctggagcatagaatcacctctgggctcctcaaaacacctgtcactccaggtttttgtttgtttgtttgtttgtttgtttgtttgtttttgagatggagtcttgctctgtcgccaggctggagtgcagcatcgtgatctcggctcactgcaacctccacctcctgggttcaagcgattctcatgcctcagcctccggagtagctgggattacaggcacgcgccaccacacccaactaattttcgtatttttagtagagacagggtttcaccatgttggccaggacagtctcagtctcctgaccttgtgatccactcaccttggcctcccaaagtgctgggattacaggcgtgagccacgatgcccagccacttcagggtttttttgaacacctatccttatgcctcgaatgaatgtaactgttaagcatcatatagttccctgttagacgctcagaccttcctgcagctgtgcagccaggccccgtccatctagccgacacatgcagtgtcttttgagaagctccattgattaggattgtggcaggatggaaacatctcccgccttgcagatcgtgagcatcagcactctcagggcccttcgtgagagcttgttggacagatgggcatcctccccagctaggcagagacactgtggcctctaagggctagctggagtcattgctgctcctctgagcttccagagcctttccctgtgcaccttctgggtgagcaagcatgtgtgcacacgtctgctttcctgttaaaaaagaaaggtgaaagaaaccaggtattgccgggagaggtgcttctgtgacaggcactagcatgcttggaggggagattgggggcaaggctgttggtgttcctgctcaggctggctggctgggcagctctcctctgggcaggccttgaggctgggggtgtcggatagacagcttggtgatgggcagggggtctgctgcacatcacaggtgctagtgccctgcacctgtgtcctctgtgttcttggtgtgtgctgtctccggcctgaggactaattgctgtgtttgaggtgcttcagccctcatgtagttaccaggaagccataggttcctgctagagctactgactgggaagtttcccatgcacttaaggcccctgctggccagccctgccccagctgggtcttagacaggcggatgcatcgctgggttctggcctccacagcccccagtccgagctccaacaaaatgagctccaagatattgccaggcccataggtcgtgtgccctctgaggggcaaaacgctggcctgcctactgtctgcatggacggggctcaggctatcaggtctctatagcatttggaagaaattcttttgggactaggggctttgggcttacttgattggttgttgtcttgttttgcttttattgaggtgaaattcacaaaacattaacaaccatttttaagtgaacaattcagtggcatttagtatactcacaatgttgtgcaaccaccaactttagttccaaaacactttcatcaccccagaaagaaaccccatatccattaaacagtcactcctcactccccctccccaccccctgacaatcactaatgtactacctgtctccctgggtttgcctgttctggacatttcatgtgcatggcatcactcacagtgttgctctttgtgtctggcttctttcactcagtgtcatgttgttgggattcatccatgtcatagcatgtgtcagtgcctcattacgttttatggctgaatcatattccactgtatgaacagaccacattttgcttatccattcatccattgatggacatttgggttgacattagcatacaaatatctgttttcttttttttttttttgagatggagtctcgctctgtcgcccagggtggagtgcagtggcgtcatctcagctcactgcaagctccgcctcccgggttcacgccattctcctgcctcagcctcccgagtagctgggtctacaggcgcgtgccaccacccctggctaattttttgtatttttagtagagacggggtttcaccatgttagccaggatggtctcgagctcctgacctcgtgatccgcccgcctcagcttcccaaagtgctgggattacaggcgtgagccaccgcgcccggcctacaagtatctattttcaattcttccgggtctacacctaggaagggaatttctgggtcacatggtgacgctatgcttgatgtctgcaggaaccaccagactgttttccacagtggctgcaccattttacattcctactgggaatgtatgaagtttccagtttctccacatcctcaccagcacttactgtcctctttttaaataaatgctaccctagtgagtatgttttgaaacagaagagtccccaggttatctcaagggtccttctgcccatctttcagaccagccagcatgctgtgtccttctcggaggcttttctgatctccatgggcagcatgagtgatttctttccctgaatcctcgcagtttcctgtcagtcccacacctgggcacctagtgccttccacctctttgtgggtgtctgtctgcttcctgctggacagtgagtgtctcagggcagggtttaggtctgtgggtctgttttcccagtttctggctcatatcctctttagtgcacatgggctgctcctccctccctcacccatggctctagtgcacacacacacacacacacacacacacacagacacatatgtgtgtccacacacaacatatgtacatgcaagcacagccacctatgcatacaggtatgtacacaaatacatgcagacacatgcacagacctatacagacacatgcatgcacacacaacatgcacacatatgtgcacatgtgtacatgcatctccacagacacacacacacacacacatacaccacaagacccaagggggtagtgctcctcttggttgctttttctgtttttttgagatgaagtctcactctgttccccaggctgaagtgcagtggtgtaatctcagctcactgcaacctttgcctctcgggtttaagcgattcctctgcctcagtctccccagtagctgggattacaggtgcccgcctccatgcctggctaatttttgtatttttagtagagatgggctttcgccatgttggccaggctggtcttgaactcctgacctcaggtgatccacccacagtctcccaaagtgctgggattacaggcatgagccaccatgcacagccagtttctttatctgtaacctaagctaggctctcagagagcatagtttcccattttacatatggggaaattgaggtccacagggccagggttggagctcagatctccgggctcctaggtggcctctttgggacccctagtaggccaagggaggctgctgccaatctcagaggtgagggcaccctggcaggcggagaggaccaggaggtgccagtgtctagattggggaggaggcagcattgggagggatctcccctctcaaccccagcctgtgctgtggctcccaggcctgagggcagagcaggtgggcaggaggggagaggttcaggccaccccgacttggagacccaaggcactacctgtgcccttcctgtcaccaagacccctactgtcagcccaatttccatcttgagagctcttgcccctcctgcagggctggtgtgaatgcccctcttccaggcagcttcctctgaccctctgggtcctgagggcactcattcttcccagccccacctgcccgtctgtgcccgctctagcctttttctaacctgcggttcctggggttcttgtcactgtggggtgatggactcaaaagtgtgaacgtacgtcagaatcaccagctgctcctttacatgtgtacagcttattgtatgtcagtcatacctcagtaacattgctaaaaagtaagttaaagtcacctgactttcctgtgcacttcctgtgccaagggctgagttgcagagggggatgaaagtccttcccgttctctgggaagatagatttcacatacgtttcagcacaggctcaagggcacagtctgcactggcctcccaagatggataggccttcaagaagactgctgtgtttttgtggaaagaataataagaagaccttagttcatcatttcccacttctgccacttgccagccagtggcagctaggaataggccttcctctctgcaagctgccccgctggaaggttgtgaaaaagatgggctgggctcgcgcgtcaaagtacctggcaccctgctggagcagcactcaatatacaccgtgttaaaggtgagaaaacaaaatcgtctgcctggctgggagagggccatccgtccgaggtgttcagcgaatgtgtgccgccgagggagtggccggaggtggcctggccaggaccctgggagcggctgctttcaggggtttcttggtcttgatctttctttgcatcctcccccaactccttcgttagcccctggggagccaggcctgtctctgctgtccaactgccgctgtctctgaaaacagtaccgcagcactgtttaggggaatggtaggcagggacgagggggtggctgctcatgtggcagagatcagagtgattcgagaagagcttgctcctaagtggcatgactgagtagctgtgccaggaggggcctgccccccttggacgccatcactggtggggagccagaggtcagcttggggaggactggctgcccttggtgatgccagctttgaagttcctggtgacagttggaactagaatccattcttcatttgaccaatctttacctagcatctatttcaggaaacaccaaagtgctatacagggggtcccgtctggctcccagtggctctgccactgactgcagccctcacacccctccacagccgactgaatcagtgtccagcaaatgatcagaacctgctttaatcctcacgataacctgcacagttggtggtactcatccccattcatccccatccccagatgacagctcgaggctcagagatatcaaggaacttgcccaagggtgcatagctggcctaatgataccagtctgcccagagatgtggtgggctgcctttttcacattgcttttagtggagcactttgaggtctcctagttcaccccttctctgaagttccagctgttggaggttacatgctctccaccctgtctgactctgaagccagtgctctccctttcacagctctgccttccagtgctcagatactcagagctacacatagcacagggtcacctatgggtggcaaggccaggggtactggagtcagcatgaagagtcaccatacactggggaaagtgctggtgactgaagatgtatgtggccaagggctgggtgggaggtggtgaggactccacctgccccaccgagagatgagggacaggtggggggccatcagtgtagtgtgcttgtttctccagcaggcaggctgaagctcactcacaggaggccattgtgggcactcaccccactggtgaccagtgtcccccccagaatctgcatccacctgcagtctcagaatgtggccttattttgaaatagggcctctgaaggtgtaatttgttaaggatcttgaaatgagatcattctggatttagagaggtccctgaatgaatgactagtgtccctataagaaaaggaaaggaccaagacacaggaaagatgaagcagagattggagagatacagcatgggccaaggagcactgggagccagcagcagctggaagaggcaggaggcatcctccctagaccgcacaggatgctactgggtgagcctgctgtcctggaaaaggcgtgaagtctgcctgagtgggcaggggcttctgcgcagccacccagcaaggccaaggtggaagggaccctcctggcccctgtcctggctccaccctcagctgctggcaggtgggtcaccaggcctctgcccaaagaaactcctgcaggcagctctggaccccctgtcttacacaccttctcactgagcctgccagcatcccaggtatcttatttcctggcgctgccataacaaagaaccacaaactgcatagcttgaaacaatagacatttattctttcacagttctggaggccagaaaccagagaggcaggtgtccgcagggctgcacttcctccaaaggttctacgggtagacccttccttgtctcttccagcttctggtggctccaagcataccttagtttgtggccacgtcactccatttacatcggcaaagaccctatttccaaataaggtcacattccaagggcctggtggggacattccacccattacgccagggcatggacagataggtagtcctgtctccacttagagtttggaaattgacaccaaagagaagtgacttgtccaggaggagagggagctggtcacagagttgggactagaattcatttatttgttcaataagaatttacggagcacctatcttatgctgaggtcttttccttgagccaccttggtgctttgggctgagcaggctctggaatgacacaggtctgaattcaaggcctggctctgccatttagtaactgtgtgaccttggacaagtttgtgcctctcatagcctcgatcgtctcatctgtgacttgggggtaatagtgctaatacacctttcctaaggggatgttgcagtaactaaaggagaatgtacatgcaaagcacttagcatagccacaaataaatgatgctactggaagaggtgggagcttagagcatccaggaagagcttgctgttttcactacaaatctggtccacataggccgagtgcggtggctcacacctgtaatcccagcactttgggaggccgaggcaggcagatcacctgaggttgggagttcgagaccagcctgatggacatggtgaaaccccatctctagtaaaaatacaaaattagccaggtgtggtggctcatgcctgtaatcccagctactcaggaggctgaggcagggaatcgcttgaacccgggaggcagaggatgcggtgagccaagatcacaccattgcaccccagcctgggcaagaagagcgaaactttgtctcaaaaaaaaaaaaaaaaaaatctggtccacattccaggagctcttttaaagagggagagatgacacatgcctgccctgacctcacctatggcctcacccagagtcttgtctgttttttgttttggaaggggactcaatcgctctgggccatggagatatagcacattttttgtgccttagagaggcctgtggctgtgtatgcatgtgcatctgtgtgcctaggtgtatgcacgcacacatacacacctgctgttcaggaagctgaccgaggatgcccttggctagcccatcatgtcaccatggaaacagatgctcggcttaaagtcgccactgcctcaaacatgaggtttcctgcataagcagaaaactgagcttttggacacggggagggacattcatggcagagagatgcttagaggtgacccatgtctctctcacagtgccagcgaggccccttcctgcttgccacatttgatttttttgatcttagtacaaaaggcaggattggtttctgtttgttttgttttataacagctttattgagatataagtcacacaccacatgactcatccatttaaagtgcacagttcggtggtttttagcctattcagagttgtacaaccgtcaccagaatcaattttagaacatttctattaccccaaaaaagaaatcactattttcaccccagccccaggcaaccaataatgtgctttctgtctctatagattccactattctgggtattttatataaatggaatcatacaatatgtgtccttttgtgtctggcttctttcactcagcataatatttccagggttcatccctcttgtatcatgtgccagtgctccgttactttttatggccaaataatattccattccatggtagaccacagtttgtttccccattcatctgttggtggacatttgggttgtttccactttttggctacagtgaataatgctgccataaatattcatgtataagtttttatgtggacatatgttttccttttcttggatatttacctagagtggaattgctgggtcatatggtaactctatgtttaactttttgaggaaccgccaaactgtttgccacagcagctgcaccattttacgttcccaccatcaatgtacgagggttccattgctccacaccctgaacaacacttgctgctgtgtgtctttttaaccgccccagtgagtgtgaagtggtatctcattatggttttgatttgcatttccctaatgacaaatgatgttgagcatcttttcatttgctcgttgaccatttgtataatctttttgtagaaatgtctgttcaagttctttgcctttattattcttactatttttttagagatggggtcttgctatgtcgctcaggctgaccttgaactcctgggctccagccatcctgccaacttcacctctggagtagctaggtctacaggtgtacagcaccatgcccagctcctttgccagtttttgaatggggttgttgtttctctgttgttgcattggaggagttctgtatatattttggatataagttactataagatatattgtatataaaaattctctcccattttgtacgttgttttttcactttctttttagtgtcctttgaagcataaaagttgttaattttgatgaggtccagtttatctgtcttttcttttgttgcttgtgcttttggtgtcatggctccaaaacgattgccagttcaagttcataggacttatgcctatgttttctcttaagagttttatagtttgagcccttacatttaggagaacgtgtttttaatgagctgttggcagcagccagtgagaaggtggcgtcctctggggagtctgtggacttgtgcattgcccaggagtcccaccagaatcccttctgcctcgccagctacctctaaccctccagcttgtggcccaaacatgttgcttccagtccctggccctcagtttccccatgtataccacaagtaggtcatcttgaggatgtctttgtaagtgtcctcctggttccattttttgccttctctagagatggctctggtcacgtgcaccttctgctccacccagaagagccctgaatccatgggccttggctcctgcatgcacacacacgccacatgtgtgtgcacgcatgcacgcctgcgcactgacattctgagtggcagcttcagtgagcccctcacagggagcacagccctcagttccctgcgccatacaccaagtccaggagacacatttctaccctggggtcaggctctttggcagcaagggccactcctagctgtcccctccctccagtgagctggccccagcccagcctgtgcttcgaactgcctacctcattcagctgtgcaataaattccatgtcagggctaatgggcaggagaagctgctggcccagccaggagacagagtcatgcccctgtggcagggagctgggagaacaagcagagcacagcccgccttgcttggtcccagcggggctctggggagggaggtttgggtggagggccctgggggaagaggcagggcacatcagatccctgagtgtagatgtggcatctggccggtgcccctccttcaggaacagacctccccttcccctcaattcctgccagaccagctacccaccatgcctggtgcctattaggtaggggttgggggttctgatgcacatgcaggtttctgcagtttaatgcaatctgtggctgcttctctgtctctgcactaccacagtcactcatggcctgggagacttggctccagtactctgtgcctcagtttcttacttgtggagtggggagcatgatcccacaacatctcagggctctgaagtgcagagaacaggtgggtgcaaaggcaagttgtaaactgagacagggtcaggagatctcctgcttggggctctcattcatgctctttgcctcccttggtagcctctttttccaggaagccctctctccctgcctgcattggctcctgataatgacagttgagcagttgtggccgctatctgagtctcagccctagtgtgcacgaggagcgctggtgtctgatgctctgtgggtcttccgagcggtcttggtgcctatagctatgaaaagggccttcctccgcagccgcatcctgatcagaggcacagctgagacccagctgcactcctctgccctgtccttttagcccaagtgctgacatcaatggctgatccaggaccagaaaaaggctgagcggagagccgtgctgcctggcccctcctcaccgcccttccccgcacctcttggctgtaccgggagcctctgagcaccggaaatgaagggttttccaggcctggctcttcactccatccttcaggggaactttgaagccatggagacatctggctttggagccatggcgattcccctgccactctccttgctgggataaagccagggcgtggcatcctgggatgatgttccctgctgctgagtgtgcacacaacctgagctcatcctgtgtacgtcagctacacatgctcgcatctaattttctcaacaacctagccagtactattgcttctcctcctcttacagatggggagatgatgacatatagaggttaacttatcagagaccacacagaaagaaagaaaaagaggagggtttgtacccagacatttgaaccacagaaactatgctctaagcccgcatgttctgccacctccctgagagggagcccctcttggaccctgatagctgaaggtaaactccatgccccacatcctcagggaagggcagcttgctgttcaaggggaatggtcttcacctgacaccgcagtggggcttgatttagaaactgtgattcccaggctgagcacagaggcttactcctgtaatcccagcattttgagagaccaaggcactctacaaaaaaataaaaaactagctgggtgtggtggggtgcacgcctgtagtcccagctactctagagtctgaggcagaaggattgcttgagcttggggggtcaaggctgcagtgagccatgatcatgccattgtacttcagcctgggggacagattgagaccctatctcataaataaataaataaactgaaattctcagcaggtgggtcctcagtaaacagggctggggcccctgtggcccacatggtaaagatgtggctcccttttgcctggaccttgtggcctctacccagtttgagcacaggacatgtttgggcacagggtaaggagcagatctcagcccatgggcagggtgggtggctgcgcaggggcatggggcctctatcccaccatggtgggcaggaaaaggctgagtcactggtctgtagtgtaccaagtgtacctgggctcactaatcactttcttttttttttttttttttttttttttgagatggaatttcgctcttgtcgcctaggctgtagtgcaatggcatgatctcagctcactgcaacctctgcctcctaggttcaaagattctcctgcctcagccttccaagtagctgggattagtggcacccaccaccacgcctggctatttttttttattattgtttttagtagagacagggttttgccatgttggccaggctagtctcgaactcctgacctcaggtgatctgcctgcctcagcctcccaaagtgctgggattacaggcatgaaccactgtgcctcgcccactgaccactttcaactgcagcccggcctctcccttctctcctttgccctcagctaccaagatttcatgttcataaagccgctaagtacctggcctacctgctgagcacagaggcatctcctgctgctcccggagctgggggcctcacctcctatctaaacccaggaaagaacacccctgtgggcagctgcccatgccaggggatctcccattctctatacatgtaccaggacgttcttcctgggacccagattagattgtgctcctctcctgcttaaaccctttccttcccttagcatcaaaactgtgctccttttatggccgggcacagtggctcactcctgtaatcccagcactttgggaggcggaggcgggcagatcacttgaggtcaggagtgtgagaccagcctggtcaacatggtgaaaccccatctctactaaaaatacaaaaattagctgggtgtggtggcgcgtgactataatcccagctattcgggaggctgaggtgggagaatcacttgaacctgggaggcggaggttgcagtgagccgagatcatgccatagcactccagcctgggtgacagagccagactctgtctcatctgtctcaaaacaaataaacaaacaaaaataaaaaaataaaaaaacttttgtgatatggcttctgcctagctcccaggcccttccctgccacttcctgcctcgcaggctacacccaggcaactgagtccacacgcttccagggctccctctagacacagaccttcagctctgtcacctgcctccctacccagcatatctgtcctgtccacccctgcctggtgagtgcctccccacctcccagctcccctgcaggtcactttccctgacccccctgaggctgagtgaaggcctcccctcatgtcttctaatcacatgatagttgttctctttggggtaggtcttccacgtactccaagtctggagcagggatgattcttcccaaagcagaccagcctggacaatgacatctctttcttctactttctgtgaactcctctgggtgagggctgcacaggccctccactgggtgggggattttgctatttggggttatttcagctttaactatttggctgatggggcttgcggctttcctggagggagagaggagcgcttgctcattctcagagaccctgctgcctggcaagagtcagctcatagtggtgtgctggagctgtgtcagggagatggctgagtggcagggccctcatcggcctggtgttctaaaggtggggtgctctgagcagcctgcagacttttctttcccagtttcattcctaattctttttcactttttattcaagtgttgtatatatacagaaaagtttatgattcataagtgtctaccctgatggtcttgcaaaaagtgaatatgcctgtgtaaccagcaccaggccaagcaacagaacattcttcagcaaacccctcaggcccccttgacccacgggattttgaaataacttgacagctacttgagctataattcatacaccatataattcacccacttaaagtgtacagttcaaaggttctcggtatattcacagagttgtgcaaccatcaccactacctaattccagagcactttcatcacctcaaaagaaacttgtaccagccaggcacggtggctcattcctgtaatcccagcactttgggaggccgaggcaggtggatcacttggggtcaagagtttgagatcagcctggccaacatggcaaaactctttctctactaataatataaaaattagccaagcttggtggcacacgcctgtaatcccagctacttggtcagctgaggcaggagaatcacttgagcctgggaggcagaggttgcagtgagctgagatctcgccactgcactccagcctgggagacagagtgagactctgtctcaaaaaaaaaaaaaaaaaaaggaaaggaaaggaaaaaaagaaaagaaaagaaaaagaaaaaggaacctgtaccagcctgtaatgccaaagctctgggtggttgagacaggagaattacttgaggccaagagtttgagacaagcctgggcaacatagtgagactccattctctacaaaagaaaattttttaattagttgagcatgtctgggcgtagtggctcatgcctgtaatcccagaactttgggaggccgaggcaggcggatcacttggggtcaggagtttgagaccccaaactcctggccaacatggcaaaacgctgtctttactaataatacaaaaattagtcaggcatggtggtgcacacctgtaatcccagctgcttgggaagctgaggcaggagaatcggttgaacctgggaggcgaaggttgcaatgagcctagatcgtgccactgcactccaacctgtgtgacagaatgagactctgtctcaaaaaaaaaaaaaaaaaaagaaaagaaaaaagaaaagaaattaaaaattattaaattattaaattattttaaaaaattaaccagatgtggtggaatggtcctgtagtctcagctactcaggtggttgaggtgagaggatcactagagcccaagagttagaggttacaacaagctgtgatcatgccagtgccctccagcctgggtgacaaagcaagaggaaagagagaaagagaaagagagagagagagagagagaaaagagggagggagggagggaggaaggaaggaaggaaggaaggaaggaaggaaggaaggaaggaaggaaggaaaagtgagagaaagggaagaaagaaaagaaaatgaaggaaaggaaaggagggagggaggaagggatggatggagggagggagggccctgcgcccattagcatcactcttcatttcccccatgttccccagcagcaggccaccactaattcactttctgtctctatatattttccttttctgtactttccatgtaaatggaatcacaggatatgtggtcctttgtgtctggcttgtttcacttaatagaatcttttcaaggttcatccatgttgtggtatgtagcattacttcattcctctttgtgactgaataatattctattattgtatggatagaccacattttattcattcatctgttgatggacacttgagttgtttacagcttttgactagtgtgaataatactgcaatgaacattggtgtacaggtttttctgtgaatacatggcagcagctggtagggctggagtcatctgaaggcttggtgtacaagtatctgttcaagtctctgttttcagttattttgggtgcatacccagaagtggaattgctggtcatatggtaatgctatgtttaactttttgagaaagtgctaaacttttttttttttttttgagatggagtctcactgtcacccaggctagagtgcagtggcacaatctcggctcactgtgacctctgcctcctgggttcaagcaatctcctgcctcagcctcccaaatagctgggattacaggcatgcgccaccacacacgactaatttttgtatttttttagtagagacggtgtttcaccatgttggccagactggtgtcgaactcccgacttcaagtgatccacctgcctcagcctcccaaagtgctgggattacaggagtgagccaccatgcctgccctgctaaactattatcttttctttttttttctttttttttttttgagatggagtctcactctgtcgcccaggctggagtgcagtggcacaatctcggcttattgcaacctccgcctcccaggttcaagcgattctactgcctcagcctcctgagtagctgggactacaggcacacaccaccatgcccggctaatttttgtatttttttagtagagacagggtttcaccatgctggccaggctggtctcaaactcctgacttcatgatccagccacctcagcctcccaaagtgctaggcttacaggcgtgagccaccgcacctggcctactaaactattttcaacagttttacattcccaccattttatattcccaccaatagggttccagtttctccacatgccaaccagcattgattcttttttctaggtttttttgaatactaaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgactctgtctgggacagagcgagatttcatatcaaaaaaaaaaagacagaatcttgctctgtcacccaggctggactgcagtggcgcgatcttggctcactgcaacctctgcctcctgggttcaagcaattctcctacctcagcctcccgagtagctgggattacaggagtgtgccaccacgcccagctactttttgtattttcagtagagacggagttttaccatgttggccaggctggtctctaactcctggcctcaagtgatctgcctgcctcggcctcccaaatggctgggattacaggcataagccaccacacttggccctcattgtggttttgatttgcactttcctaatgaatagtgatgttgaacatcttttcattgcttattggccattcgtatatcttctttggagaaatggctattcaagtcctttgctcatgtttgaattgtgttgttttgttgttgagtttaggagttctttatatattctggatacaagtcccttatcagatacatggtatgcaaatgtcttctcccatttggtgggttgtctttttctctcttcatagtgctctttgatacactaaggtttttaatttcagttaagtccagttcatctattttttcttttgttgcttgtgcttttggtgtcatatttaagaaagcattgccaaatccaaggtcataaagatgaccttgtttgccccagttttcttctgttttatcattttgtgattttatttctttttttaaactaccatttctcaagcatcttatagttttatagttttagttcttatttgtaaatcttggattcatttcgagtttttgtatctgctgtgagatagggtccagcttcattcttttacatgttgttattcaattgtcccagcaccattttttaaagactattatttccacattggatggtcttggcacccttctcaaaaattaattgatcatagatatatggtttatttctagactctcaattatattctgtctgtctgtctgttgatctatttgtctatcctatccagtgctacacttttttgattactgtagttttgtagtaaggtttgatatagggaagtgtgagtcctccagcttggttttgttttgttttcaagattgttttggctcttccgggtctcctgtaattccatatgaattttaggatcagctgttccatttctacaaataaagctgctgggattttgataaagatcgcattatatctgtaggttgtttggggcagtgtcgccatcttaacaatattaaatcttccaatccatcaacacgggatgtctttccatttatttagaactttaatttctttcagcaacattttgtagttttaagtgcacaggtctttcacctctttggttaaatatattcctaggtatttattctttcagaggctattataaatggaattgtttcttaattttctttgacattgttcatttctatgtgtcattttgtattctgcaactttgttgaatttatttattaggtctaacaggctttggtggagattgtttagcattttccatatataagattatggcatcaggaaatcgaaatagttttacttctatctttccaatttggatgcctcttattctttttgtttgttttgttttgttttgtttgttttttgagacagagtctcactttgtcaccaaggctggagtgcagaggcgtgatctcagctcactgcaacctctgcctcccgggttcaagcgattctcctgtttcagcctttgagtacctggggctacaggcatgtgccacatgcctggctaatttttctatttttagtagagacaaggtttcaccatgttgcccaggctggtctcaaactcctgacctcaagtgatctgcccacctcagcctcctgaagtgctgggattataggcgtgacccaatgtgcccagttgcctcttattatttccttttcttgtctaattgctttagctagaacttatagcacaatattgaggaaaagcaaataagtgggcatccttgtcttgttcctgatcttgggaacgcttttagtcctgggacaggtgggagtcagaatataggacttgtgtgtgcagcactaggtctgggagagggagtctgtggccccttcagcctcttgcacaagccctggcatatagatttgggggcctggaagtgacacaggaggagccagcctcgttgaccaaagcccctcctccctttccacacccctgggcccagtctcctgtgccccttccctcctgaagagtgctctggccccacacacattgcaggtgcttttgtccccacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggtgcgcctgctttggcctccatgtgcctcccacctccacatgccatctggcgggaagcaatcttgtggcatagatccaggggatgggatcagccttcaagcaggttcaacaacccataaccccagggaacccaggctttgttccatacaggtgccccgaaggtcacctagggcaggcacaggcaagagagggaaggatatacccctagatgcctcctgactgcctacgtgtggaggccatgaaggcgtgagtcaagcgagggctgttggagactcctttgccattccagaagatgcagggaatgtaaacccacttcaggctccctaagaaggctgagacagccttctggaaagaaactgagggtagaacagatgacccagaagtcccttccaactctgagaccttcagctgctgtgacagtgttgtcccacatcccatgctgagcagggctgtccttgggattccctggcagagggttcttcactctgtgccctgcagtgtgtagcttatcactgctgagttgaatagatgggagctggtcccacaagctgtctactgctgagcaggtggggtccccacaaatctcctggggctcccttccccacgctggtgggcacctggagcttgctgagggatccacggagctttttcctcttcccagtagtactttcccctctaagctcatctccagcctagagagaggctattcccccattgtcagagctggcttcttgggaactagaggtggcatgccccatggagcaccccagcttcctcctgcttggcagtatgctgccatagctgtgcccgtgttcctgccatgctgtggacattggacatggggcttctagaagccactgaggatacactgtcttctgctccccctaaatccttccctgcccccatcctggctgttcttgggacaaagtggcgatccaagaggtggacagggcaggcaagtctcggctaccctccaccctccttccatgcccgctcaccagctccactcctacccagtgggtcaacaggccctggccaggacactgggcctctccaaggacaggtcctgatgagtgctttcctttccgcacaggttcacctgtcctttcgtggagaaattctccatcgacattgaaaccttttataaaactgatgctggagaaaaccccgacgtgttcaacctctctcctgtggaaaagaaccagctgacaatcggtaaccaggaagggcagagccccacagggctgtactctgggtttcctacccacaggtccctcttgtcctgccccttttccccacacctggtagactccagacctggccctgtcctgggcaggcaggtcagagttggagcaagcatggggcccatgggggaggcagggcaggccttctcagccccattctcctgatatatacaccaagtccaagtgccttttccacccagagccgcttccctccatccctttgcgggatccctactccccagaagtacatatgggctcgggcatccatctctagctgacagccatgcacaagtgcccccggcacataatggggtctatgtcctcttgatggtgggtgccctacccactacctccagatgacagtgacatgtaggggatgggccccatttgttaaatcttcattttcaagagaagccagtgataaggatgttcatgagaaatctcccaatactaaatgttagcaaccaattaaaaatctttgtaaataaatgtatgccagtgaaacaaaacacatatgtgggccagtgcagctcagcagccaccctcctgcagcctctgggtacaaggcccaagtcactgtggaggcatctcaggcagggcatgcgggttgggggtgggtgtccatggcccaggagctgctccaggcccaacccccccacctctgctgggatttcctgggtctgcgaaacaaagcgtcatagcatgagtggcttgcacaacacacagttattctctcggggctctggaggccagaagtctgagatcacagcatggtgggttcttccccctggggaagactctgttcaggccccttcagtgtctgcttgccggcagtccttggtgctccttgacttgtagaagcatccctccaatctctgcctcgttcgtcacatggtcactcccctctgtgtctgtctacctctttgtctcctcttcttataaaaacaccagtcatactgggttaggacccaccttaatggccttacttttaacttgattacctctttgaaaaccttatctctagataagatcacattctgaggcactgtgttcagtacgtcagcgtaggaattggggttggggtgtacatagctcttcccatagcaggcagccctgacactgccagagctctgcaggctccctctgaggccagctgccatgggtcctaagtctctgtgacatttcccatgcagggtctttgccggctcacatgggcagggcatatggtctgctccaggaagagtgctcatccctcctggcattctgtggtcctcagacttgctcctgaccctgctgattttggtggagctgatgtctgtgtctgcagtctgcagcctggatacagaggggcccacacattggagaaaatgaggcagccaagggcctggctagagcagaaccgaccgcaaaaaagggttctgtgagccacaaaccctttactggggctctttctcacccagtgagtgccccagtcctgcccaacacacatgtgcctcgggagtgagcacacaggagggctctgagatgctgctgtggaggggaagcctgtgatcataagtggcctggcctacgtcctgcccagagccatcacccatcttcttgtcaccctcaccaggtcctgtcagcccctaagcctgttttctgcactcctacctctgtggcatctgcccctgctctcaggcctagcctggagcaagcttggccagacaccccctgtaggcctcttcagacatctcttccggtctctgtccaggaaggcttttccaacaggccagcctgcctgcatccctctcagcctcagatctatacctgggtccacttggctctcagggaactgtccggtctcctagcttggagagaagtggccggcatgtccagggcatccccattgctctgtgactgctgccatccttctcctcacgcagacaccctggtggttccttccccagaaccccccacctcttgttcaagggccggtgctgctgggacattcttgacctcttgattccacccctctggctgaaacaccgtctttgtgggaagcttttcctagccttctcttctgttcctcccaccctgtattcttcatggaaattcatctccccagtgtttcctcattgccttatttatctgctttgccaagaggtagggtgcactcagaacatgggttttgctgaaatgacttgaaaaggcaacaaggggccaggctcgttggctcatacctgtaatctcagcactttgagaggctgaggtgggaggagtgcttgagcctgggcaacatagcaagacccttatctgaatgaatgaatgcaccaaggaaactgcaggccccactgtcagggattttgaggtcagagctgcccagaacatgatcctcactcccagggtccctctggcagggcaaggcccagagtcctgggaggatttgggggtggaggaacatggagagatgtgggtgggggttgaggtcagggcagaagtggccactctaagggtttacccacagacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggtgagcacacccatgccaggtgggcagtggctgggctacccaacccctctgtctcctgtcacctgcctgtctgcctcctctctttgcatgtctgcctgggagtctgcgtttctgttttgttctgggaaggtgacaccaaagcccatgtccagcttccccactacccgccagccatgggttatcttgaacatccatgaatacttactgagcatctgcagagacaagcagtgtgtgttgttggatgaagaagccctaggcactgcccccagacattcctgacctagttcgcatttgataaagagtagcccacactccacaggtctgagtagcccctggggacaggttccctgctgctcatctgggcctctgggctcccaggcctttgtttcctctactcaaggaggcccagaacccagggccacagctcagcctccctcactgggctggaagctcccaggagcagggtgtctcagacatcatagtggccttcacacccacaccagcctagccagagtaggtgcccatggaacaggtagacagcagatggcctgggggtcctggtgcagtgagtgccatttcctcacctagagccctaaacccccctctgccgaggtcatagcatgatgtcattccaagagctggttccggtccctgaggcccatgacccaaaaggcaccccagccagacaccttgtgatgccatgagcaagggtgactttatttaagattgaacagagccacactgttgacagtacatatcacgcttgtcacgtaagcttacgataacccatgagggtaggcattgtcactccacttatgcaggaggaagcagagacccaacactggggctgaactagatctgcctcccatcccagccacccttgtcctgaattaacatcctcctgttcttagcatcagtaagggaggtgtctcactagacagccatgttcagtgttggggctgtgaccccaagggaagggtggatgtgtacccgaaaggattggggtccaaggacgcggtcttccacttggagaagcgaagacgtggacagggcctcgatgggtgtgttggtgtcaccacctccatccccagggcagaacactcagacacattgtccaccattctttttccagaagggctgctgcggtgtcaatcagcagctgggagaggtggcaggaagagaaggaagctgtcccatccattgagagggatgcattcccacaatccatctctctaaccccatgggagcttagattggcccaaacctgcctctccccattacccagggctcacagactgggacctgcaaccccagtgctgaagcctcaaaatgggaatggtggttctcacttcccaggcaatatgaggagtggaggagcatgtgggcaggactgggaggggctcccctatcctgggcagggcgtcccctaccgcccttctcgacctccaggaacctgaacacatcagcgctggtgactcgtcccaccctctcctcaaggcttctctaggttcagccctgcacaggacacccagcagacctactaaggctgcagctcctggcactctggctctgtgggtctgcttggctctccctagccctacccagcagctgagatcctggccaagctgcagagactccccagctccctgaaagtcagttctcccctcagaaagcaggagcttgtggctggtgggaagaaagaagacaactttagagtccaggcctgactcacacgtagtggctctgtggtctctcagcctcactgagctttgcttttctcttctgtaaaatgggtgtaatgacaccgatcctatcggactgttgtgggccgagaccgtgggttcagaactgaagatggggtgtggcacataggtggagcttgatgacaactgtgagtactagtcctataatatcacggggatgatctcgtgaactcatgtgagctacgctgggcttcttgggggccttgaggaggcaactcctgggggttgggacagctctcagctgtcctcattactgcctggccccagatgtagtgcatgtcccagcccttccggtcaccccaggaggaggcatttccctatatagggtagagcaagggatgcggcccttcctggcagccctgtgaggccagcagacagtcccagaaaaggtaaccaaggctcttcagtgtgccacatctgaggccacccctggggcttgggcaggggacacaggactccatcccacagagaggtctttaagaatggatgggatttagaaaggaaggctgagcaaagccaggggtgggaagtgaggaggcaggaaaagagggtacacaggagaccagcctgggagcctggcgtggcccaactgcttgcaaacccgctcagcatgctctaggggaggcgggggtacatgccctgagattgcttctcccaggtttgtcccctggagaaatccccatgcctgttctggaatgttcattcagagcaccaggtttatgaaagcaaaatggagaaacaatgtaaattagccaaaggcccattggcaggaaaaggaatcaatgaaatgtggcatttcacacacacacggatgccacacaatcccagcttgatgagccaaagcccccacgcgtgcatccatggacaaaactcacccagagaagcaagtggcagaaaaatacagcgtgacacatagatgcggaattcagcaacagccataccagcctgatacagtgtgcaggaaaacacatctgtgtgctgagaccagaaggcaaaacgcatgacaagcaaaattcggggccaactgtcaggggccaggcgagtggagggctccctgtcgccggcgatggtgtgtttcttcgctggggctgtggatgtggatgtctcattgctttttaatgttttttaaacagctttattgaggcataattttagattccatatgattcactcattgtaagataacagtttggtaagttttagtatattcacagctgggcacaacttcagagcattcatcaccccagaaggtcctttgttcccatttcactgtcatccccatcccaccctggcccaaggcaacccccagtctgcttttagtctttatcattctattattattattattattattattattattactattttgagacagggtcttactctgtcacccaggctggagtgcagtggcatgatcatggctcgctgcagccttaaactcctgggctcaagcgatccccccacctccacctcacaagtagctgggaccacagacacacaccaccacgcctggctaattttttttttttttgtcttttctggtagagatgggggatctccctgtgttgcccaggctggtctgaagctcctggcctcaagccatcctctcacctcagcctcccaaagtgctaggattacagatgtgagctaccatgcctggccctttaattgttttttatactttaaaaggtatatattctttactttattctacatcttaatttatatgtataatatattcttatatatctcacgtgcataatatattctactaaaagctttttttaaaaaaacaaaagaaaaggagaaccaacccagtttgaacttgaacttgattttccgtgggaaatttaacaggaaaaatatagcagacactgagacacgagactctcaggaagtcctattctacctcccctgtgcaggaatctcccagaaaattaactgtggcttcttatttatttatcgatttagagacagggtcccactctgttacccaggctggagtgcagtggcacaatcatagctcactgcaggcttaaacccctgggctcaagtgatcctcccacctcggcctctagagtagctgggactacaagcgcacaccagcatgctcagctaatttttttttttaattttttttttttttatagagacagggtcttgtttcgttgcccaggctgatctcaaacccttggactcaagctgtcctcccacctaatcctcccaaagtgttgggattacaggcatgagccactgcgcccttccaactgtggcttctgaccggacacattgctttgggaggcccctccactctaattatagaaccactatgagcttgtgagactatctgtgagccagtccccttattttacaaatggggaaactgaggcacagacaggcagtgactttagtttgacctgcaacatgggtacagcctcccaaagcccctgcctgggccccacacttccgtgcaggctcctgcgctgacctccctcccctcgtctctccctctctgatccccatggggcacaggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggaggtaaggccctgcgccacctgccacccacactcaaggtccctcccctcaaggcagccccacacactgctggatcactgcacctcctcagagttctttcccatggacattgaggcaccaagcccagagggagtcagagccctgggctagtcctcgcacacagggaagcctgggccctgccccagtgggctccccaacacttcccctccatgcccagggaagacagtgctacccataggagcagtggaggtggctgggctcctgcagcgcggtggaggggccacccctcctgatggggaccctaggagacttcagaccctgagattaaggatcaacccaggcaccctgggtggagccagcttctccagcaggcaggcctggctcactcatctcccgcctgggccctgctgtggccaaatttcaggagtttgctcttggtcagactcaggtcagaggcccaggagtggacccaggcctgtcttaccccacgtcctgggcttatgtctgtcatgctcttccccacccatgctccccgggacatgactgccttgtgccaggcggacaggagatgagcctaggccgctccccactcatttacacacttcattctcttcggaaccttcctggctcctgtggcagcctctgtgatgcctgtcaggcctgtgggtggccctccctgcctcctgccggctcagggcagcctctgggcccttcctctccagttggcggtcaatctggggttttgccttccagcgagtccttcccgccacagcatctcagagtggaggatgcagagtattgccagggactcggatgagagctcagatgatgagttcttcgatgcgcacggtaggcaggcagcgctctgcagtccttggggccttcctgggcgaggtggggaggggtctgaaagggcttagggtgtgggtgtggactgatgcgggtgttgcctgttactattctatatccagtccctatacctgcactgtcccaggtggacagcctggtgtttggggcagtgcacagaggatgagatgaggtcatcttgttcccttgagtctggggtctcagaacccgatatcaggatgtgctgtgggcctggcagatggggactgcgctcttgaaaccccaaataaggatacaccatcagactagggctttattccgtatgtgaatttatttccatggaagcataacttcttttaattttctaattttttgtacttaccttatttcttcttgattaaattaataccacatctaatgcaggcactttagaaaatgcaataagcagaaaacatgtgaagtgcccattttcccactagtcccaaaataagcgcatgaccatacagcagatgcaccacctgtgccaggaagaggcatgcatacagcgctcgcctgcttggtgccccagccattcctctccaggaagctggaggggccagcaggtgtaggggttgggggcttgggtccctctgcaagccagtggctgagccagcccaaagttcacacagcagctcagaggctcagaaagggatgggggcgagcccataggcactcagcagacacaggcagcaccagatctcatgtcaccactgtggcttggaggggcacaggaaccacataaggtggcattttggttaactggccagctgccctcaagggaaggaacctggggagtcagtgtccaggcagaagaaaggtgcctggtttggccctgggactggaggacctggaatggtggctggggactcccgagctggcctctgcaccaggagccttgcccaggacggaggaggggcctcttggcgtcccacccctcccaggtggctctctgaccctgatgagaggacaatacgtatttcacatagaaaaagctgtaaaaaagacagcaaagcaggaagtgccaggacagcggtgtcctggggaaatgggcccaggagcccatccaggactggaggggggccggcaagtgccagagccagacagtagccatgagcctggtggtcctgggcagaagttctcagaggagcaggaggaggagtcttggaggcggtgttcatagcagcacttcttatgaagctgtgcttttgtggagggacagggagaggcctgttagaggatatgaaattatatctagataggaggaatgagttctagttctgtgacactgctggatgactagagttaacagtaatgtattaggccaggcacagtggctcacacctgtaatcccagcactttgggaggctgaggcaggtggattgctggagcccaggagtttgagaccagcctgggcaacatggcgaaaccctgtcaataccaaaaataaaaaaatttttttaaaccacagtaatatatagtttcaaatcactggaaggtggaaattgaacattcccaacagaaagaaatgataaatatttgacatgatggatatgctaattaccctaatctgatcaccatgcactggtgtattgaaacatcactgtgtaccccatgaatatgtacaattatgattatttgtcaatttgacaaaacaggaactgggtacggtggctcacgcctgttatcccaacactttgggatcgcttaagcccaggagctcaagaccaactagggtaacatagtgaaacctcgtctctacaaaaataaaaataaaaaaattagccaagtgtcgtggcgcatgcctgtagttccagctactcgggaggctgagatgggaggatcacttgagcccaggaggtcaaggctgcagtaagctatgactgtgccactacactccagcctgggcgtcaaagcaagaccctatctcaaaaaaataaaatatataagaaattttaaaaatggtgaagatggaataaagtaaatgtagcattttttatttttatttattatttatttatttttgagacggagtctcactctgttgcccaggctgaactgcagtggtgcaatctcagctcactgcaatctctgcctcccagattcaagtgattctcatgcctcagcctcccgagtagctgggactacaggcacatgccaccatgcctgcctaatttttgtatttttagtagacggggttttgccacgttggccaggctggtcttgaattcctgacctcaggtgatccacctgactcagccttccaaagtgttgggattacagacgtgaaccaccacccctggcctaaatgtagcttttttttttttttgagacaagagttttgctctgtcgcccagtctggagtgcaacggcaccatctcagctcgctgcaacctccgccacccaggttcaagtaattcgcctgcctcagcctcccgagtagctgagactacaggcgcacaccaccacgcctgactaatttttgtatttttagtagagacgggatttcaccatgttggtcaggctggtcttgaactcctgacctcaagcagtccacccacctcagcctcccagagtgctgggattacaggcatgagccaccatgcctggtcaatatagcatttttaaaaaaacagtcaggaacatcagctgatgagtggacaaacaaaacgggtgtgtccatgcaatggactatggttcagccataaaacggaatgaagcatctgacacacactacaacatagaggagccccagaaaccctatgctgagtgcaagaagccagacacaagaccacatagtgtatggttccatttataggaaatgtccataatagacaaatctgtagagacagaaaattgattggtggtggccaggggccaaggaaggcaagactgaggacccactgctcccgggtatgaggctcccatttagggaggtgagatgttctggaattagatagtggtgatggttgcagggcactgtgaatatactaaatgccactttataaatggtgacttttcttatgtgaatgttaccactattttttgtaatggtcaggaagatgcccaaggtgtggggctgtgtggccgtcctgttgaggaacggtcagagcagagccgtacacaggggcgtccccacctcgggaagccaggcttccccagcgttcccagtcccacctgagtttccctctctcctctccagaggacctgtccgacacagaggaaatgttccccaaggacatcaccaagtggagctccaatgacctcatggacaagatcgagagcccagagccggaagacacacaaggtcagcaggtctgggggtgctgcagagcctggggagggcggttgcagggcttcagccccctcctttctgaccagcttctgcacagtgctgggcatacatgtgagttggggacccccaagctcccctcgtcacagttgcagcctctgtccggtcggccaggttgggctgcccctcagctcacagcacggcttctgtgtctttgcagatggtctgtaccgccagggtgcccctgagttcagggtggcctccagtgtggagcagctgaacatcatagaggtgggtgcccgggtgtcagagggacaggggcatggccgccaagggaggggcagggtgcagaggaatagtctgaggggttacagaggtggaactctgggcctggcagcctcacctccacgcctgcctgggtactgtctggggagaggcctgggcctccttttttgctgccctgctaggaaggcgcctgtcgccctctgtctctgaggtccccgagaaccagggactacagacaacccctgagaaagccttatccaagctccacccatgggaaagtaaaatgagaaacttgtaaattccagatcaaaaataagatcttcaccttgtgcccagcctgtctgctgtccctgaagataaaaagacgaaaagggaggaagcgacagtcgtctaggcagaagtgatgtggccgtggccgacaagatggccccgcgggaggcaggcggagctcagtgtgtccaataaaactgtcttggtagagcgcctgtatccgcttcgggggttctctgtgggagttcatgccccatcctcctccacctgcgggccgtcagagctgtttgcactgggacaggagccagggctgagctgggctgtcccaccatcacctgcggtcaccgcactgctctggcctcaagctacctaaggtggaggcagcaccacttctgtggggaactcgggcccccggggaatctaggcggggaggaggagggacatccacacagcctccccctcctgtggttttctgctttgcggtctgatgccgaggtcagctttctagaaagggtcatggaataaggggagttgatttccaattgctgcttaatgtctagataagcaaacggatccctttccccacctgcagcacacacagctctgacgcccccccaggggaggggcagaaggggcctggggctctggatctgccttggggtgtgtgttcagaacccagcactgattctggggtaccgccatccaaagccaaatccatttgcttgcaagaacccccaaaccggagcccctgctccttgccttgtggagacactagtagggggatgcctctacagctgcagggggctcagccccaactagagcccagggcaggccaggtgtccccttggagaaagcaggctgagtgtagggaggctgtgttccaggggcctctgggggtccctggatcatctccagggctgagcccagtcagacaggcctatgcaggattctctcagcccccagtgccaagcccttctcatcccctggtgacaaagtaccgctggatgtcacctccctgtcgtgaaggctgcgtaagacatttcttccataagcccttcgcctcactggactggaaaaaagcccttgtcaaagcccaacagggctcatgttgttccctcctgccatgtgttctgggcagctggtggccccctctgccctgggctgagtgtgtttgtgtccaggccaaccagtggtggctaatccccatgtgaagacaagtgtcagtcctgccctggcccctgggaagaagagagaagcccttggctcctcctggggtgagggcagcccagccttcctcctccagctcagcagcacccaccaggcttcttgctgctcagtggctcctggcccagcccatccattcccttgcccttcctggtgcccactttttttttttttttttggagacagggtctcactctgtgacccagtttgcagtgcagtggcacgatcttggctcactgcaacctctgcctcctgggtacaaacgattttcctgcctcagcctcccgagtagctgggattacagatgtgcacaaccatgcctggctaatttttgtatttttggtagagacggttttgctatgttggccaggctggtctcaaactcctggcctcaagtgatctgcctgcctcggcctcccaaagtgctgggattacaggctcgagccactgcgcccagccacctggtggcctgttaagtcctggatccagcccctgccctccccacccacccagcctctgtgttggcacctggttcctggtgctacccctaccccctggccagttcagggccagctgtccccaccacaagccctctagatggctttggctccttggtctgtctcctcgggttcttggaggcaggactctcccttcagctcccttccctgcccccacaccccagacatcatatggacacagcaagtactcatcagtggcccctctcaggccctggccctgctgctatcctctggtcacataccagaagcttggggcaggggagggtgacctctggggacagggccacagcctggcctggcaggagagtgctgagtagtggcagaggcttcagattctgatccagcctggcaccgacacgctatgtgatattggcccagtcccccagcctggagcagttcgcagcccctacacaagtgtgcaggtctagggtctcaccttgacctcacaggcaggcctggcctggcaggaaggtggggtcattacctcttgaaatctgatcgacctcctctctaaggtgctggggctccgtccccaccaggacacctctccttttggagaccctggtcttagagagaggccaggaatggcagggccttagggtgggggcctggggagaatgacttgggggagagcttggagctgcaggcagagtagctggggttgccgcccactcaggctgtggatgccctgaccccagccattctcaggtgacctctgtaactttgagctggtggtggccctgtctgctcaggccaagacagacacacacagggcaggcagcccccaaggccaagacaggctgaacctctctgcctcccgctaaagctggaagccccagaagccactgcccgggctccctgaaggaagcagagctcatgctctcaaaggaatggactccctccctccatgtcctctgtgcccctggtgagggtggcagacaggagcagggctgcaggaggaggagtggacaggcccacctccctgcctcctcctgcaggctccagtccctgcaagagtcccaggggaggggttgaggcagccaaaccccaggctccaggcatgagtaaccaaaactggggttctcagagggagcagttgggctgcgtgcaagaggcacacccccaacaagggtgacagaggggcctcagcaaggagctgggttccctggggagctgacactgtcccccaacccatgcaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaagtgagtggcatctgcccttgattgcagcctccggcagtgcactgtcctcctcctacccctgggcctcaggtggctccccagtttcaggactcctgccccgatgtccagacccaccggccagccccttctacctggaggtgcccaaacgtatacacgcaggctaagcctcgagtcccaggaggcctgggcccatggctgagccttcgtttccaaacgtgtaatgtggggatattggcctgcctctgagacatggggtcttacccaccctggtcccccaagcctatccaggccctggccgggaagggtcctcactagcgtatgctgagtccatggctgagactcaggtcaggggagaggggccctttgggctgagctggagccgcctgccctctcttgactggcccctctccccagcctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtgagtcccggggaagttggggaggggaggaggatggaagaccctgtagggcgggctggcctcagggggaaggtgacggcctccccagcctatagtccagcgagcgggtgaatggctcaggcctctggcccctctctcccaaggtctgcctgattggggactgcgtcgggggcatcctggcatttgatgccctgtgctacagtaaccagccggtgtctgagagtcagagcagcagccgccggggcagcgtggtcagcatgcaggtacccaagtgggggcccagacagtccccaaggcctgaagcctcctgcacgcccccagggtggctgccctgcctgttcctgcacctggccccaggctgtgtccaccaagcagaatgctggcagcacttcctgagtccatctggcttggactctacccagttaagctctgttcattcaacaaacattttccaagcccctgacccccaaccctgctgccagagctcacctccaggacaggggctgtggaggggttgggggtgcaggggagctgaggaagcccagcacattctggccaaagagtcaaggaaagtgcctgggccctgaaagagctgtagcagtttttctcacaatctctttcccctcacccttccaaaaaaggatgggaagggcaaaggttggcagcataggtgcccagaggcggcagggcaggtacatgggggcaggggagcagctgctatgtggccaagcctaggaatgcgtgtggtttcatgagcctgaaccagggtctgcactgcgggcagtggggtctggttcctaggaggtgggatgggcgacccctctctgcttccctgcctctgctgcatagtggaaaacggcctgtagaccaatgaggtccagggtggctggtgggtgggaggacagaagggaatggggccctcccctctggtttggcaagaggccggctggacagtggccgcttggcctggggttaggagggaggaggcagcttccaggacactggagaaggggtcaggccagcggccacctggcagtgagcctccacggggccgttccaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccaggtgggcagggctggggggctggggcttgcctctgggtgtgggaagaggctccaagagggaggaacatcccctgtgatggccaacaggagacccgggctgtctgcctgaggttcccccagcctgagacctggaatcccagtctgggcccaggagaaagtggcttactggatgccttgtctcatatacaccaagggccatcttgggcctgagggagcaacttgtcttgagggtgagggtggggaatggcagagttgggggcagaatggaccaggggcaggtggtccagctcagggctgtcctgaagccagtgggcccccgagagaggttgggacctgctgccaccagcagtgtcgtggcagatgatggcagctgcacccacatgacagctaagtcttatttgggtctgcagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatggtgagagcccagcaggggcaggatggggggtacatgcactgggtgcgggggcgggggtctcagtggacccctgtgatgagatcatggccacgtcccaggcctgtttctgccctccttcctgtcttccccaccaagggccccttgctatcctctgctcctgcttcagcagctcagtcactggccgtccgtgacacctgctgtttcatttcatctccggggtgcctgtggatgctgagggtcaacccctagatgggcaagctgaggtccagggagagaaggcaccaccccagagtcagatggagacagacccagcctcccaggtccaaggtcctcccatagggagagatgcagaggccaggcatccccaaagcctcctgggtatagtgggctcccagccctggaggggccacagctgtgcgtctctgtctacccagggcaggcaggccagcggctgggcgtcattggagcagcagtccctgccctgtgccctgggatcagcctgcaaagctccaggagccacacaatcctgagagtagcaacacatgttacactcccagatgacagagggggaaactgaggctcagagaggtttagatgcttgccaagtgcaggttaaaaatgcagagctggccgggcgcggtggctcacgcctgtaatccagcactttgggaggccgaggcgggcggatcagctgaggtcaggagtttgagaccagcctgaccaacatggagaaaccccgtctctactaaaattacaaaattagccaggtgtggcagcacatgcctgtaatcccagctactcgggagcctgaggcaggagaatcgcctgaacacgggagggcggaggttgcggtgagccaagattgtgccattgcactccagcctgggcaacaaaagcgaaactcagtctcaaaaaaaaagaaaaaaaaaaatgcagacctctggactcagcacccaagtgccttccccttccataaactggcgacttcagcactgccaggaagagaaatgggtagctttaaggggaccccaacaaccaaggcagccccatggagggcatccctgtgccccagccactgcaggctctgaacagccccacagagtcccacacaggtgcatggagacttagggacagtaccgttgtggtcccattatgtgtcattgtgaaaaaccagaaccaacttaaatgtccgtctatgtggaggggctggttaaataaattctggcacaaccacacagtggagtacccgcctccactgaaaaagagcaaggagaaactagacgtgctgacatgaaagacgccaacattttttgtgttaaatgggaggaaaaggcaaagttcagaaggcatagcatatgttctggtttatgtccctctaaaagtgagatacagcactaataattaacacaaccttgcattcacgtgatctccttaactccatgacgtggttggaactgctgccccatttgacagaaggggaaacattttccgatacaggcagggcagggctgccctagccagcactcggtggtgctcccgcaagatgagctggagcttcggggggatctggggtggaaggggtttccaccatgtgcccttcatcatatgctcttctgtactgcaaaccaccttttaccacaatcattataacttttgcaatgaaaaaaaattagaggtcaggcgtggtggctcacgcctgtaatcccagcactttgggaggcccaggtgggaggatcacttgagtccaggagtttgagaccagcctggataacatagtaagaccccatctctacaaaaaataaaataaaaaagccaggtgtggtggtgcacacctgtggtcccagctactcaggaggctgagggggtaggatcacttgagcccaggagacggaggctacagtgaaccaagatcgcaccactgccctccagcctgggtgacagagcaagaccctgtctcaaacaaacaaaaaagtgacaatgacccaaacaggtcccaaattgatagagacacaccccccatcttatccctaactttcagcagacaacccagtgcccagttcccaaatttcccacccccaccactgctcctcagggccagccccagctctgcagccaacacccccacccccagttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctgggtgagaggcacattccgccccactcctctgggggaaggtggggtaagcgtggctccctggctcctaggtcctccatgctacgtggttcttccccaggtgagagggacagcttgtgctgaatgcctcttggaggtggacagctgttgggggtggggggtgggggtggtgcatccctccgcactgatccctgtgaggcacaaatgatagttcccacctttcagaggacacaggtcagggccttgttccagggtccccggagcagggaaagggcagaacaagaccagactcccctctccacagctgagcctccatcccaacagagacagagctaaggacccagcagggaccctcacttagtagggggcctgggtcggctgggtcccatcatggcaggcggctggccccgagatagggtgcaggagatgcgttggggcaggggaggtccaggtaggcttggcccgaccccctgccccagcgtgtgtcccagcgtcttgtcacgtcctggtcctcgaggagccctgagtctctgtgtcagagcgtgtctggatggcccatgcaagtgtctgttcttgtcctctgttctctccccgtctgcctccagtcgagaccgtgcagagaaaccctgagctggtcctggagggcggccccctggcccctctcccccacggggacggcttcctggaaaccagtatgcctgttcccgcgcccacctggcaagacgggccccgcccgggctgtgccgagtgtgtgtaccctcccctgctcgtggtgacgtctgcttcgttggttgacctggtcctcagggacaccccccaatccatgccctccttggccactcacagttcgtgggacctgggtggtgaggaacagagacttgggcaggacggctctggggagctgatgtcggtgcttcctccctgcatattgtgggccagaggcagggcagagccaaagcaaaggggcgcagcagctcagagacagcagaggccgtctcagggccacacagcaagtcagcgacagttccagggctctgccagaagcagactgaggccttgagccagccgggcccacccctcacctggggaagcttctggtcccagcgaggggttggattccccaaggcccactccttcgctttctgaggtcacccaggcacctcctgtaccccgtccaggtgtggcttgtctggctgagccccatcctccctgttctgtcctgtcttcagcctgcgcctgggtgagcctggcttgagcccccagcacctgcctttgtccccaaacgcccatcaggggctgctggctgtggcctgtgtgagggatgctcagggcttgcctctctctgtgctctgcatgtgcagggcatccccaggaagccacccatggcacctgttgtcagcgccctgcaaacctgggtggagccgctgcttctgctgtgggctgtgggtcaggtcaggccagggtgagctctggaggccctggagccactggggtgctggagacaagctgaggggtgtgtgtggggcaggagggtgactgaggttgagcccagctgccacgcctccctgccctgtgtctgtgtccattcgtcagtccaccctgccccagccctcctcctcacctgctaaagctctgggccccttcctctcacggccctgagcaggtggctctggcacagctgctgcccagcctccagtctaggtgcacactggaccctggcacactggcttccccactgctccggggctgggcagggcctctcttacctggcctctggtccctgtccacctgcagcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagagtgagtataccaggcccctcaccctcctcactcagccagggccattgtgcccacaggggacagctgctggccatgtctaggagcatttctagctgatgaagctagggagggctgctgctggcacctggtgggtagagggagggaggctgctgggcacctgcagtgcccgggccagccccacagcagagaccggtcaagtccaaagactctgcagtgtctaggctgagaagcttcgccttctcaggaggattctggaagaaggcgcattagtaagggccccgccttcctcatgcttagctcctgcatgaagcctcttggtgcttgaagcacagcccgggttcccttctcagtccccgccaggggctgcgccccgtgctgggccagggattctcgcagctgtggtcagggtggccatgcaggagctgaggctggggtgggggttgctggcagttgtgttcatccgtgaggagggccaatgggctcgcccttgatagctccaggcctggcactgtcccagtgtcctgcctggcccctggtagacgtggcagtgcggtcatccccgcgtggctgagccatccattgctcttgcttctcagaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaaggtaccaccccacacactttcccctcactgggggtcactctgctgctgagcacccctcactgccaggctctgcccacctagacccccgcttcggcctaacagggagctgggggctgggctgggaggacttggccatctagggaggaggtgggagctggtggcattgtctggtggggtgggggaccagggaccccacggagctggagtgaggccagatgaggaccaaggaagctccggggaaagctgtgggcagaacctagggaagcctggacctgtaaaccaggccctgctgctgggcctctcctgcggacagcccagggggcactttacaagcttgtcttgttcaggaaggttgtcctcgcccagcccctagtggcagagccagatgcacccaggaccatccatctggaggcccaggcttccccgcccacactgctgtgtctcagggctcgtagggtggcccaggtgcgagaagggcagcacccttgccctggggatcaggaattgtaaccccatctctgtgccgcctttcccagccttgaggcctgggggaagataggagaacaggaatggcccagagagggcagagatggggttgccacggggcagagggtcaccagagtcaggaagggaccacagacagctggtaccatcccacagatggcgactggtcctcccacgcaaccgcaggagcccctcagcagggctggcactcaccactgtcctgggtctgcgtgcttttgcctgcgctccctcccgcttgcctcactcacccagcctgggagaagactcacttttggctatagctggtggggggactgtgctgggctgagcaggccagaggggccgggtgacccttcggggtccctgtctggggctatacagccccagcccagtcacggcccctcctggcagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtacccggggcctgggacctcccaggagggccctgagtgacaacacccatgacagggccacatttcacagacgaggggacagtggggactcctctccaaccccatcagatcacagagcaagcaagatgagggcacctttatgctcgggtgtattcaggcttttcaggacattgggatggagggaacatatctgcacattcgtcaggtgaacgaacaggggtctgagggctactgggcagacagtagtgagttgaagaacaccccctacaacccacaggctcctcttgctcccgggtactgggcctcctcctcccagggcaggaagcccccgggtggcatctgccccacagcctgcactgtcccctcttcccaggtcatgaggcatgacaactccagcatcttggagctggatggcaaggaagtgtcggtgttcaccccctcaaagccaagggagaagtggcagcgcaagcggacccacgtgaagctgcgggtgagggtcccccgggcgcccaggcccccacgatgtcaccctgtcaccagcctccgtgtccagatgaggaaactgagttgcagggaagcctgcagtcttatgtaccttcccaggccatgaggttggagctgtcagcccacttcacagacagggaaggcagcaaggcttcctagtttctccaaagccacgtcatcgtgtctgatccagactcagacatgggctgcgcagctcacagctcaagcctgcccctcaggcccacagagcttgagcagaacacagggacccggggtgccctccgaccccctgacctgggcttgccactccctccacagaacgtgacggccaaccaccggatcaatgatgcccttgccaatgaggacggcccccaggttctgacgggcaggttcatgtatgggcccctggacatggtcaccctgactggggagaaggtaaggacacggcgggtaggggtaacatggagggactttggggagctccctgctgccctctggccggggtgcagggggtggagaggccagacacagccagcccgtgaccagcctgctgggcccaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggtatatgcctgcactgggagggcgggataggcagggcgaggctctgggtggttctgatgagcacccccaccacctgccaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggtgagtggcccagaggggcacaaaggggctgtagcaaggtgggtgggctcaggggctcccaccagccaggtggaggaggacagcggagcctctgtgggggacgcctggctcgggcactgggccttaaggacctcagttcagagcccagcacccccaattattagccgtgtcaccttgggcaagcgatgtcacttctcaatgtcggctttcaattcccgcatctggaaggtgaggctggtaagccagggacacagcagcaggggcatctgccgcccagtgcgggcacccaagggcctgctgcagcacgtcattgtcaaccattgtcgtcgttactgtctgagctcaatcagagatgtgctttccaatggcccaagtgggccctggctgggcaggagacagggaggcccaggagggaggaaggggtggccatgagacgacacctcacccccaggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgaggtggggcccgggaggatggggcagggcaggggtgggggcagagggaccatggtgcctgtgcccatgccagtctccccacagctgcacctgcgcgtgcacgcggcctatggctccaccaaggacgtggcggtgtacagcgccattagcctgtcccccatgcagatctacatcgtgggccggcccaccaagaagctgcagcagcagtgccaggtgagtgggcgcattgtgggggcgggtgcaggcgggcagctcggggagccccagcctgtgacagccgtcctcactgaccccgcagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcaggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttccttctggatctctttactgcagtggcgaccgtggggcatggtgggatgggggcatggaacagtaatgctagtgacactcacagtgacgccaacacgtgagtgcggggctgactctaggcctagcctgcttctagctccttcctgggatggaactcagtttgccctcacagacctcagtgaaacgggtgctgtgagcctccctgcctcagagtggaagacacagctgggcagtgagagccagacctgccacacaggccacccagccccagcacctggctctgcactgctgcgatctgtggaatgaacatggcaggggaagccgactctctccatgcctgagtgcatggcatttcagagccagctctctgggtttggggttcagctggcatgaggtctggtccaggcaggctgacctgaagaggaaggcacaggcgctggtgtggcctgtgctcacgaccaccagaggacaccccagctttgcccaaaagctcccggagcccttgtttttccctggcagtcatgtagcacccttccctcccactcagcacaaaaagccacagaacagagaaagtctatccagggggcctttaatagctgagaagtgctgctctttcagatgggggtgccaagcaggccggtgaccccaacctccaccccctgcccctgagaagagactgggctgggccagagaccaatccacgggggaaaggccaccagcacccatcaggcttcccactggcaccctgaaacctgcccaggctgggccgccagcgtcgtccacaggccttggccagcgggggccctcagggaagcaacccagctcgcatctggaaggccaggcagtcccctcgggtggcttgctggggaagaaagcacacaggaggaggggtacatcacaaacagagctgggggcggatggcaggcagaggggccacacccaccttgttgatctctctgtgtcgttctttggttacgatttcctctaggacctcgccatctcccttaataagcctgggggtgggagggtctccgttcagcaaggaataggcaggtcccctaatgccagaggagcagaaccacaagcagccggcagaggggtcccagggctcccaccccgcagccttgagtggacagaccctggggcctcacccactctccctgatgaaggcagtggagctgggctctgccttgccagcctcagcccggccaacaacagccctttcaagagcctcctccaggcccttccagcccctgcaactacttactccaagtgaccgtatttttgcccacatttggcctttttcaggcaccaggaaccccgcccggccccactcctcccgagagcacacatcttcagccaacactcccagatcctgtggtgtaagtcaggccgaaagctccccacctggtgcgccccgtctcagggtccaccaccttgcggatgatgctctgccgggcatcccactcctccttggtcatgggcttcatggcctggattcgggacttctgctcatccgtcaggactggaagggaagacggaggtggtggccaggccttgggaagcgaccttctccctctcaggtgctgggcagcacagtacctgggccatcctcttcctccccagctgatcggtgccactggtccagcgaggggcccggcagagcctccacctgctgtgcttccgccttctccttgcccttcttcttcagcttcttcctcttcttcttcttcttcctcctcttgtccttgtacttcccccgcttcttccggccatcactggaggaagaggaggaggacgaggaggaagaagaggagctagaagaactggaagaagaggaggaggagctggatcttgttctcctccgggccttctgcttgcttctctctgtgatgcagggagaaggtgaggctggaaggccaggaggggaagaggtaaaccttcgtcccctgctctggcctggggcaggcacagaccggctacagggtgagcgcttcctgaggggctttccagaacagagatggagcttcccagaggagccccttcctggctcctgcggcgcctggccctcacatctcaggcccggctgcacagaggcatgactgagcgtccccgaccactgctcgcccgacttccccgggtagtaactgcgcctcctctccccgatgcctgtggtcctcaccctccgccccaggggccgtgctggccttgcgaccttgggatgtggaggccgagcagttcctcgaggtgtctttcctgctcttcttctttctcttttccgacccccgtccccgggaccggctgcgactcctcgagcgcttgcgggagccgacgtgagccatggcgccgcgggctggcgacgaagaagacgcgcttgagccgaagcccccaaggccggccgcgggcgggctccaagggtggctctagcggggccggggcctggcgacgcccagtacccgtcaccgtcccgggaaaatgagcgaccctcacccacccccagcgctggggaccccggttttctccgccgactccagtccccgcagcggtgcctgttaagggcccgccccgtgcccggaggccccacgcctgcgcacccggctccaaacccctgggaactggccgccgtccgccgcgagtggcgtctggggcgctttcccgcgctctcctaccctccagccccgcgcccttcgcggcctcgccgcctcaagggggcccccggggctgctccgttcccacctcgaccgccctgcgggccggacagcccgccccgcgccttctcgagaggaagcggcggcgaggaggcttccggccggggcgctgcgcgggaggctggccggctgggaagcgcggcgccgctgcctttcgttctgacgccccaggttccgtcccgggcgcgcccacctcccgcagaggcaagcaggggcgccggccctcgagctccgcagcccctcacgcctgtgtctgccgaagctgcgcccacttccaaggctgccctctcggcgcacgcccgcagcacccacgcccccggtgccctgggaagaaggcgaccctcgcgcgcgccgccctcctccccggctggtcctgccctctccatacgactgcgagctccagactgaggcgccctggtctttccgacgcgcccacccagtgactcagaggtcgcaaactcgtgtccgtaggggccagaaagatcttggcagtgagcgcgggcatggaccccaggcccatccggaaggaagccaggattctgctccagctgatacgtgcaacgtggcatggggctggtgccccaccttcccagggagaccaaactcaagactgcaatatggaagccccctgagtttcaaatgtgtaacccaaagcgtggctgtgcgcttcatccaatctcgggcccccaagttgcaactcttccacaatgacagccgcaaacacaaagggatcttgcaaagcactttatatacgtcagcgcatttgactcccaaaacagctctaggaggtaggtgctaaatgaggaaacgaaggcaccaaaaggtgaaggctcacctaaagccacacagctggaagtggcagaagcagaatgggaacccgggcagcctggttcctggccctgccattcacccctctgccatctagaagatgctactggtggcccacccgagtccactggggggtgatgcctgctgctgagggttcacatctgtgctctctggaggcttcccttggctactggaaggcaccctgccctggagataagtgtctgggaagttattcactcctctctggccccctcatccaggagccagtaaccggtggtgtgggcacactgtggtactgtgggctctgcctggagctctccgtggggccagctgaggctggacgtcctctgaagccacttccttgcccagctgctccctcccctcccctgcttccctgactccctcgctgaagccccattccagaccctgcttctgacaaacctgaactaaggcagcatctttgcccatagaatgacccagaagctggcacaccgttgagccaagaagtgcagtaggctgcggggattttatttctgcccccagaccaaggcaacggagccctcacctgcctgccacccccacactgggcccaagcaagctcaggtgagcgcacatacatccaccgtggcgggctcctctcgggtgaagccatcaccgaagccctcatcgtccaccaggtcgggctcacggcagcacatgggacagaggctgttgcgcacagcagaggctcggagccagacgacaaggttccaacgctcaccagtgcccaagggccgggctccatgcagctggccgccacggtggaggacaccctggcccaccacgtgctccacctccaggggctccgtcagggctgtgggtgcctgcagatggcacgactcaggcctgggcactcacagctgccccaggccctgccgcatgggtcacacactcacctggaagaggcccccaaaatacagggcgccccctgtgaagaccttgcccaaggccacattgagggtgagctcggcattatcatagtggcagcccagctccaggtcctggcccggtgcgtatttgaccacaaaggcccggtggctgtcgagccggcccccgccacagtcagggtacagcagggccatcagcggctgcaggaagcgctcccgcagtggtgtcatcagcggctcgtccagcccgagctcgtgcagcagcacctgggaggggattcctggggtcagcaaggaaactagagggctgcaaccctgggcttccactccacggtgatcccactgtgaccttctttcgcagcccgggcaggcagcccatctgcagaacctctgacactgcctcctgaccccagccaccccctcctctgccaccggccaggcctcacccaccccgtagttgttcatggtgttgggcctccccttaggcatgtccgattgctcgaagtgctccagctcttccagcagggcctggcagaagggcgctgtgaaaacaggcacccggtagatgcgcttctcctctgtggaaggagggatggtctgttggcctgaatgtggccgtgggccggccaggcctgggcttcagtcttcctgtttcatcacctgtgccatggagatgaggcctttgcttttcagggctattgtgatgacttaaggaagtaacatgaggagcaggggaggccgattcccatgccccccacttatgcccggaacctttccccagactctacaagtgtccacagggctggccctgggagctcacatatgggtcctgaggcccagagaggggaaggaagtagcccagggacacccagcaggccagtgacagccaagtcgggatcacagagccaacttcaggctctctctgcacctcctttcatctgatgagccaccgaagtctgtaccccaactcagaagtggctctgggagcctctgtcccccagcaggaaggccagaaggggctgttctttcttgctgggccctgagggggaagaaaccaggctgagaatggaaacctaaacatttcttggcggacgcaccaatgcccaggggtgcagggctagtgtgcccacgatggggccacctcgcagcctaggccctgccccagccaacagcctcagcactatctcagctgccggggagtggaaggcaatgaggagagcacccccaggctgggaggagggggattcattccacccatgactcccaacaaagcacaggctccatgaggggaaacttgtatctgcctcccacaggagcccctagcccaggctatcagtgccaataagaataggaaacactttccaaacactacgtgcgggccctgtgacaggcactctatgcagattaactcacttgatcgtcgcagtgccttaagagagggggttactgttgctcccattttacagatgaggaaactgaatcagaggttaaacaacacgcaaacctcccttgcccagcatttcctgctgggtttagccaataagtgagcccagcaagaaatccgaagagaagtggggcattttttgccctacttggagtttggcatggccgcaggcctccgcccagagccacaactccaggtggtaactgctccctcctgttgccagccctggggggccgggctttgccattccttactggtccctttatcctgcccatacctgtctcaatggtccctttaagatcttggatcagccctgtttgagtgtgccagctgtcccacacatgacacaaatatccactatttgctggatgagggcacgaaggaagggtgaaggaaagaatgaagataccaggctcatggcaggtattgaatgaatgaatgcggatgtcctgctcctggcaggttggtcccactgacccttccagctcctgctggtttggtttttggaggcagagatggtggctggagggaccccagcatcccacacccaggtttcccaggctgccattccctggtcctgccaggtctcagggccaggacctcacccgatactgtctccagccgctggagaaggcccttgaggtctgcgtctggggacacgctgtactcagtcacggccaggaactcgggggccagagctgcatcctgggagcaaaacacaccagctgtggggcaggcagcacccccagccctggatgctacctcctctttccagtaccggccttcaagcactctggctggctggtacctgcagtgagtcgtagacctcaggccgtgccgggtggtaggaactcgcgatgagggctttcctagctgctgactcctgccccagccgctgccgccgctccacctcctgctcaagctggggtggcacagggttgttaccaggtggggcctcccatcctcctgaggccactgtacagatgaagaaactgaagcccagaacgccagacagggcccaggctggaagccaagtctagcctacactcctgaatctatctgggtcaactgcaagttccagactgttagctgaaagggacttctagaaggggacccatcctgtttcaggctgccccaacctgagcctagctgggatgagaacccctagatgtacctcaaccatctgggcccacacagggacaggagacagtcatggccaagtcctgtgttccagaggttgctgaggactctcctgggaagcttcccaccactgactccaggggaaggaggaggagggagtggggcagcagccctggcagcagcctgcggggtatatggtaaggtgtgaggagcccaggggcctggaagctgtggctgggatcacatctgctcctgctgtaaaagcttgggcaagggatccctctttaagcctcagcttctcaatccaaaatgagagtggtgcttgtgcttatctcacagagctgttaagaacggcatgactaggcaacttagcaacttagcatttccccttctctctcctggtgccaagactcaggtgtggagggatgagtggggggcaggaaggaggaaagtgagggcctaagtgacccttcagggatcagggactgaggctaggctcaagctgtgtcctcaagctgcggacacaaatctaacgaggaggagctgtgcaggggcaggggactggtacctctgctaacagctgctggaagtccttggcgctaacacagcctcggctgcgcaggatctgggagcagaaagaacactgagcatgactgtatgacctgaggaaatcccttcactctctaagcctcagtttcccctgcttaaaatggggagaggagccccgacctcaaaggatcatggagagaatgaactgcggaaccctgtcaagctcaggacagggctccgggctggtgttgctgtgaggcggcaagctgagcccggccctgtcctaagcaccctacatgcttgttcattccttcctcacaatctcacagggagatactattacccctttacggtgagaaaaccgaggcagagagaggccgtcattcttgtatttgaagatacggtgcgcggcgtgcgcaaagcaaacgaccctggggacgaacttccctcctccactacccctctctgcccactgctccgtagggacgacagcggccactcaccgggccgtagtcccggcgcagctgctgctcgcctcggaagcgcacgtgcagcccatagcgcgccacgtacaagttatcggtgcagaagcaggcgcagcggcagaagtgccgcggagcccccaccgtcgccatagtgaagcacccacagccctaccagcttccgtagagagacttcgggcacgcccccaaccgcgggaggcgcggaaccagcggccaaggggccgctctaagttcccaagggcggaaaaggacgaagacgcacctcgccaggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagtgagtgtctccaccaaaacgctccgtctcgcattacttccggtggcgttcccaatggacgcgggagggcggggtcaggtgtgggagggcgacggggcgtggtctcaccgcagccaacaaatgacaactcttgcagaccgagcctcttctctccccggacctttgctcaggaatctaccagcattaaacctttgagctaggtactattatatcaccgtcttacagatgaggaaactgagacccagagaggcacagggacccgccgcaggtcacacatccagtaaggggcaaatatggcgtttgaaccctacagagttccccagttaaccaccacagggcttctgggagtggtggaagtatgtgggatttggggttttctcgtgcagagctgcccggcccgagaaggtgtttaacgttttacagtcgtcttgattgcccagtgatagtgagaggccctgctatctaggaaaggatccatttccccagatcaatgttcattacccgcctaactgccctttttccccaggaggcccagggcaggtcggctccccagccacccaccaggcaggcctggcacatgcagcacccccaaccccaccctcaccccctctccgtttgcagcagtttgcaagatgagtgtgttgtacctatcagtttatttatttgtttatttactttttgagatagagtttcacccaggctggagtgcagtggcgcgatctccgctcactgcaacctctgcctcccggattcaagcagttttcctgcctcagcctcccgaatagctgggattatcggcaggcgccaccacgcccagctaatttttttgttttttgtttgtttgtttgtttgttttgagacggagtcttgctctgtcgcccaggctggagtgcagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 677 - DNA, 5319 bp, Homo sapiens
cccagtctcccagctcctccgtccacccatcctggggacacgcgtgctcctcagtgtcctctgtctccaggcatgggctgctgggagagctgcgtgctgggggcggccccctgaggccggcagcatggggagctcagcggacctctgcagggatgggaggctgctgcgcgaccccagcctggctcctgtggtgcacacctcctggctctgatactttgtccccccaccccttccctcacattggcttcctaaaaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggtacccaacctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcagctccaccatgctggatggcacaggtgccctgggcaggtttgactttgagatcaccgacctcttcctcttcgggtgcccgctggggctggtcctggccttgaggaagactgtcatcccagccctggatgggccagccccagctctgcagccaacacccccacccccagttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggtcgagaccgtgcagagaaaccctgagctggtcctggagggcggccccctggcccctctcccccacggggacggcttcctggaaaccacggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagccccagcccagtcacggcccctcctggcagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcaggccccaatactgagagcagcccctccacactgaaaacacccagcactgtgacggagtccagcctggttctgggtcccgtgggccctgctcctgcccacttagcgaggcatgggctccttgcctcacctggccccggcaatcccactgaatttctactctgggcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattggg

SEQ ID NO: 678 - protein, 1532 aa, Homo sapiens [sequence omitted]

SEQ ID NO: 679 - DNA, 57137 bp, Mus musculus
  misc_feature (1)...(57137): n = A,T,C or G
aattctttataaggaaggcttcatttgcttggctctttggacctccttgagtcccacccttgtttgtgtgatgtgcccttgttcacgtttagaagctggtatgggaagatagcaaagataacatggagagttttccttttatttataggttgtttactgtgtaagaaaatttcatgggattaatttgttttcttcagcattctagagtatgcattgtttgaatttttaatctgatgagaggttcggtaccagcaggttaataggtcatagcagttcactagtccgtcctgttagattggcttagtgtggattattttgttccacagtttacaaggactacttctaggatcataattcactacataagaatactaataggagaccttatcatgttcttgaatgctgtattatgaactgcctacgacctaactttagccctctgccctcaagaggcctagctttcttaggattgctgttcactgtgcttctgggtggtaatctttccaatttaggccctctatggtagcttacgttgtttgtttgtttgtttctttgctttttgagacaggctttctctgtgtatccttggttgtcctggaacttacagagatcacttgcctttgtctcctgagtacagggattaaatgcatgtgccactactgcccaacaagatttttttaaaatgaacattatgctcacccccagttcaacttgtatatatcaaaatagctcatacatcccctatattagactgatcctgcatattctgcctttttatagaaatgttagcatttttctagtttcttactcatcttttattcttattttcattggcaattaaaaaaatgggaatttccagaggacccaagtttagttcctaacaccgatatcaggtcacttacaaccacctgaaaccaaagctccaaaggatcatcaggaacctctctagcttctgagagaacctgcgtccatgggacaaacattcatataaatagataatcttctaaagtaatggaaattaagggctgaaggcccagcttagtgatagagcatttgcctagcatgcccaaggtcctgggtttgttacccggcaccacacatacagatttaaaaattgaaaattaatctgatcattttcctcctggttcctctcattttcaaatagttcttcaaatctgttgatctactaagtacttctcatccttttaattctacattatttactcttcacttagccaacaggccacaaagttatccgcatattctttggtattacctgctataatagcttttatgttcaaaggtgtgttaatagtacatttttattgaagtcaaaattatattttttttcttcctttatttggaagcagtggaagaacactaattcattctcctgtgtctacccatatctacttttatctccctcccctcttccttactctgccttccttccacaagctatacttaaaagaaactaaacttttagaaatgagattcttgacttaaaaattttgggcttctcagtatttatattttgaactatatctttttgatctagagaaccactctgtattttagtctgttttctagcatttctgtccactactcactaggtaccagcagcttcctgttttaccccccgttctcaccatttatgacaaataaaacatgtttcttgacactgctaaatttctctttgcaagggataggattttctcaggcaagagctagtaggcttaaaaaagcctttcaggaaatagaggtagaatattaattcctacatgtgtgtgcctgccaacttcttggcagctgaaaacccagtttaaaaaaaaaatatatatatatgtgtgtatgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttataaggttaattaagtacacacacacacacacacacacacacacacacacacacacacacacacacacatatatataatataaggttataatataataaggctatatgtttttacctaattgtcttataaacttagtggagatttatatgcatttatgctttaatgccatcagttacttatatgtgatattctctaagccagcattgtaaaccacagaactattgatgctgtcttaatcaaacaaaatatgatctgtatatgaattcaaatggcttgagaacatgaatctcattctgttactagactggcccaggtcttactggtcttactggtctcagtaaacgtctttcttctgagatttcagtggggtataccaccacacctgggaggaatagaatcataagtaactgataaaactcctcagtgtgttgtgctgaggagatgggtcatcagtgaagagcggttgttgctccttttaaagatttactttatttttatgtatgtgaatgttttgcctgcatgtatctgcgcaccacatgcttgtagtagtacctctggaaacaagaagagggcattggattctcaaggactggaatcagactcttgtgagctgccaaatggtggttaggaattaaactcaggaagagtaaccagtaatcttacctgctgcaaatctctccattcccaacttgttcttagagaagacctgggttctatttctagtgtttacatggtgggtcataatcatctgtaactctagttccaggggatccaacagctttctctaaactctgtaccaggtgtacataacatatatgcaggcaaaacactcatacatttaaaatgaaattaaataaaaaaaattattaaacctcttgtgttcatttttatgatgaggtttggtttttagccaaccaagtgtcaaattaatagaatttttttcccccttcatttctcatttcataggtaggttgttctaatctgggcattagccaggcttctccatcttcattgccttcatttgttcctcaagaaccaaccagtgagccggaataccattcctccaatctcagaatgttgagggtatctcccgacactctgctaacaacgcatacacattcagcaggtatgtagaaaacggaggcattaactaccctttgtatctagggtgtgattattgtcttaccatgccgttctagcagttggatggattaaaggatgcccagatgtcttattttgtgtttttattactgtgataataccatggccaaaatcaacctagggagaaaagggcttatttaatctaaataactttataactgagggaagtcagggcaggaactcagtgaaactggaggcaggaactgaagcgggaaccttggaggaatgctgcttattgtcttgctcctcctggcttgctggttttttcttacatcccaggaccacttggccaggcgatagcaccatccacagcgggtgggtcctttcttcccacatcaatccttagtcaagaaaatgccccacagcttgactttatggaggcattttcttaatggaggtttccttctttcatatgaatgtagcttgtgtttagttgacaaaaaaaattagccaacacaccagataattggtaaagcagcatctacacatacctgaaaggctatctgaggaagagatttgaataagtggactgaatatggaagatctgtctcaccattgtgagtttgtccagttggttgagacctggattgaacaaaaaggtcccactgggacaccttttatctgcccttgagcacagaactccaggttacttggcctttaggcagtttccctgcctttgctcttagactggaattatattgttggcatgattgattttggggttttggagtgtgagccaagctataccatcgggttctttaggcaaacatggtaggatcaatttctccaatttcttcagagaattacctgctaatctttatttagtcatttccatttagtttccccttcaatataaattctaagttttcttttcttatttttcctcttccttttttcctcttttctttttgagataaggatctcactatgtagtgctggctgtcctggaactcaatgtgtagaccaggctggccttgaactcacagaggtctgcctgcctctgccttgagtgctgagattaggtgagtaccaccatgcctggcaaattctaagtttccagtaggccactctcaatctgcttctactactcaccaccttcctcagtaaataatatgctttcctcctcaaaatgatcttctgtgctcttttgtacaagattatttgcattcatacttctcttgagctcaattatttttgccttccagttatgaaaaatgttttgttttgttttttgagaagatggggattcatatagtcagaatgattgtgacccctgaaattttctctttgaaattcttactctcagagtgatggcattaggaagtagagcctttggatggtcacaagaactctagtgacaaactaaggaccttggagtgatcccttgtcactctgcccacatgaacacagtacagtggcatcttctgtttctaagaggcccttgccaagtgctatatctacaagcaccttcatgtaagatgttcttcctccttcttttgtgaaaataggcatgcattctaagtccttgtatgttgggccagaaaggcctccttaagtgttcacatagatgataccactaaactagatctttggaagaaaatatattcagaaactttttttttggccaggctgactggtcagattctggttgttgatctagttgtatttgtctcttcagtgcatgtggactttagatgatattttttgagacttggtcttctctttctattatgggttctaaattaaactcatgttaccaggcttttatggcaagcaatcttaacctgctgaaccaaatcactaagtcttattttttaagcatttgatcatattacttgcaaacaggagggctttgatttcttttccttttctgtttgcatatgttgtatttcttttgtcttattgttgtagataagacttaatatatttaatctgagtggagaaggtaaatactcttagattttcagttatttcccatttaggaatatgttgacttatgtgtaaccttcattatattgagatatgtttcttctgtttctaattcttcagggcttttatcttagtgggtgttggactttgtcaatggtgttttctatatctgttgaggtgattgtgtgatttctgtcagagtttattaatgtcgtatgttgtgcttattgacatatatgtcaaataattcttatattcctggaattaagctaacttggtcattcatggtaaattatccttataatgtattataatgttgaatttagtttgaagtattttactgagattttaagcatttgtgttcttctggtgtacagacatattattttctttttgtgagttcttgtctagcattggtatcagagtaatactgacttcataaaatgaatttggaagtatcccttttttatcctattatatggaatagtttggggaccattggaagttctttaaagacctggtaggggctaaagagatgacttaatgtttaaggagcactggccattcttctagaggaccttggtttgattcccagcatcacatggcagttaacaacatctacaataccaattcacgccagtttacacctttctttggtctctgcaggtattgcatgcatttggtgcacagacatattcggactaaacacccatacacataaagataaataatatttaaagaaaagttctagtgtagagccagagggttggctcagtgggaaaaagcacttgctgtgctaattgggcatttgattcctgtgaaaggagaactgacttttgaatgttgtcttctgacctctaaggcacaacatagtacactggtgtcttagtcactgttctattgctgtgaagagacactatgaccagggtaagtcttacaaaaggaagcattaaactgggggattgcttttagtttctgggacttagttcattatcatcatgatggggaacatggcaacacacaaaggttgtagtagtagctgagactattagattctgatccacgggcagagagagaacctgggcctggcatggggttttgaaaactcaaaccccatccctagtaacacacttgctccaacaaggccacacctcctgatccttctaatcctatcaaaaagttccactccctggtgactaagatttctaatatatgagcatatgggggccaatcttatcaccacaactcgtatttgtgtacacacatacactaagtaaaattaagtattaaaacaaagttttaaaagaagtctgatagtctgggtggtggtgtgtaagcctttaatcccagtttttggaggcagaggcaggtctggtctacagagagagtcccaggacagccagagctacatagagaaaccctgccttgaaaaaccaagggaaaaaaaaaagtctgataaaattcagcaaagacatggcaccatttttaggtgactttgtttaaaaaaaaaaaaaaacaaacttcagactcattgcttgttgtaaatatgtttaagttatttatatcttggtttaatttttatagttcatgtctggtggtttgaatgaaaatggtccctcatagactcatttatttgaatacctggcctccaattggtggaactgtttgggaattgagtgatgtgtctttgttggtggtagtgtgttgccatgagtgggtttttaggtttgaaaagtccatactattcccagtgagtgctctctctgcctagtgattgtatttcaagatgtaaaaacttagctactgctctagggccatacctgcctgccaccatgttccctatcaatgatggttatagacttgccctcttgaaactgtaagccccggttgtagattaaaatacttaatgtaaaacaaaataaaacaaaaaaaggtttctttttaggttgctttggtcatggtgtccatgattaagttctttatttgaaagctctgactttttaaatgtaggtatgtgtagctttaaacttccttcttataatggcttcattgtatctcacaggatctgctgaccagaagattggagcagcagtagtctcttctgcttactcacaggaaataaagcctgggagttttcaccaagaagagttgccagataggcatcttaatgaagagattcggaaagtgtcacctgctcttaggacagctggccagaagccagagatgctaccagtacaatctagttcttactctaaaggaatgaaatctattttctatcaacatcctgtgtcacatggccatcaaggcaaagagcctctaagtgtttcagctgtttgtggatcagctggtaataaagctttccaccagctttccacattatcagacagtctactaactgaagaaacatggccagtttctgttattcctggcctaggtaaccagaagactcctttaccatcagaattctctctttcatattctcatagaggaaagaacctgcccgaagatgttgtgaaagtttccactgattctggatctgctcacaagaaggctgacattctaacagcgtcctctagaacctaccagcacaaaatgaaacctgctaatatttaccaccaagagttgccagacagtcgtgtacctatagggactagaaaggttgcatttgaatctggaccagctggccagaagtctggggtttctcacccatatggtgagatgcccagtgttttctatcagcaggggttgccagataggcattcagcaaaaagccctacaaaaacctttatcccaggaccagctgaccagaagactgatctatcaccagtaccccctacttcctcttcgcatgcagagaagcctgtttccccctaccagttaaccttgccaggtagtcatctacctgaagatgttttcaaagcttcttctgtttgtaagtcatctgatgagctatctggaataacagctctaacctctgcttcctactcatataaagggagacccaatagttcttatcagcagaagtttccagacagccacctaaatgaagaggcccagaaaatcttgggtacaactggaacagtagaccagaagacagtgacaccaacaatgtcttcttcctttttacaaaaagaaaagcctagtattttctaccaacaaaccctgccagatggtggtctgtctgaagaggatctgcaggtttcagctgttccttggccagctgaccagaacattgctataccaacagtaacttctgctgctttctcacaaagagaaaagcctcggattttctaccaacagactctgtcagttgatcgtttgcctggagagcctctgaatgttttagggacttctggaccacctgaccagaacactggggcaccaacagtaactcctagttcctacttccctggagaagagtccattattttttaccaagctggctttccaggtaacactctgtctgcaatgtcttttaaagttccaaggatttctggatcaactgaacagactaacgtaacaacaggatcatcaagttcctactcagttggagagaagtccattattttctaccatcaggccttgccagatggtcgtcttcctcaagaagcttctcctgcaccagctgacctaaacactggggagccaccaatgtatttggcttcctgttctgttggagtaaagcccattattttctaccagcagcctatgtcagatagtcagcgaactaaaggtcacaaagaatcagatgttcctggaccaactgaccagaagactggcatagcaacagtgcattctacttcccaatcatatatagggaggcgcactgtttcttaccagaaagagtttccagatcttagtgaaaaggctttgaaagttctaggtgatgttggatccactgaacagaaaactcaaataccagtagtgtcttctgctctcttacacaaagaggggcctagtgcttaccaggaggatttgccagatcttactgaagaacctttgcaaattttaggtgtttctgaagaagtttcttctagctcttatcagaggaagttaccagatcatattgaagtatttttgaaatcagtaggctctggctctgctgatcggaagactggggcacaaatagtctcctcaagtagagagaagtccagtggttttcatcagcaggagttgccaaatactggtggggatgcagtagatgcttttcatcccgaaccagttgtccaggaggtcaggaaggtacagacgcctggggcaccagcaggaccttctagttcccacttccataaagaaaaactcagtgattatcaaaaggcctcgccacatcgtgatctaactgaaagttctttgaaggcttcaactgttccaggactatctgatcagaaaaagaaacctgcagtctcatctggtttctgcttacacaaagagaaacacgagatttcagcttcagctttgctgaattgccagacagccgagttgctaacagttactcagaggtcctgtttacatagagaggatcctgcaatttcaactgtgatcaaaccagatgaccaaaagattccattaccaacaacttttcatggctccagtgatcaaaaagtaaaacctgttatttttgttcaaaaacagttacgagatagagatcaaagtgaagatattccgaagatttcaactgtctctgagccaactgttgtaaatacagttctaccagtacttctgcctggttcttactcacacagagagaagtcagattcattttacccacaggaactgccagatggacatctaactgaagttgatctgaaggtttcaagcggtcttggtcaagctgaccagatttctgggttacctacaggtattcctggtacttattcacacagtgaaaagcaccagcttatctcagaacatgtccaagagctgatggataacttgaattcttccgagtcgtcttgtctcagtgtggatagtatgcctctaaattcacaaatcgatgatggagttatcatatgtaagccagaatctttaggttttgccaatgctggctgtgaggaaatgcagaatatagatcgtggttcgaaaactcttaaggaaattcagactctcttgatggaagcagaaaatatggcactgaaacgatgcaatttctctgttcccttagtccctttcagagatgttaacgatgtttcatttatacgatcaaagaaggtggtttgcttcaaagaatcctccacaactgatgtttgtacccagagggaatcatttgtagaagaagttccacacattgaatatgtacagaaggacattggcacacagacgaaccttaagtaccagaggggtgttggaaattgggaatttatcagttcagctacctttagaagtcctctacaggaagcagaaggcacagctagaatggcatatgatgaaacttttaggcaatataaagctgccaggtctgtaatgaggtctgaacctgaaggctgcagtacaggcattgggaataaaatgattatccctatgatgacaatcataaagagtgactcgagtagtgatgtaagtgatggttgctgctcatgggacaacaatttaccagagtctttggaatctgtttctgatgtttttctaaacttctttccatatacttcacccaagacaagtataacagatagccgagaagaggagtggttgtcagagagcgaggatggctatggtagtacagattcattggctgcacatgtgaagtaccttctgcagtgtgaaacttcactgaatcaagccaaacagatacttaaaaatgcagaggaagaggaatatcgggtccgaacccaaggtaaggactcactgacataataggcacagccacgcttgtttacagcttagcagtttaaagtgagacatttggagttctacatttgttttcttataaaactgtagaatggtcatattttctatgtaaaatctggaaaataagaacaatgctgtaaatgagacatatgatcagtagtgctagtctgtttatggttttagaaggagattctcatgttagatgtgcagtaagaaagtagtttggccagcagtttaacagacttccttagttaattctcttattgtaatagccttgtctggggacacatatgtctccaatttgttctttggtaagttgtttgtattctaaatctatgtatgctttctctctgttttctaatgacatttttggagttgatctaaagtctaaggggaaagacacttaccaggtctttagtactatatagaggtctaagtctaaagggtatttattagcctcattaatctctaatataatctttgtaaaggagacataataatctttaagacataaggaaatgtattttgggtagtaacttgtacatggttcaggactggctcggaatcttaaggttaactgcttgtgcggttcctgtacatttggattctgtcaaaatctccctagttttgcttgtattaggtatcatagaggtgttagtaacaagtactatggggagatagattttgattagaagaaaaattaagattaatgatttaaatactatatttagattggcttctttggagataaatctgtaggggatggtttaaaaaaactcagaattttagtttatttatggtgacacataattgtaatctctgttctaggaggctgaggcacagagatcataagttcagaattaccctgtgtcttactgggggtttactgctatgaacagataccatgaccaaggcgactcttataaggacaacatttcattggggctgacttacaggtttagaggttcagttcattattatcaaggcaggagcatggagctgagacttctgtatcttcatctgaaggctggtagaagactggcttccaggcagctcgaagaatcttaaagcccatatccacaatgacacatttcctccaacaaggccacacttcctaagagtgagcccaagcatattcaaaccaccacaccctggattacatagaaataccctgctttggtagatggtcagactcttcaatgaagtgacctcttatgaactagtgtgtcacatacttgagaccatatgctcagctttgtgttgtgcattaaggggcagatattggtggttttctttacttgaatagtaatttaaaaattactagtttcacagtttttaaatctcaactgttctgtgatttctttctagcctggaatctaaagtttaatttaggacgtgaccgtggatactccatttcagaattaaatgaagatgacagaaggaaagtagaagagataaaagcaaagttgtttggtcatggaagagcaactcacatgtctgaggtataaaacctagaagtgaaaactgaaactgtgaaagagggcagtagaaacgagagctctgacttactgatgattccagatgagttgctataatcttgtgctaaagtcttagagtcttagttctctaaaagttaagattgaaggactagattctttaagttttgattcattccaaaattatcgtagtagtaaaacagtaattgaggtcttttgccaatgcatttttacagttgagaggttaaacttctccattacatcttataattcagatggaagcttagattcagaagtgtatgttctgtttgaaagtagagttcaagtagttttatgtaaaacagctttctttttaatagtgcttctccccaccccccctttagtggactgtttcttgaatggaagcatttatcttaaaaaaaagaaaattattcctgtgtttcctgtttagctctagaaacagaacattaacagatacaattaacctggacatggtagcatgtactttaatcctagtatttgggaggctaagtccaaaggatcacaagttcaaggccagcaagggctacttagccagattgtatttcaaaaaccaaaccaaatcagcactccccaacccctgacaaatgactttgttttggatctccttccctagacttatctttatttctaatcctgacatgggttggctttctgctcttcagtatgcttttgaattttacatagaaccagcatgatgtgggctgcagaaatgcctcagtggttaagagcaattgttggccttgagtatcagggttcagttcccagcatccatatgtagttcacaatcatccatgactccagttccagggaatctgacactgtcttctgacccccaaagtcaccagacatacctgtggtacacatatatacatgtaaaacattcatgtacaagaaaaaagaaaatcagatgtattcattctttatgaggctaaagttccattttgtatatataccacattttttttcttccacatccctattggacacttaaataccatgttttggctattaacagtagcttttaaaaagaggacctcttgcacacctgtcagtatgttgacttataagattttaggaagaatagtctaaaaatagtgtttgacaggtactaaagcaataagaattcagaaaaaatttatatacattaattttgtggggagggtgccacagtatgcctgtgaaggtcagaggacaatttttaagattctattcttttctctcaccatgttggttctggggattgaactgagtcaggcttggcagcaaatgtttttacttcctgggtcatcttgcctctcaaatactctaaagagtttttttttttttattttatttattttattattatatgtaagtacactgtagctgtattcagacacaccagaagagggagtcagatcttgttacggcatggttgtgagccaccatgtggttgctgggattcgaactctggaccttcggaagagcagtcgggtgctcttacccactgagccatctcaccagcccctctaaagagtttttaaagtagaaaaatcattatgaatttgtttactatgaaaacttgaaagatgccacaggaggaagtaggccactgagaaagagaaatataaatacattttagatgaataccaatatgtaatgatttctagttttgaaagtggaggaaatttatttcttagattaaggcatttgtttcccagtgatctgtcaggaggttccaggctaatcagaagctgcacattaaaaatggcaattccgtgtatttaagtttttttttaagccaactattgttttaaattgtagcatttcatgcagctgtatgaaatgatatggagagaggatatgtgtcctgctgtatccagtttctttactgatcatgtcctacaaagggatgttttgttttgttttgttttgtttgagacagggtctggttgacttggaatttactttgtagactaggctggccttgaattcacaagagatctgcctatctgtctcaagtgctgagataaaaggcatacactactacgcccagccaatgtcttgcaaaattttaatgatcttccccagttatgacatttgctttatagtcatgatactaaaaactgatacttcacaaactgtctgagactgtccttatgtataatagctatatctatgtaccccccttcctacttcttctgtaacacttgtcaaaccctagtttaatctccatttccatattttgtaatttcaagaatgtcataaaatgaagtcatatacatgcatttttttgtgcatgttgacctttcttatttcaaataactgaaatatttgaattgagactaattcacagagatgcccttttttgatgttgaacattcttttaatcttcttatttctcatttttatatcctgtttgttgctcttcctatttgtgtgttatgctggggaccaaacttatacatcatgcatggttgggaagctctttaccactgagctacccacaagccccactgctgagtttgattttttttttttttttttttggtggtatgtgtttgatatgagtgtatatgttcttttttaggaataataatagtaatttatttaaataaatctacttgagttattattattaacattatcatcatcatcattggtttttcaagacaggatttttcctgcatagtcctgggtatcctggaacttgctctatagaccaggctgtcctccaactcagagatccatctgcctctgcctcctgagtgctagaattaaaagcatgcatcaccacatctgactacttttattaattttaagtatgtatatacctgtgtgtctgcatgtaggcatgtgtacatgaatctaggtgcccttggagactttttaaagatggttgtgacctgcttgatttgggtgctgtgaactgaacatgggtcctggaagagcagtcaatgctcttagccactgtgagccatctctctagctccaagtagaacaatttttaaagagtttcctaagtgttcttcattatcatgagccattttattctgtaaagtttcattttttttttcctgctgttccttgatctgtcttatagacaagataacacttgtggttatttttagcttggatataaaactaatcagtatatctctattggattactttttatattttctagggcttacgaagtccacaaggcataggatgtttgccagaagctgtatgtagtcgaattattattgagagccatgagaaaggatgtttcaggactcttactgctgaacaaccacggccagacagctgccattgtgcttttcgatctgttgaaccttcagacttgattagaggacatcggagcccatcatcatggagaggcaggcacatcaacctttccagatcaatagaacagagcaatccctgtttcaaagtagggagttcctttcagttacagagtcatcccccatttcaaaaacttttacctgatgacatcaaaattagcaagggtgttggaatgccagtccatgcatacatggatccccagccatcagaattagtagaacctacttgtgtgccagctaaagaaatggattttccttcctcatctcaaatactgccccctgagcccaagaagcagttcactactgccatcactttttcttctcacgaacactctgagtgcatttctgattcctctggttgtaaggttggtgttactgcagatagccagtgtagtggaccatctttaggggtatttaagcctcatatccccgaagagcagatttctcctagagatcttaaacagaaaacctctttccagtcatcacttgaaaggcatggttctacaccggtgactattttagctgatggtagtaggcaaaggcaaaaattacctgttgattttgagcattctcatcaaaaagaaaaactcttacaaagattaggttttaaagtcagccattctgaacccaatgtcagtacaaatgttagcaatttcaagggagttcaattttctggtaaggataccattgttagccaggacaaactaacttctacagtagaggtaaaagagaagaatgtaactgtaactcctgatcttccttcttgcatttttcttgaacaaccagagctctttgaggaaagccacaccccacatacagatcttcagatgagaaaatacccttctccctcttgtccagaaattgcttctcgcatttttcttgagcagccaaaactctctgaacaaagcaaagccccacatgtagatcgtgaaataagagaagatcactctttctttcctaagtgccaggattatatagttgcagacccttctcccgattttcctgatcagcaacaatgcaaacctccagacgtagttggccacacgagaaaacagaactctcttctttctgaaggtcaggattatgagttagaagaggttcagcatatacctcagtcatacttttctaatatggtaaatgttgaagccaaggtcagtgatgcgatctcccagtcagcccctgaccactgtacagctgcatctactccaccttcaaatagaaaagcactttcatgtgttcgtataactctttgtcccaagacttcttccaagttggatagtggaaccttaggtgaaaggtttcattcattggatcctgcttctaaaacaaggattaatagtgagtttaactctgatctgcgaattatatcttcaaggtcattggaaccaacctccaaattactgacctgtaaaccagtagcacaggatcaagaatctttagtttttctaggacctaaatctccactggacttgcaagtcgcacagtcttctcttccagatagtaagactatttttcaggacttgaaaaccaaacctcctcagaatagccagatagtaacctcaaggcaaacacaagtgaacatttcacatttggaaggatattccaaaccagaggggactccagtatctgcggatgggtgagtcactgtgataacaggcaaaccgatggaatttgtaacaaaggattaagcaatctgaaagactttggggttgggggagggcaatgtgatttctttataggagattgaatctaactggtctggtagaggtcttaagaggtatgtaagtaagcgaatatgtgaaggtattgtaaacgtgaaacgtgaagtaacatgggaagaactttttgtaagatttgacaacagatgtaagaaattggaaactttgaaaagaaccattgttcggcccatagtatatttactatttatttttatattggagattctctgaagatcctgggaggtagcagcataagtgtggagagatttattttggccatagttttagagaggtcaactgatgtttgcttgtttcgatattacatggcgacaagaggatgaggtggaggagccgccaagaaaatacccacggtgatctaatttctcccaactatttcctaccttgaacagttctaccatctcccagtagtctgtttatattttgaatccatcagtaatttaagctatcagagttgtcatgatctaattaaataccctcaaacagatccagtcatttctcaaaacagttaacttcacggtcaggattaaccttatttctgcttgcaattttactctctttgtatatagttctctctctctcctttctagctcatgatttctctattatattttgtattttttagagactccttttaaagccccataactttatagtattgtgttattctgacacataagcactttagccagcccaccagttaatgtatatggttttgatgttcctggatgagaatcctctcttacctcgtgttacaggaatggaactaagttcatggacaggttaattagatttgtcttactcaagctagtattagtaattcatcgctgattcagttttaccttcataagtcttttttaactaaggagaaagaattacctgtatgtaaatggttgagaaaggtagcatactacttcttcccaggggcttgggaagaaagaaggaagaagtgtttattcaaatatctatgggaggggaannnnnnnnnnnnnnnnnnnnggagagggagagggagagggagagggagggatatccttgagacatgttggccaatcagtctaaccgtctgtaaaaggggttacgagcaatgacatccagtaacaaatctggagcttacttcagggtttgtaaatagatgaaatactatgctgcatacaaaagaaaagcgtttgggctggagagatggctcagcggttaagagcactgactgcccttccagaggtcttgagttcaattcccagcaaccacatggtggctcacaaccatctgtaatgggatctgatgccctcttctggtatgtctgtgtactcatatacataaaaaaaaaatcttaaaagaaaaaaagaaaaaagaaaagagttctttagagaactggctgattctgggctggagtgggagtagggcaaaatcctgaagtcactgctctcagaaactgagtaacttaagcactgaattacaactcaaagtgtgaaagagatatgactgagtctactgatgcaaataattaaaagaggaataaatgaatggacgaggtgcaatacttcttacagagaatatcagggatagaagtttctcttggctgggctgggaatatacagttcatcatagtgggggaagggacagtgatggaagtggcaggaattatgatggcaggatgtgaggggaattgttacatctcagccgaacagggagaagagagactagggcaggaagtagggctggttacaattaccagcacccgctccctagcaacccacttccagcagtgaggcatcactttctaagggttctacagcctcccaaaccagtgctattgtctagggctagggacctccttgatggcattttacatccaaatgctgacctattaactgtctttagacctttaactgtcttaaaagacttttttttaattaaaaattttattatttttgtcatgtatatatatatatgtatgtatgtatgtatgtatgtatatatatgtatgtatatacttgcatgcatgcatgtatgcatgtatgtatgtatgtataccataagtgtacagtgcacacagaggccagaagaactggagttacagatggttgtgacccaccatgtaggtgctgtgaacctaatctgggtcctctggcagagcagtaggtgctttaactgctgaactctgtctcatccctttagagacatctttaattttttttttcatggttgattggttaccctggcagaaacgaaatagatttatagtcattgttttcttcacatcaagagaatattaaagaaaatttctcattcacacaaaaaatctcagggagatctgtccataagcaggtctggctggcatgcacaaagcaaatgaagtggattgagctctaatagctagaggagaagacatgtgtgaagggcctacattttcttactggtaagcaaagacttgcttgccaacctgtccagctaaggaactaaagtgggaaaggcgggggaagtcataaaaaggaaattggtgatcaagcatcagaaacagagggaaactattattgtgggtgttgtagtgattgtcatctacatccgtaattcatggactcctgtgctaatatgatggagtgatgcttaaagatttctacagctgtgctcatgagaagcgttcactcaccagtagttttccagtattgaactggaattctttatgaaagtattggtagtctgaagatttggaatcagttttatgtttggtagaattcaccaatgatattgtcattgatggggtagtttttattactagtttattattaatttgtttaatgcatatggctatacagattttttctagtgttttgaaaaaatgttttaaaatttttttttctctagccgggcagtggttgtgcctttaatgcccagnnnnnnnnnnnnnnnnnnnnnnnnnnnnnnnnnnnnnnnnnnnnnnnnnnnnnnnnnnnnnnnnnnnnnnnnnnnnnnnnnncctgcttgaaaaaaaccaaaagaaaaaaccccaaaatttttataagttgacatgtgatatcctgttgtgacattagcttcccctcacccccttttctgataattggtaatctttctgtgaggtaattattgttaagggttaaaaattggggttttggtaagcctctttagtggttttcgttaatttctactcttttgtcatatattttgcatcttaatttgttttgggtttttaccttcttaagagtaaataatgtattcatatttttttgttaattttagcattcttttgtattacatttttagagagtttttttttttaatgtagttttcaggtttttctttgtcccattgactggtgctatgtgtttcttttttcttttcttttcttttcttttcttttcttttcgtttctttgtttttgtttttgtttttgttttttttttcaagacacggtttctctgactagccctggaactcactctgtagaccaagttggcctcaaactcaggccacctgcctctgccttccaagtgctaggattaaaagtgtgcaccgcccctgccctgctggctttgtgttttttaattacattgtaatcacggcagttactcggaagaatgacctcagttactcggaagaatgacctcattcactctatgtaaacatgttcagaattgctttgtgatgtttttattttgaccaacttatggttgtcaagattgtgtgttctgatgctgctgtgttgagcagagaacaatccagttccggctgtcccatgacttgttgctgtatttccgtttgctatatttgtctgctttttagccaagacatggtaggcacatattgcatggtaacatataatcacacttccaagcatgattttctcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgattgaaaaccatcacttgaattacttagtaagactgtagcggctacatgttactatttttaagttattcttttctctacgtaattaaatatgttataagattctttaaagttatataaatatcttagtatttagcaaattcagcttattatttataactatacagaatcatgctttcttatctgagtggcttatgactgtttttatttttaattctctctctctctctctctctctctctctctctctcttcttactctaggccttgaagtcacagaaatctgcctgcttctcccttctaaatgctggaattaaaggcgtgcaccacacccagcctctttctgttctcatagaatcttctctgtagttcaggcctgcttcagccttgtcatcatccttcctgcctcacatattggggttattgtgtgtgtcatgagccctggctattgatgctgctttgctttttcctttttatttgaaataaacacagagtaacaggaaaacacaaaaatagttctgagaagctgaatgtggtggctcaggcatctatgaagctgaggcaaaagaagggttgtcataaattccaagccagcttggcctatatattaagttatagagtaaaactttcaagggctggagagatggctcaggggttaagagagctgactgctcttccagaggacctgggttttaattctcagcacccacatggcagctcataccggtcggtaactccatatctggcattctcactcagacatacattcaggcaagacaccaatgcacataaaaaaaaatagaaaaagatgtttaaaaaattaacgttcaaagagataaagccagcagtggtggtgaacatgtctaatcccagcactcaggaagcagaggcaggtagatcactcttgagttcaaggccagcctggtctacagagctagttctaagacagccaaggctacacagtaaaccctgttttagatgggtttaatgatcttcagctaccaattaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttctgcccactatttctgcatatcactaacaatttactaaaatgttgaataggaatgttgagttgaaaccttattttgttgctatataaaatgattattcacattttactcttaggatggttgttcagatataaagttttaaaagtttttctgtgttttgggtatattcttcattttttctctaatgcaacacactatgtttcctttcctttcctttcctttcctttcctttcctttcctttcctttcctttccttttaaaatttttatcatttttggagttagagaaaagcaccaccaaaagtagctaaatttatttttgaaaactttatatactcgcagaattccttccagtaatcactcagcttctcctatttttctttttttaatttttttttttttgtaattcatcttttacactccatatttccatttccccgcccctccccatccaccctccgactgctccacatcccacatctcccccgttcccccccaatctccgcatggatgcccctacaccctacccccaacctctaaattccctggggcctctagtctcttcagggttaggtacttcatctctgaatgaacacagacctggaagtcctctactgtatgtgtgttaggggcctcatatcagctggtgtatgctgtctgtttggtggtccagtgtttgggagatctggggggcgggaggtccagattaattgagactgctggtcctcctacagaattgcccttctcagcttctttcagcgttccctaattcaacagcaggggtcagctgcttctgtccattggttgagtgtgtacaaataactgcatctgactttcaactgcttgttgggtctttcggagggcagtcatgatagatccctttttgtgagcattccatagcctcagtaatagtgtcaagctttggaacctccccttgagctgaatcccactttgggcctgtcgctggaccttcctttcctcaggcctctctccattccatccctgtaattctttcagacagaagcaattatgggtcacaggtgtgactgtggaaggttcgacaagctttttttgaatcacagaagcattctgaccacagaagcaaatatactatgaagctgtaccattagaaataggagatgctcacaagggcacttcagcttgttgagccttttgaatcctgtggactgtatcttgtatatcaatcccacttgggagagagaagaaagcaatcacaagtgtgtgtgtgtgtatgggggtagtggggacttgggatgggatggcaaacagagcaggcctcttcctctacacaaaaataaaattcaaaattaagatctcggcataaggcttaagcctttaaaactcctgtaggaacgtatagaggaagtacttcaagacatgggcacacatagggtttgacttcctgtggcttaggaggttacagcaagagttgatagactacatttcaagttaaaaagcttctgcagagaaaggaaatattaatcagaatgaaaagatagcatatagaatgcaagaaaatctttccatctattcatctgactggaactactatctgggaaatagtaggaactcaaaaaagtatgcatcaaaactcttatctcccaatcaataaatggaaagaatgagcaattctctaaagagtaagtacaagtgctctataagtatatggaaaaatatttggtatctttacccatcaggaaatgcaaatcagaactaggctgagattccatttcactctagtcagagtagctgatatcaagaaatcaaacaaatgctggcaaggatgcaggggaagggggcagtgttggtggggatatagattttactacagctggtgtggaaggtaatgtggcaatcctataaaccaaaactgtaataccatatgatctaattctaccagttctgggaatatacctgaggaatataagtttactactgaagaaaactgagtatctgtgctgacgactgtactatctacaaaagtcaggtcacaggatcagactagatgttcaacaggagataaatgaataaagaaaatatgcaatctataaaaaatggagttttagtcagccatgaagaaaactgaaatgaagtcctttgcaggaaaatgagtagaggtagagatcattagctaagcttgagacatgccagatgcaggcacacatattacatcgaactttctctcatacatagactctatattttaaaacaatatggaagttaagaaaattaatgaagaacgaagaccaaagtgtggatactttgccacttcttagaattgggaacaaaacacccatggaaggagttacagagacaaagtttggagctgagacaaaaggatggaccatctagagactgccatacccgaggatccatcccacaatcagcctccaaacgctggcaccattgcatacactagcaagattttgctgaaaggaccctgatatagctgtctctcgtgaggctatgctggtgcctagcaaacacagaagtggatgctcacagtcagctattgcatgggtcacagggccccaatggaggagctagagaaagtacccaaggagctggggggatctgcaaccctataggtggaacaacaatatgaactaaacagtacccccagagctcgtgtctctagctgcatatgtatcagaagatggcctagtcggaaagagaggcccattggtcgtgcaaactttatatgcctcagtacaggggaatgccagggccaagaagtgggagtgggtgggggagggtgagggggacttttgggatagcattggaaatgtaaatgaaataaatacctaattaaaaaaaaagaaaattagatgaaataatcgttttgggaagggagaacttataagtgaggaacttggctgaaatcgctaagtattgaaggtacagcttggcttttcttagatgttggttagtaagtaatagagtaagaaaaataagtttttaaaaatgttaatttatttaactttattattttgcatgtgcacaaagttattattaattagatcattagcaacttaactagcagtggttaccctgaataaaattaactcttccacatttgaagcacctaaccttcaagagactggaggtgccagggagtttagaggtcaggtgggggttggagtgggggcatccacgtggaggtggggtggggtgggggaggggtgaggaaatgaaatatggactgtaaaaaatgaattacaaataaaattaaatttaaaaagaaagaaataggagaagctgagtgattgctagaaggaattctgcgtgtatattttctcttccacattcatcagccattaattgccagtagcttctcatcaagaagtgggctgttattgctggaatattgacacatcagaacctgtatgtgtcttgtgtaggtaccacagctgctgtgagagttttactacattggccttgttatatccaaaagacagtatttcagagcactgctcccatttccagcttttacattttgcccacctcttctgcaatgaaggaaacgatttaatgataaaattttaatatcaaaagaagtagagattatttgttggaaaatatctaacatttctgtattataaaaatgagaaagtgtgtttggcagagaacactagtataatggccaagtggccatttgataaagtaagtatggatcagccagatctgttcttataactaagaatactgaagaatatatccaaaggcaattcagatactgttggtgtccttcctgctgctaacccaaagtgcagggacttggggtcattatttcaaaggagacatttcaggtctttgtgcaacttctgtgcttaatgctcagtgctgtcctacagatcttctgtcccatattctatgtcacttcacttcttcaacatctcaggtgtggctctaggaccccaggtatgtgctatacccagcaacattgtggtgaagtgatttagagggtcattgggagaaaccccaaaggctgccagagtcacagggacgagaggtcagagtttttgttcaagattattgatatttccttttctctctttcccttatgaaatgatactgttgtattttggaaggacatactatgttttatgtcattggttcatagttggagaacagtttgtctgcatataaattgtacattgaatctgcctctgataaaggtagtacttagatgacactcaggactttacctcaagagattttactgtaatgtgttaagactatagggatggaatgagtatatttgcatgtgaggacatgaattttgggaaccaggaacagaatgtggtggtttaaatacttagtttcttcaaaagtcacatattaaaatctaatccctactacaatggtgtttggagctatggcatcaacgaagtgtttagggtgagagtgagtgcctcatgaatgagctcaatgcctttatccaaagacgtccctcccatcatggactcatggcagcgtctatgaaccaggaaatagaggtcctcaccagacacataatctcactgcctcattgtccttctgagcctccagactggtaatcagtgagctctgtctaaaggccacacagcctgtggattttgctatgacaatgcaagtatctctctagcctttttcagtatatgacaatcctttttccttccttgtttttaaatggacttggcaattttgaagaatgccagacatttattaaatagatcctccattctagtttgattgatgttttcttgtgattagactgaagctttaaatttgaggaaagaataccacaaatgaaatttaccctcacatcagataggggaaattatacccacaagtatagtgtgatgtcatctttgctcagtaagtaggtgggtttctcactttttaggttgtgttccttgagatctagcctgtgcttgggggtttgggagttggagttaagccttaccttctttggtgaggggtgtgtgcatgttctgtggaatttttcataagcaaaactagccttcctacatgtttgtttatgcaatcattcatttactttgttttaacatgaattctcaataatcttgactaaatacacacagacacaccctttagaacttctggttctgccgggtatggtggtgcatgcctttaatcccagcactcgggaggcagaggcaggcggatttctgagttcgaggccagcctggtctacagagtgagttccaggcagccagggctacacagagaaaccctgtcttgaaaattaaacaaaaagaacttctggttctaccattatgattcctttatgagaagactttgtttcatgtttatctttgtgtcctctgggcatttaatatagcttctattaattgtcaaattaaacaaataaatgagtctattaattttaactaagaagtactgtttcttcagttaaattacataaaggtattagaaattaaaatgattttagaataaataataaacatatgcttgatccctttttactatatattttacaaaatgaagaatactatggaaataggttgttaacatgcgagatcactatacttacaattgcatggttacttaaatattccttgccaaagatatgagttgttttgtctttttttgttgttgttagttcacaagaacagagtaaggtttcctttactacgtcctttggaaagttatcatctgatgccatcactcagataacaacagaaagtccagaaaagaccacattttcatctgaaatttttattcatgcggatgatcgtggacagggcattctagaccccatggcccaaaagccatccaggtttgcctcatcatcctcagtgcagcaaatcccagcttctcatggcaaagacggtaagaggatataactgaattttacatcattaaaccaacctatgtgtaattatctttaaaatgttaattgtctttctcatcattaaacctaattttaatatcagcattatgctataatattactgtatccagtttttgtttgcatacctgtgaaaagaataggattttcatctttattttaaatagagttaataagagtatatgaaattcatgctgctatggctggctgactttgtccagtgatttttgtaaaaatatacttagcatgtaagaactgttggcatttggttcatagtaatatggctttaactgtgtatagtaatagcgtatttcttgcttatgaaataaccatctgagccaggtggtggtggcgcaagcctttaatcccagcacttgggaggcagaggcaggcggatttctgagttcgaggacagcctggtctataagtgagttccaggacagcgagggctacacagagaaaccctgtcttgaaacaaacaaacacaaacacacaaaaaaaccagtgtgtatgaaataattatctgttattcaggaatgttgtttgctgtatggaaatgtgcatacatgtgaaccccgacacatgtgaataagaacatgcacatgtacacataaccatatacacacatatatgaaaagaaaacaaatctccaatggatgctggtgatacagctcactgatggtgtatacatatctaacatgcacataccagttcgtatcattaccaaatatatatgcattcacacatactctaacatacaggtgtgtatgtattttcagtagtttaaaataacagacatgtctttgagccagttgaagttttgccccaggtggtaaaagcattttcggtgtgcctccaatgcctgtttctgagattcaggctatgggacaatttgtgtcttgcctagaatttgtagctgtcatgatgctggcagaaccacaagaagggagacctaactgaaaaaaatttaaacctacatttatatcagagttctctgtgtatgaatagggtaaaattaatactcttcttataaaacagaaaaattgaattgaaacttttactttatgatgagtgtataaacagaagaaaaatatggatagagtctacatcaaactgatgattttttaaagaattatttattttaagtatatgagtacactgttgctgtcttcagaaacaccagaagaggtcgttggatcccattagaaatggctgtgagccaccgtgtagttgctgggaattgtactcaggacctctggaagagaagtcagtgcccttaaccgctgagccatctctccagcccccaaactgatgatctttgaatagtcagatctttttcgctttgtttttactttgatgtctttttaactttttaaaatgccagataacttgcttgtatattttaattaactgtgtcatgtatttcccatctctagaattctgtcttctgttgaaagcaaaggtgaatttatgtttagttcattcatgtattttaagaaatgtgagcactgcctggcaggtgaaaggtattggtgtgtatttggagagtcattgctttcttactaacagctctgatatttaccttctcagcccagcctgtgctgttaccatataagccatctggtagttcgaagatgtattatgttccactgttaaaaagagttccttcatatctggattccaaatctgataccactgttgagagctcacattcaggtattatgcaaaaattattcacgattttatttttagaaacactgtgtgctggctggttgataatgaaatttttttagtcaaatatggatgttttcatgccttaagcaacctctgattcataataagtgagttatttgagactttgtgtaagagaaaaaaaaaaaggctaaaattgagttgacagctgcctgtgtaggtattaaagcccctttagaataagcacagagccaaagacttggaagacttactggtttcagttgtttcaagcagtcttcatataagcattagctcactaccacactaatccagtaggaactttaatggccatatacaatcaagtgtagtctttacccctggttcagaggctactaaacaacataaaacaataacaaatcctgaggtgggagtagaatgtgactttcacatttggtatattatattatttaagtgtccaccttgcaacaaaaattataaaggaaaaacacaagatacaatatgatccatacacaggaaaaaagtgcttgaggaatcccagacattggacttactacacaaatacttaactaattaaagtgtttagtaatctaaatgaaacaacttttgaagaaccaaggaaaaatataaaaacattgtcttaccagataatgttctaaagagataggatttattagaagggactataatataatttttgacttgaaaagcacaaatttattttctagaggaactcaacagatgaagttcaggcagaagagacagtgaacctaaagataggtccattgagatgattctgtgtggtgtgtgagaaatagacaaaacagaaaaagaaataaaccccagagttctatagggcactattaagttgcctgtggagggactaaaagtgtaatagaaatggtgcgccttctcagtgagaatcactgtctgcttagaaatgaaggaagcgcttcctactaacgcatctgataaataggagctggcactgagcaggagacgtcctaacttctgtacacttcaggtgtacgcatcctatagacagtcatgctcacatccctgcccaggctatgatgaaaacagtttcaatagaaactagagactgcaagtctggccatttaggcagatttgcacacgcaaagttattacattttgcaagatttattttaaatataccagtgctctttttcaagtagttgctacccactgttgtcttgctcacccccaatcataagattatttttgttgctactttataaatataattttactactgttataaatagtaatttaatagttttggagatagagatttctggaaggggtgagactcacaggttgagagcagctgctttagaggcatgcctttgttgtgagaatggagcctgatggcagccggtcaataatactgagtaaacatttacattgtggcatcctaaattttgcttattcctaacagaccttggtagcacataccaatcttagataatttggaggctaaattctacttgaataacttaagcaaatttattagtaagttccttattactgagtttcttctacatcaaactgaaaagagagacagaaacagagaaaagaatatttgaacatgtgatgaccctaaatttcttaacttgatgagaactgaaaaacttagacctccaagtaggaaaaccacaggacagcatttagatgtgtgaatcaaactgtccaaacccaggtcagagagaggctcaagagcattcaaagagaagtaactctgctagattttgttatcaagacacatcagataagatcttatcagaaacctaaagcttaggagaaactggaatgagatccttaaagtgttgacagaaatgggaagcagagagagagggaaggagggatgaaggattaggcagtaaacccagtgaaaaccaaacagggaaactgtacctccaccaagattcaatatctagcaaaattagtctctaaaacaaagagaacgtttacataggagattttgttgttgttgttgttattgttgttttttgtttgtttttaataactcttggcatttacccaaatacattgttgtaaattaaagtgcaaatggtaattcccaagacaagacaattttatgaaacaaccaaaaaatgcatagtaaaaaaaaattcagtatttaaaggccatagtagcaaatattcttttttgaacagaaaaatttcacaggagagaaattgagaaacaaacctagacatacagctttattaaacaggaataaaatggacttaagttttacattacctgtaattaaatattagtgcattaaagtataagacagatatcagcagagtagttaagacatgatctgactatagtctaatttacagaatactcatgttaaattcagaaacaaataggacaaaaagaagatggaaaaaattatgccatagagtttagctgtagtaatattaaatgaagtggattttaatgaaagctatttctaaaagacaatgacattttatacttaaaaaaggatccaaaatccatcaaggaataacatatatgtaacaacataaagaaaacgaaagtttaaaaaaaacctaacatagtgggagaactgagcaataaatagtctgagccattcacagtcatgtaatctatgagttgatgtgaacaaaatgtgtgaaataaggctgtgtggtgagaattacagagttgttgattgtgaatccattacatactgctaaatcatacacacatttacattggtagcctttatgttatgtgaataatatatctattaaactgtttttgtttttgtgacaaggttcttctgtagccctggctggccttgaaggccagaagagggagtttaataccctggaactggacctaggcatggttgtgagccaccatgtgggtgctggcttcctgaaaatgtaaaatttgacttcacattttttttttttttaagatttacttatttattatatctaagcacactgcagctggcttcagacacttttcttctgtttccggccccactctcttcaatcccactcgccccgggccaaagatttatttctttattatatgtaagtacactgtagctatctttagacaccctagaagacagtatgagatctcattatggatggttgtgagtcaccatgtggttgctgggaattgaactcgggaccttcggaagagcactcagtggtcttaactgctgagccacctttccaacccttgacttcacattttaaaatcttttttttttttatattaacaaagggttaaaattaacatgaaagaaattgaattggtgatgtgggcagtagacaacatgatgtgagcagaagtaatattcagggtctaattggaagtgtttttctctcaaataaaataaaataaaataaaataaaataagaacataacatgtagattgaaacatcatttataattccaacagaaatcaatagcaagagactgaagtgcatattctacattttaacttaaaaatcttgtaaatctgtaagatttaagattttaaaacatttttattttatgtgtatgagtgtttattgaatgtttggacaccatgtgtgtgcatggttcttcaatgctgtaagagggcattagaccccctgggactgcagtgacaattatgagctgtcatgggtgcaggaaattgaacccaggtcttggaagactggcctgtgctctttgactgcggaaccatctcaccagcttctaagcttaaattgtatagttactgggacaagattatctttttttttcttaaaataatttataaatgagctgaaaatgatctgtatttagtgaagaaagaatataaatcaagtatttgttactttaatgcatattcatcaaacagtatggccatacaaagaccttttctgctgggcgtggtggcacacgcctttaatcccagcactcgggaggcagaggcagggggatttctgagtttgaggccagcctggtctacaaagtgagttccaggacagccagggctacacagagaaaccctgtctcgaaaaaccaataaaataaaatgaaatgaaatgaaatgaaatgaaatgaaataatgaaatgaaatgaaataaaataaaatagaccttttcactaatgtatgtaagctggaaaatataacctattcctgaaaagctcactggaagactcatccaattgaagactcaggtcagtgaactacacatccaagacagatgtcagtgtgagtgtgtgtgtgtgtgtgtgtgtgtgtgtgtgtgtgtaccagtaggaaattgttgggacagaggggaaacaaacaaaacaaaattgaagatattttgggatgaaaaacttaagaagaaaagccaatttaattttatttttgtctttaacagaaagcaactactaaagggattttattttattcaagactgagttctggctgtggttcaataataatagatgcttatcctgtaggcatgaggccttaggtttgattcctacctaactcctactccctatcaaaaacaaacaaaaactgaggcttgataattaaaaaaaaattatttaatccttttcaaaagctaacatgatatccaaaatttaggtaacaaagaagaaatagaaaattaattcaaagtgtttgtttaccaaagattacctcatcaacacaaaggtaattcactgtgtgtgggggggttgttgtagggagtcttactacatcacagtggctgacggggagctcactatgtagattaggctgactaaactcactaagatcctcctgcctctgcccctctagtactgggttttaaggcatattccaccaatgtgggacagataagttatttccagaccatatgtatgtctgataaggagttaatatccagaaaaatatgaaaaatttactacttaaacaacaaaaaaccaaatatctttgatttatatgtgcttgcagaacctaaatccacattagcttacaaatacatgaagaggtgcttttctttttttttttttttttttttttttggttttttgagacagggtttctgtgtagccctggctgtcctggaactcactctttagaccaggctggccttgaactcagaaatccgcctgcctctgcctcccgagtgctgggatcaaaggcgtgcgccaccatgcccgacaaagaggtactttttatcagtcatcacaggcaagtatgacccagagccataacaggtcacacagcacacttgttagaatcactcctaattcctttaaaaataaacaagtgttgatggaggctatgaagaaatctaagatggtgctggtgggagtgtaagtgcttggccattgtagaaaacaacatggcagtttttcagaactataaacacagactttaccatacgtttgagtaattctgcttcaaagaaagaaaaacaggatctcagagtcaccagtgaactcacttttatagatgaaaaaggtggattctatatgcctgtcactatgagtagatgaacacaatgtacttagagtgttccttgggctttgtcaaccaacagcattctgatatgatacattatttgttttgtttttccttaagatttattcacttatttgttgtatatgagtacactgtagctgtacagatggttgtgagccttcatgtggttgttgggaattgaaatttttggggggacctctgctcgctccagttgtccctgctcgctccagtcaactccacttcggttgctcaactccgcttagctcagtccctgcttgctctggcccaaagctctatttattgttatacttaagtacactatagcatcagagggcatcagatctctttacgggtgattgtgagccaccatatggttgctggaatttgaatttaggacctttggaagagcagtcagtctgtgctcttacccgctgagctatctcaccagccttcattatttgttttttgacttggtgaatcttaaagcggttgatacattccagtcaaatgccattgtacgtagtatagtacttagcaagcatgcatgagagcctttggttcaattcctgaaccactgagctacatccctaggccttcttctgcttttggttttcgttttaactttttattttcagacagaatctcacctagttgcctaatatggctttgaagctgtagacagtctttgaacttttgaccctcttgactcagcgtcccaagtagctttgatgagtgttgacttattcttctccagagcctctcagctctgctgccagtcattcttttgctcatccactgcaactgtcagaaaatatctgttgctctcagcccagctgacatggtcaccactcttgtgggaaaagggtagtggactgattgttcatgttgctgctcctgacatgtgctctgctatgtaaaaggattggtgagaatgaccagaaattagagttgggttgagctactctatatactaacttaaaattataaagaaggaacaggacattaatttctgttaaaatggtataagaactacttttatcctttattgctagaattagaagcataaaagaaaggaaactcttggccagtaataagcttgcttgaggggtgtgtgtgtgtgtgtgtgtgtgtgtgtcctgtaattcactgtgtagaccaggctggcttcgaactcagcggcttgtctgtctctgtctcccaagtggtggaattaaaggcatatgccattaggcctggtttaagcatttccttttttgagccatttcttggttgtcatgtgtatctaggaagagtaatggtccatttctgtaggagaactgggcagttggtagaagaaaggataataggacttcccagagatccaagaggcaagggctagaaaacgataacaggtatactgagaagatgcatgtcatatgtagacttgatccagaagggttggtaggaaacttggaggcagttctgaaaacgtgttatgccttatttatattgcattgaaccaatgagactggtactttctcagcacttagtgttatatacatattattactattacaaatatattaattacacaataataaatatacaaggtgtgggatcctggagtagaaagacaaactttgatagaattctatagtgactataagctgtagttattataagcttttatatgtccagaaatgttttttgcctatcagatgtaacatgcgtaacatatcagtttctcttgtcagtatatatacgaatgttgaaatacacaagtttaattcttttgaatctttgtcaggtaaattatttctttcagtttttgtctttttctaatttctcttttggttctggggattgaacttggggcctcatacaggccatatataaacatgtatgctcttttctctgagttacatgactagctctcattcagtgttttataatgttggacaaattttcctaagtcaaagcttattaattactttatgattaaaaaatactcttcactgatgttatattccatatacagtaaaatttatggtattagattaggatttcatatgttgctgttatgattaagtattcttattaatgtatcctgttgtctagcctgactacagtgtgtgttatttctatacatgccttgtgtgtgtttgtatagtgccatctgacatgcctttttgccttcatggtcatatcagaagacatcccccaatccttttcccttttagtagctttcctggatagcagttatccccttaactatcactgttccactttttgtgtcatgtcttacgtcatttgcttccttgcctggtaattttaccatttattctactgtctctgattttcagtttgatttataccttctaattggcctgcaacatttcttgtcatggtgttctttccatggaagtgatctaagggaagaaaaagtctttcttgactaaaatagttcaagcctattttagtgttaattgtaatgctttctcatttttacgtaggctcaaatgatgctattgccccagactttccacctcaaatgctaggcacaagagacgatgacctctccaacactgtaaacattaagcacaaagaagggatttatagcaagagggctgcaacaaaggggaaaaacccctctcagaaaggtgatgcaggtaatgagtgaccttgcgtgttttcaaatttgtttcttgaacctttgcatttgaagtgagaatagtgttgtatttatccatattctggtttgtcagaaaatgagaccctgagtttaatccctacaacggaaaaaaaaaaaaaaaaaaagatgaaaagagaattaaaaaaaaaacaaaacgttaaaaactgaaaggaataatttacctgacaaaaatcctaaagaattaaactttaagtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacatctgataggtaaacctccttactgctacattaagtaacacaggaaagtgaaattttagaatatttaaaatacttcagagaggttggaaaactgcaaacttcattctcaacataaataaaatgtattttagctgttaaaaggcaatactaagtcaagcttattttgaatacaaattatcagataatcttgattacaattcttatggatttatctctgtcagatgttgcaaagtgcaattttagacagaatgtgacaagaagttaagagtccacatgatgtttgaaattttattatattttattttttggtaccaacttgtgaaaattcagttttgggcttgttgggaaaaatatctgaatgtctggctacttttggtgccccttcctctatgacagtagtcaccttcagtggggccctggctgtttcctacatacaggatctccattctcatgtttgcttcactccccatccatctcagatcccacctgcttcattcagacacccaatctctctgctcaaagtgctgagttttcagcatttttcctctagattgaggacagtcattttctaaaagtgcaatatatttaaaattgcaggaaaacccatatttctaggaatgcactgttaaaaaaacaaacaaacaaacaaacaaacaaacaaacaaaccaaaaaaccagaccaaaacatagaggcataggttaataggtaaatagatgaacagacagctagatcttctataaggaaatggagagtgtgtcttcttaatcttagaaaaggaaaaattttattaaactggatttttctcctaaaacaaaacaaaaagtaaaaccagcagccatatagagatctattgttaaataaggtatgttagagttaaaaattccataaaatctaaacagtaaataaaagcaaatcacagagtggaagtgaaaattatgcattctatacaagatatgcatgtaaaaaagaaaccatgtgaagaagatactcaactcaatagaaattgggcaaaaagaactggataattattttataaaaaagattatgtaataccaaatcattgtatataaattttcactttgttgacaatctgggaatacaaattaagatagcagtagttttctatactcattagaatgtctgaagtgaaaagtgctataatgttacaagtgcagactaagatgtcattcactgctagtgagagtataaattagtatcctgactgtgttgctgagttttgaatctagcgcttcaattaaacttagacatccactttatcactgagctatacctttaaccccatacaaattcttcaagccctatttgtaatagttccaatctagaaaccacccgaatggccaatatttgtttagtagaatagataacttgtagtactgttgaaatcttactggcacagagaaaagggtaaatatatgtaactacacgtaataaactttacaaatacagtgtgagtgaaggaaggaaatctcatatgttgtattatccatttatacaaagttcagacatctacgatgaatttgttctatttaaaattggctattatatactctggtttcctcttcaggttgtataaatcctttttttaagatttatttatttattatatatacagtgttctccctgcaattatgcctgcatgccaaaagagggcaccagatctcagatcttatgagtcaccatatggttgctgagaattgaactcaggacctctggaagagaagacagtgctcttaacctctgagtcatctctcagtgcccagattgtatcaatcttaaaatttttataagtgtcgaaaaaattaggaagaataaggactctgtaggcttctattttatttcttttcttgtttttttgagacagggtttctctgtatagccctggctgtcctggaactcactctgtagaccagtttggcctcgaactcagaaatccgcctgcctctgcctcccaagtgctgggattaaaggcctgtgccaccactgcacagttcatattttatttgttgacctggggaaggctatgcacatattgtctgataattagtgataattcctgcatttctatgcaaatattttctaggacagtaaaatcttttttaaaagatatgcaaataataaggttcttagaaatgagcctaaagtacatacaaggctaccatagagaaaattcttaaattacactgaaatttattagtcctgcataattagagaattatataatagtaataattaacttgtcatttgtcattaatctctgaattcataagagaacctgctctatttgtcatcaaaactatgtagcttgttaaatattatttgtaaaggattaaacagaagtgtaggaggcagccatgttggtaagactttaaggatgaagtgtctgacatttctaggagatagaatctcacagcaaacatccttatcctctgactcttacagtccttctatcctcttctgcagtgatccctgagcctcaggtgcaggaattgaattatagatggatcagttgggactgtgctacacaactctgcattctgatcagttgtggttttctgtaatggtccctgttgtaaagagttttctttatgcgaaatgaaaactatacttacctatgggcatagtaaagagaatgaaaatagacattagcatggaaggaaagcttataaggcctcaaccttagacaaagaactacaggcaaccaaggagtgttgaaagctggagaaacagtcttccccagggaagagcacagcaactggttatcaacactaagtgctcagccctgaaaacatacacatacaagtaacagaagaatgagtaggttatatttatacatttaggaatagacatacacacacacacacacacacacacacacacacacacacacacacccctacccacccaccaaggagggtttggtgagagggaaaggaaaggggaaaatgttgtaattatattataatctcaaaagataaaattctttctaaaactgaaaaagtatagcagagtgtgacccagaaacaagtttatgaatatggaaactgaagtgagatggtgtgccagcctgtgaagcttgaggatggacagcaggagtccttagaaaattgataacgtatgtaagaaaaatcaggtcaatcctgtctgcacactgacagaaatgtatgacagccacatgcaataaaaagagaaaaattttagagtttatatacccttatgactctggggtaattgagaatttcatcctttcattgagacaaggtttcatatatccttggctgattttgaacttgcagtacagctaaagcataactccccaccttgtgatacccttgcctccaactccactcctttcagcaggcatcacaggcatgtgccaccattcccaagaattcccttttacgtggtactaggcaagcactcaaccaactgagctacatcttcagtcccccgttcagaatttcttaagcaagtcacatgaaatatagatccaaggggataaagttattaacatgaaaatcttggcatataaaagatataaaatattaaaagacaagacagagatttaaaaaaagatattttcagcttgtaaaaatcaatgtgaaatgttacaggaatgctcacactgctgcttttcagtataaacaaatacacagaaaaagtcatatgttgatcagttgatgaattgatggatgaagacaagaatattgcatatattaagctcacatattaatatgtccaaatctctatcaaatattgtgagaaggcatattcttaaaggtatatccagtgttgcatattttatataatagatatttaagttaagattataaattattagtatagattattagtagtagcatttttaaatattaatgcaatgtgctaaagaaattaagagaaagtccagtacaaaggctgctattatatattgtttcatttttaagccaagttgttaataccttgttaaggtcctaatatgaaaaatgttagaaagctaggagaaaaaatttaggattgaattaatagcattaaggacaaaaaagaaactgatgagtaaataaagccaaggtttattctttgatgtatgttttattgtctgttaacgttctgatttctttgagaaacacagtgaccagggaggggaaaaataacataaaatattaggtttaaaagttataagtacacgagactaagagaaggcagtatgtaaaatctagatggtataactatttttgttgactatatggtatattaattagccctgcaattaattaaagctttaaaaaggccaaagaggttcaaggagttgtttaaatctatatttttactttgaaaaacataatttgattcatgtttttctggttgcatccgactattggtatattttaaagtgtttatttaaactggtgtcatccagaaagatgtggcaagctttctggttcatattagagtttcccaagacagagtctaagaggtcttttttctctcatttataaagggcttgggggtggctgtgtgtttgggaggggtggatggataggaggactgcttgccaattatttactatcaacttcttctctctgggatcgatggttctttttccagcggccccagttcaaatgcctataacttgggatgagaatgtcttggacgaaaaccaagaagaggtcatcagtagaggagttgtgatcaagatggcaggacctgaagaaatgtcatccctggagaaggaccttgcaggtagctgaaacagatatcctctgttctcctaaaaacattaatttgatgttggctattggcttgctgtatgttggttgcttttattgtgtttagatatgtgtcttgtatcactgatctcaaaaagacttttaacatgattttatcaaaggcttttcagcatctaatgagatgagcatgtgtgtggttttttcctgcagtttgtttctatgttgggttacgttgatgggtatttgtatattgaacctccccagcatcctgggatgatgcctacctgatcatggtggatgatgtctttgtgttcttggattcagatttcgagtattttattgagtatttttacatcaatgtttataagggaaattggtctgaaattctctttctttgttgagtctttatgtggtttaggcatcaaggtgactattttcatagaatgagtttggtagtgtttttattttgtggaattagctttgaaaccatctggctctgggacttttttttttttttttttggctgggagacttttaatgactgcttatatttcattacgggttaataggctatttaaattgtttatctgatcttgattttactttggtaagtggtatctatcaagaaaatcatttcggatctgcgggagccatcttggttccgggactccgcagaaagtagtctgcacaggtgagagtgtggactacagaaactaacagcttctgggacaggcaagagccccagaacttctgaggcagtgccattttcgggctccagacatccagccatcttcccggctagaggacaggtgtccgccccgcctgggaggcctttgcctcaggatctgcggaagccatcttggttccgggactccacagaaagtagtctgcacaggtgagagtgtggactactgaaacaacagcttctgtgacaggtcaaagcaacacagattctgggaaaggacctgttttgggccttcatccatacaccagataactttgcaccttccctgtaagaggagagcttgcctgcagagactgctctgaccactgaaactcagaggagagagctagtctcccagttctgctgatagagggtaacaaaaccaccagaggaacaatctctaaacagagacaactataacaactaactccagagattaccagatggtgaaaggtaaacgtaataatcttactaacagaaatcaagaccactcaccatcatcagaacccagcactcccacttcgcccagtccagggcaccccaacacacccgaaaaactagacccagatttaaaagcatatctcatgatgatggtagaggacatcaagaaggacttaaataactcacttaaagatatacaggagaacactgctaaacaggtagaagacattaaagaggaagcacaaaaatcccttaaagaattgcaggaaaacacaactaaacaggtgatggaattgaataaaaccatccaagacctaaaaagggaagtagacacaataaaacccaaagtgaggcaacgctggagatagaaaccctaggaaagaaatctggaaacatagatgcgagcatcagcaacagaatacaagagatggaagagagaatctcaggtgcagaagattccatagagaacatcggcacaacaatcaaagaaaatggaaaatgcaaaaagatcctaactcaaaacatccaggaaatccaggacacaatgagaagaccaaacctacggataataggagtggatgagaatgaagatttttaactcaaagtaccggcaaatatcttcaacaaaattatagaagaaaacgtcccaaatctaaagaaagagatgcccatgaacatacaagaagcctacagaactccaaatagactggaccagaaaagaaattcctcccgacacataataatcagaacaacaaatgcactaaataaagatagaatactaaaagcagtaagggaaaaaggtcaaataacatataaaggcaagcctatcagaattacaccagatttttcaccagagactatgaaagccagaagagcctggacagatgttatacagacactaagagaacacaaattccagcccaggctactatacccagccaaactctcaattaccatagatggagaaaccaaagtattccacgacaaaaccaaattcatacattatctttccacgaatccagcccttcaaaggataataacagaaaaaaaacaataccaggacagaaaccataccctagaaaaagcaagaaggtaatccctcaacaaacctaaaagaagacagccacaagaacagagtgccaactttaataacaaaaataacaggaagcaacaattacttttccttaatatctcttaatatcaatggactcaactccgcaataaaaagacatagactaacaaactggctacacaaacaagacctaacattttgctgcttacaggaaattcatttcagagaaaaagacactacctcagaatgaaaggctagaaaacaattttccaagcaaatggtctgaagaaacaagctggagtagccattctaatatctaataaaatcaacttccaacccaaagtcatcaaaaaagacaaggaggggcacttcatactcatcaaaggtaaaatcctttaagaggaactatcaattctgaatatctatgctccaaatacaagggcagctacaatcattaaagaaactttagtaaagctcaaagcacacattgcacctcacacaataatagtaggagacttcaacacaccactttcaccaatggacagatcatggaaacagaaactaaacagggacacagtgaaactaacagaagtgatgaaacaaatggacttaacagatatctacagaacattttatcctaaaacaaaggatataccttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattctccactatgttcatagcagccttatttataatagccagaagctggaaagaacccagatgcccctcaacagaggaatggatacagaaaatgtggtacatttacacaatggagtactactcagctattaaaaagaatgaatttatgaaatttctaggcaaatggatggacctggagggcgtcatcctgagtgaggtaacccaatcacaaaggaacccacacaatatgtactcactgatatgtggatattagcccagaaacttaggatacccaagacataagatacaatttgctaaacgcatgaaactcaagaagaacaaagaccaaagtgtggacactttgctccttgttagaaatgggagcaaaacacccatggaaggagttacagagacaaaatttgaagctgtgacgaaaggatggaccatcttgtgattgccacatccagggatccatcccataatcagcttccaaacgctgacaccattgcatacactagcaagattttgctgaaaggacccagatatagttgtctcttgtgaggctatgccgggtcctagcaaacacagaagtggatgctcacagtcagctattgaatggaccacaggcccccaatggaggagctagagaaagtacccaaggagctaaagggaactgcaaccctataggtggaacaacaatatgaactaaccagtaccccggagctcttttctctagctgcatatgtatcaaaagatggcctagtctgccatcactggaaagagaggcccattggacttgcaaactttatatgccccagcacaggggaacgccagggcccaaaagggggtgtgggtgggtaggggagtggggggagtgggtatgggggactttccgggatagcattggaaatgtaaacgaggaaaatacctaataaaaattttttttaaaaattccaaaaaaaaaaaaaaagaaattcatccacttttttatattttccaattttgtggagaacaggcttttgtagtaagagctaatgagtctttggattttctgctgttttaacccctccccctttcatttctggttttgttgatttggataatgtctttctgccttttagtttggctaagggtttgtctagttgattttttttttcttcaaagaactagcgcctggtttcattgattcttcatgttgttctttttgtttctaatttattgatctcagctcttagttttattatttcctgctatcaactactctggggtatgtttgcctctttttgttgtagagctttcagatatgcttttaagttgctaggatgagattcctccaattttttcatggaggcacttagtgctatgagctttcctcttagcagtgctttcattgtgtctcataagtttgggtatgttgtgccttcattttcattgtattcttaatttatttcttacttgacccagtattcattgaatagtgagttgacttggtaggctttctttttgttgttgttgaaatccatggtgttctgctaggatacaacgagttatttctgttttcttgtatatgttgagactagctttatgatcaagtatatggtcgattttggagaaggttccatgcggtgctgagaaggcatattgtgtttggatgaagtgttctgtagacatttgttaggtccatttgattcataatctgtttcattatttctcagcttagcttctatcttgatgacttatccattggtgagagtggggtgttgaagtctctcactattaatgtgtggggtttgattttttatttaagctttaataattttttttatgaaattggggcatagatattcatattgggggatttttttccttcgagtatgacatgtcctttcatatctcttggttacttttggttgaaagtctattttattagatgttagaatggctactccggcttgtttcttgggtctttttccagccctttactctgaggtaatctctgtctttgctgctgtggtgtttcttgtgtgccgcagaatgatggatcctgtttacacatctagtctgttagcctctgtgtttttattggtgaattgagtctattgatgttgagagatattaattaatgaccaatgattgttagtttctgttattttgatgatgttggtgtgcatgtatgtttctcttattttggttttgctggtatggagttaatctatttttgtgttttctttggtgcggttactccccttgtgttgaaaatttccttctagtatcctctctagggttggattagtggaaagaattttttaaagctttttcatggaatatctttttttctcaatggtgattgaaagtttgctgggtatagaaatcttggctcacatctgtgatcttttagagactgtaagacatctgccaggctctccttgcttttaaggtctctgttgagaagtctggtgtaattctaatggatctgcctttatttactacttggcctttatcccctctggcttttaatattcattgtttgttctgtacatttagtgttttgattattatgtgacaggaagattttcttttttagtccactctattttacgttccgtaggcttcttgtacatttataggcacctctttctttaggttagaaaaattttcttctgtgatttttttgtgtgtgtgtgtttgttttgttttgttttacaagacagggtttccttgtgtagccctggctgtcctggaactcactttgtagaccaggctggcctcgaacttagaaatccgcctgcctctgcctcccaagtgctgggattaaaggcgtgtaccaccaccgcctggctaaaaaatacctgaattctttgttgttcgttctttttttaagattttatttatttattatatgttagtacactgtagctgtctacagatctcattacgggtggttgtaagccatcatgtggttgctgggatttgaactcaggaccttcagaagagcagtcagtgctgttaactgctgagccatctcaccagcccctcttatgtgattttgttgaagatattttctgggcctttgagttgggagtcttcttctattcttattattcttaggtttggtcttttgatagtgtcccaaatatcctaagggtgttttgtgttagaaagtttttagctttagcattttctttggccagtgtatcaatttcttctattgtatcttctatgcctgagaccctcttttccatctcttctattctgttgctgatgcttgtgtctgtagttcatgttctctttcctaggtttcccatctttaggattgcctcagattggtggggttttttgtttgtttgtttgtttgttttgttttattgcttctatttccattttcaggtcttgaacagttttattcatttccttcacctgtttaattatagtttcctgtattgtattttcctctatttctttaagagatgctttcatttcttttttaaaggtctatatctttataatatcattttgtgattaagatgcgttaggatattcagggtttcgatagtaggatagctgggttctggtggtactatattgccgtggcttttgttgattgtgttcttgtactgttcagccatctagttgtccctatggtttggcaggcctgatagtccttgatggaagtaggcctctgtggttgcaagtagagctggttgtacctggtggcagttggcttctaggaatgcaagcagagctgatagacccctgatagcttcaggctcctggttatcctgtggggacaggcctcttgggataaaggtagagctgatggtccctgatgtttgcaggcctctgtttgtcctgggcagtagcaggcctcccgggatgtgggcagagttgtttctctggaattagaatgcaatggggcagggcagaattcaccactgctgggtttgcccagaggggccagaaggcagagagttgggatagagggtcccacctggtagtcactaatggatgcatgtgtctgagatattagttagaggtgtggaccagaagatcaagtctggggcttaggtaactcacttggttgttcctgccagcaccaaggcctccagccacaattttttttttttaaaagataatcttacaccattgttgtactaaaagtgtttactctttagaaatttattttatttactttggatctattgtgtttatcttactttaataggattatgctgaaattgcctgtggtagagtgtttaatttagggtcagctttgattaaaaaccaccctaaaatgacaagatttaaagaagaaaacatttctcattctgtattgttgatatttctgaccttgactctatagaaagagaaggcatattctttagtggagcttctcagaaatttcactccctttttgtcgtagaggccagcttgagtcgtgtgatctcatcaagttatcaccaaggaggtgagattattctggtaccatgctcagctcttgcagaggaagaagaaagtgtattaggggatgggtgttagttaggccacagtacggacaagagaggttttacagcagaagacacttttctttcttacacaccagctttctctttaagattttagacttgtattctgggaaacactccagaatgataccgtgtttttttttttttttttaattgttgcaaaatgaatgtccctgaaactgttttgcctgttagtctcttgatgcatttcagtcttcattgtcttcgggaataaaatcgtaggtcttttagcagtcttccagaatgttaggatgagctccaaaacagcctttcctgctctggtttccccttgtttccttattagatgctgcagtctgtagatatttagttgctttcctgattcctctcttgtgttacacagccacctttgctttcagtgacttctgatttccatttcaaaatgtttcccatcttgagagactcaagtgtgttgtctagagtattctatggtactgtttgctagaatttgtttttctttgagcacttaataccttttcatctatctcatggtgattcttttttttttaacttttaaaacagatatattagatgtttttaatcaattttattttatgagtatgggtgctttgcctatatgtctgtgtgtaccacttgcataccttgtgcccgtggaagtcagaagaggatgtcagatgcattggagctggagtcgcagatgttgtaggctaccacatgggctagaaactgaactcatgctcggcaagagcagcaagtgctgttaaccgctgagctgtgtctccacccctgatgatgattctgtagctctgtacgacatgcttgtgtaaatgtacttttttattaacatttcccattttttaaacaatggtatcgatatttatgttttccgtgccactaacaatggctttcacatattaaaaaattagaaggtttttatgtatttactgcattcattttgttctcttaggtcccagtgatatcactgtacaagacagaaaaactgaaaatctgccagacactaaatccattaaacagaaggaaggatccttagagataggtaatgcagtatatgttagtatgtgtgcctgagtgctagtgcttgtgtttctggatcattctgacaaaaataaaatgcttttctattttacttatgaatatcatttcaatactgcctccattctcagttcagccaactctctgcagaaaatattttgaaaaaaagttatcatttttgaccatgtatagatttcttttttgtcattactttccacagatagcataggataatgattattgacttagcagttactttgtttctcgtgttgaaagcaatccagtgactgcttaaagtatagaagcacccatgcacatgcgtatgcaagtgtcatgtaaagtagttggcatctgtgagacgtccaggaaccacttccaccatacactgagggacgactgtaccccaaggctgctgctgctggaagtcttagttctgaatcatggatacctgaagctactctggaataatgagaaacaaggatagcatcaatatgtaacagtaaaaagccaaattaaatcaatttatatatttttggccctaatattatgataaaagagaagaacatacaaaacataaaccattattattcagctgtcaaattttacctgttagaaaataagaatttccatgtaagaggaaggagcagaagagagagttctactcacactgttttctgaaaagtttccattaactactcacatatagaatgtataaaaccagtgtttactaaggatataactgctatgcagtgaggaaaggataggctttccaactgagagtatagaaaaactggataaccacattaagagaataaagttaaatcattacataaaacttacatcaagaagaattagagatataaacacaagacctgaattccaaaaactggtagaagacataaaagaaaagcttcaagaaactgtatttggtaatcacttatttgcatgacagcaaaagcggtcatggacaagtgaaactgaagcaaggcttcccaaagtatttgctgagagttaaacatagaatttataaggagcatgtgtgccttgaaaacaaaaaacaaatctgacttagaagtgtacaaggagttaaacaaatagttctccaaagaaaatagacatgacccaagaaaatacgtaatgcactcaactaattgaagagaaatgcagttcaaaaccacaaggaactaacagctcacattatgtagaaaagctaccaaaagaattgttaggaaaaataaggaattcctgcatcaccggcaagaacgttgtacaaccaatttaagcttatccccgactagcttagaaataaatgagcctcagactatggttattttatttggctttgacaattactgggggtcacccctaatattttctaattgctggcctggctccttccccagtgatgtatcccaagtatttgctgtttcctggccatgggctcatggtaaccacttctcatggagccttcttgtctgtctcttcggggtttctcttctcttcctctcttcacccccacctggaaactcaaaacccacctacctctaatccctctagtaatttgctgtagcccgttttatttaaccaatagttttaaattaagggacaaggtttgcacagcaaaggcttgtaaacatgagaattccttcataggcctaaccctttgggtacagaatttaagcattacaacacatagttacagaccaaacctcagcaaaatgtaaaatgg

SEQ ID NO: 680 - DNA, 3448 bp, Mus musculus
atggataacttgaattcttccgagtcgtcttgtctcagtgtggatagtatgcctctaaattcacaaatcgatgatggagttatcatatgtaagccagaatctttaggttttgccaatgctggctgtgaggaaatgcagaatatagatcgtggttcgaaaactcttaaggaaattcagactctcttgatggaagcagaaaatatggcactgaaacgatgcaatttctctgttcccttagtccctttcagagatgttaacgatgtttcatttatacgatcaaagaaggtggtttgcttcaaagaatcctccacaactgatgtttgtacccagagggaatcatttgtagaagaagttccacacattgaatatgtacagaaggacattggcacacagacgaaccttaagtaccagaggggtgttggaaattgggaatttatcagttcagctacctttagaagtcctctacaggaagcagaaggcacagctagaatggcatatgatgaaacttttaggcaatataaagctgccaggtctgtaatgaggtctgaacctgaaggctgcagtacaggcattgggaataaaatgattatccctatgatgacaatcataaagagtgactcgagtagtgatgtaagtgatggttgctgctcatgggacaacaatttaccagagtctttggaatctgtttctgatgtttttctaaacttctttccatatacttcacccaagacaagtataacagatagccgagaagaggagtggttgtcagagagcgaggatggctatggtagtacagattcattggctgcacatgtgaagtaccttctgcagtgtgaaacttcactgaatcaagccaaacagatacttaaaaatgcagaggaagaggaatatcgggtccgaacccaagcctggaatctaaagtttaatttaggacgtgaccgtggatactccatttcagaattaaatgaagatgacagaaggaaagtagaagagataaaagcaaagttgtttggtcatggaagagcaactcacatgtctgagggcttacgaagtccacaaggcataggatgtttgccagaagctgtatgtagtcgaattattattgagagccatgagaaaggatgtttcaggactcttactgctgaacaaccacggccagacagctgccattgtgcttttcgatctgttgaaccttcagacttgattagaggacatcggagcccatcatcatggagaggcaggcacatcaacctttccagatcaatagaacagagcaatccctgtttcaaagtagggagttcctttcagttacagagtcatcccccatttcaaaaacttttacctgatgacatcaaaattagcaagggtgttggaatgccagtccatgcatacatggatccccagccatcagaattagtagaacctacttgtgtgccagctaaagaaatggattttccttcctcatctcaaatactgccccctgagcccaagaagcagttcactactgccatcactttttcttctcacgaacactctgagtgcatttctgattcctctggttgtaaggttggtgttactgcagatagccagtgtagtggaccatctttaggggtatttaagcctcatatccccgaagagcagatttctcctagagatcttaaacagaaaacctctttccagtcatcacttgaaaggcatggttctacaccggtgactattttagctgatggtagtaggcaaaggcaaaaattacctgttgattttgagcattctcatcaaaaagaaaaactcttacaaagattaggttttaaagtcagccattctgaacccaatgtcagtacaaatgttagcaatttcaagggagttcaattttctggtaaggataccattgttagccaggacaaactaacttctacagtagaggtaaaagagaagaatgtaactgtaactcctgatcttccttcttgcatttttcttgaacaaccagagctctttgaggaaagccacaccccacatacagatcttcagatgagaaaatacccttctccctcttgtccagaaattgcttctcgcatttttcttgagcagccaaaactctctgaacaaagcaaagccccacatgtagatcgtgaaataagagaagatcactctttctttcctaagtgccaggattatatagttgcagacccttctcccgattttcctgatcagcaacaatgcaaacctccagacgtagttggccacacgagaaaacagaactctcttctttctgaaggtcaggattatgagttagaagaggttcagcatatacctcagtcatacttttctaatatggtaaatgttgaagccaaggtcagtgatgcgatctcccagtcagcccctgaccactgtacagctgcatctactccaccttcaaatagaaaagcactttcatgtgttcgtataactctttgtcccaagacttcttccaagttggatagtggaaccttaggtgaaaggtttcattcattggatcctgcttctaaaacaaggattaatagtgagtttaactctgatctgcgaattatatcttcaaggtcattggaaccaacctccaaattactgacctgtaaaccagtagcacaggatcaagaatctttagtttttctaggacctaaatctccactggacttgcaagtcgcacagtcttctcttccagatagtaagactatttttcaggacttgaaaaccaaacctcctcagaatagccagatagtaacctcaaggcaaacacaagtgaacatttcacatttggaaggatattccaaaccagaggggactccagtatctgcggatggttcacaagaacagagtaaggtttcctttactacgtcctttggaaagttatcatctgatgccatcactcagataacaacagaaagtccagaaaagaccacattttcatctgaaatttttattcatgcggatgatcgtggacagggcattctagaccccatggcccaaaagccatccaggtttgcctcatcatcctcagtgcagcaaatcccagcttctcatggcaaagacggctcaaatgatgctattgccccagactttccacctcaaatgctaggcacaagagacgatgacctctccaacactgtaaacattaagcacaaagaagggatttatagcaagagggctgcaacaaaggggaaaaacccctctcagaaaggtgatgcagcggccccagttcaaatgcctataacttgggatgagaatgtcttggacgaaaaccaagaagaggtcatcagtagaggagttgtgatcaagatggcaggacctgaagaaatgtcatccctggagaaggaccttgcaggtcccagtgatatcactgtacaagacagaaaaactgaaaatctgccagacactaaatccattaaacagaaggaaggatccttagagatag

SEQ ID NO: 681 - protein, 1150 aa, Mus musculus
  VARIANT (1)...(1150): Xaa = Any Amino Acid
MDNLNSSESSCLSVDSMPLNSQIDDGVIICKPESLGFANAGCEEMQNIDRGSKTLKEIQTLLMEAENMALKRCNFSVPLVPFRDVNDVSFIRSKKVVCFKESSTTDVCTQRESFVEEVPHIEYVQKDIGTQTNLKYQRGVGNWEFISSATFRSPLQEAEGTARMAYDETFRQYKAARSVMRSEPEGCSTGIGNKMIIPMMTIIKSDSSSDVSDGCCSWDNNLPESLESVSDVFLNFFPYTSPKTSITDSREEEWLSESEDGYGSTDSLAAHVKYLLQCETSLNQAKQILKNAEEEEYRVRTQAWNLKFNLGRDRGYSISELNEDDRRKVEEIKAKLFGHGRATHMSEGLRSPQGIGCLPEAVCSRIIIESHEKGCFRTLTAEQPRPDSCHCAFRSVEPSDLIRGHRSPSSWRGRHINLSRSIEQSNPCFKVGSSFQLQSHPPFQKLLPDDIKISKGVGMPVHAYMDPQPSELVEPTCVPAKEMDFPSSSQILPPEPKKQFTTAITFSSHEHSECISDSSGCKVGVTADSQCSGPSLGVFKPHIPEEQISPRDLKQKTSFQSSLERHGSTPVTILADGSRQRQKLPVDFEHSHQKEKLLQRLGFKVSHSEPNVSTNVSNFKGVQFSGKDTIVSQDKLTSTVEVKEKNVTVTPDLPSCIFLEQPELFEESHTPHTDLQMRKYPSPSCPEIASRIFLEQPKLSEQSKAPHVDREIREDHSFFPKCQDYIVADPSPDFPDQQQCKPPDVVGHTRKQNSLLSEGQDYELEEVQHIPQSYFSNMVNVEAKVSDAISQSAPDHCTAASTPPSNRKALSCVRITLCPKTSSKLDSGTLGERFHSLDPASKTRINSEFNSDLRIISSRSLEPTSKLLTCKPVAQDQESLVFLGPKSPLDLQVAQSSLPDSKTIFQDLKTKPPQNSQIVTSRQTQVNISHLEGYSKPEGTPVSADGSQEQSKVSFTTSFGKLSSDAITQITTESPEKTTFSSEIFIHADDRGQGILDPMAQKPSRFASSSSVQQIPASHGKDGSNDAIAPDFPPQMLGTRDDDLSNTVNIKHKEGIYSKRAATKGKNPSQKGDAAAPVQMPITWDENVLDENQEEVISRGVVIKMAGPEEMSSLEKDLAGPSDITVQDRKTENLPDTKSIKQKEGSLEIX

SEQ ID NO: 682 - DNA, 198073 bp, Homo sapiens
  misc_feature (1)...(198073): n = A,T,C or G
acagatgacaacatggtgagctctgtgaactctagatttgcagtaatttcagggggaacagtaatgtgagagaggagtcctcactttgtacacagtgttgcaggcattctgaaatcaagaaagtatactgattaaaataagaatgatttaagtcaacattcaggaaatcacaagaatttttttttcattaaagcagcagttcaaactttttgggtaacaggattcttttacacttttaaaaattactgacaactccaaagagcttttgtttatttgggttattgatatttcccacattagaaattaaaactgaaacatttaaaatgtatttattaattcattgaaaaagtacatattttataaaaaataacttttccaatacaaaaatgtttagaagtatggccatgttttacttaaacaattctataatgtctgacataatagaagacatcaagactctcatgtctgtttctgtattcaatctgttgctgtatcatatattctgtagcttctggaaaatgtcactgtatctttttgagagaatgggagtgaataaggcatatgatatcttaatattattttgaataaaattttgacattaggtaccccctaagagtgtcttagggcccaggagctcctgtgctatgctttgacataacgggtgtagtctatattatgtaagatgggaagaaacactcataatagttaagagcgtttgctaaaagttgaaatgcttgggttcaaatctcactctggcatttcagctacttgaatgtggacaagttacttaatgctttgtaagttttgtaatcatgtttcctcacctagaagatatatataataatacctatctttcaaggttgtcatgaggattaaatgaaatattgtgtgttaagcacctggaccttgtcagactctcaataaatggtagctgctactgctgttgcttttatattattattctaatgcttgtagaattctccatatggcagcatatgtaggtgctttaaagtattatatacgtaagtaaataatcaattttcagcattacccagcatttaatatttgaaactttacagtcatacaagatagctttgcttctcctgatttgcctttgctgacctgtttgacacaagaccaagaatttgcgcctgattctttatttcatcaaagtgaactaagttttgcacctctgaggtaggatgatttatttgcaagtaacctttctcacttcttgttctatgtttttactaatattagtgacttcaggctaaggtgggactttgaggtggggcttagatactcttaggacacgccctgaaggtaacaaagtcctgtactaagacttgatgcatattaatttggcagagtaacgtatgtgtagagatgaaccagatgacagtagtttatttaaaaataattcctaatatattcaggcatttcaggcatattttaatttagaagacacactggattttccttcttataaacctccccatctgctgcccatcatctctctcctccctctcacccttattctgcaaaaagcatttatttcttgttcactaacttgtttggcactctcattttgttcagctgttattgaatgagactagttagctctccttaccttataggaggtgtcaatatgaagtaagaagatttttatgaacagacatatccaaatgaacagatactccaaattcatgtcctttagaatagtcataatgggagaaaagtctggaattttcaaaacatatttggaattattcaagaatatgttttcttcctttagaattgaaaacccaccttaaattaaaaactatagatgtttagaaagtaaaaagtaacctctgtccttatactatatatttacctgatatcacttttatgaaaagtgatctatacacattagatcatcaactaatgattaagttactgttgtgttttgggaatagatcacttcttaagtggtttctttctctttctctttttgtttgtttgcttttttttttctttagatggagtcttgctctgttgcccaggctggagtgcagtggtgccatcatggctcactgtgacctctaacttctgggctcaagcaatcctcctgccttagcctccacagcagctagtactacaggcatgtgccaccatgcccagccaatttttaatttttctgtagagatagggtcttgccgtattgccaaggcttgtcttgaactcctggctttaggtgatcctcctgcctcagcctcccagagtgctgggatcataggtgtgagccactgtgcctggccttgcatggtttcaagagcacaataaatgatgactagtaaaaaagttaacgcaggttaaatgaaaaatcatggtaggcgtcattatgaaaatcacattctgtgtctattgttttaggagaagtctgagataatatcagggttatagggtggtagttcaccttttagttaaaaagaatttgctttgctcagtcattagccatcttagaagagtctgaaattaggagagctgtgtttttcaatacacttttcaaataaacttgatttcagtgacatatgtatttttgtgttagtacttaaaaattaaatgtttttaatgttatttatttatttatttttaactatatattttcaggggaattcctgataagtctgaagatactgaatggtcttctcgaccatcggaagttagtgaagctttattccaggctactgcagaagtagcttcagacttagcaagcagtcgctttagtgtatctcagcacccgcttataggcagcacagctgttgggtctcagtgcccttttttaccttctgaacaagggaataatgaagagactatttcgtctgttgatgaactgaaaattcccaaagactgtgatcgttatgatgatctttgttcatatatgtcatggaagacacgaaaagatacacagtggcctgaaaacaatttagctgataaagatcaagtttcagttgcaacttcatttgacataactgatgaaaacatagctactaaaagaagtgaccattttgatgctgctcgttcatatgggcagtattggacacaggaagattcatctaagcaggcagaaacatatttaaccagtaagtaccctgattctttttcagattcatctgacacaattgataaaaataaaattcccaagggaagtaacaattttagtgtccccttttcctatgtgccatggaacaaagagggaactttgcaccacccagaaacgtgtgtaatcagtaaggactgtttttcctttccatgtgaagttgctgctcatcatcatcatcataaaatgtcatattctttcttgtgttgtttgttggaaagaagaggaaaaggggttcccttgacttctgatagtcattattttgagaatgtttatttaagggctccagctgagattgaggtgaaacaaaagatggattctttggagggttatgaaagaaatgaagaaggtttacagaaagaatcatctcaatgttttgaactaacggagactagaaataatttagtatcttcagaagtgcaacccagattcttagaaatacagtatattaggaatgttatagctcctgataattctgtaaaagtttcagaagcacatgtactctccaggggacataatacctctaaaatggaggcttctggttggattgttatatccaacttggatgagatatcagaacaactgtattttcaagaggaaagaaaccaaaagggaacttctctttttggtgagaaaaatattgatgctgctgaaaatatagcctttgaggcagttattgcctctattgagccttctaagaaagagagtacagtaaatgaaatccaagctgacatcaataaatatttaacagatgacagccgagagagagccaaaaaatccagatctttctccattaaattataatgatgaaacctctttatttgataggcttaaacatccatgctatcagtctactcctggggtgtttgaaccagcagcttcaaaaccattgttgcataaaaagggtaataatgatagcttcctatactggcatccaaatttaaaattaccccctaatgctcttcagaaaatgttcattaagccactttgtgttattccagagcttaagtcatctgcttctttgagtgaaaaatcttacaaccaggctgttggtcttggcaaaacacagtcagctttatttcagtgtgatataggcaatgaaccatttcttccctttgggaagataaagtctgttccttctcttgaccttgcagagaaggtaggatcttcagatgttatttatcatgtgaaagtattaacttcagaatctttggttttacaagatttaaagcagccaacctttgaagaagttgcagattactcaaactttaatttgggtaaggatgttaactgtagaaatgccattaaaggtccacctgcagctgtaggaagcagcttttcagcaaacttggtggcatgtgatgcaaagtcacaaggtgcttgtaccattgaccagtgatgcatcattaattgcagtcgcccaagagacattgctgaaagctgatataggccaaggtgaaagtccttcgtgtgtgggagctgagcctagttttactatacatacaattatgcaaaatgactcctattttgtagagggcctgcaggggaaggttgagtctgacgtcattactctggatggcctaaatgaaaatgctgttgtatgcagtgaaagagttgctgaactacaaagaaaggtgagacacaataaaatgatagttgtaagaaacgtggcctttttcagtattgtttcaggaaatggtattgtttgtttttattttactttttactgtttcctgggtacatgaccaatgtcatttgactggtgagtacattgagctagcagctttagagaaatttcatggtgatctagagatgcatgacagctccctgcactggcagcctactttacaactaccatctgagaaggaaagcaattttgaaaagcctgtaagtttttctatttgacatttttttctgggcggggagggaatgttttatttgaaaaatttccaaattttatttgaaaatactttatttgaaaaattatatccttcagtaccagcttgtaacttgtacctgttcttcatctgatatccaggaatatgttccattagaggttggtataaaagaaatgtttatgtttcatagactgtaagacttagttctgtggtgtcttggaaaaggcatcccatggggctccaggcctttcatattgaggcagcctaactcttcctagttgtgccagcaagagtctttagacagtgttaagattaggcttattcatgggaacatccaaaagcttgtactttgaatgtttccctctggtcttcaatgcacaagccttgaaacagtccctggaatatttaagtatttctgtttagaagctcttgaaagacttgacttcagaggtgtcttgaaaattgtaagacccatgtttgaccaggaaggataatgaagtgcttaacgtccaaactggccagtgtctcttcaaagggaagtatctccttcccaaatgagcaacatactaatgtatatacatgtctcttccctctctctatttatatcattattaccattgtgtgtgtgtgtactagaaactggcaactctaggatgtcataaaaattttatatcagccttttttttttaaattaagttctggggcacatgtgcagaacgtgcaggtttgttacataggtatacaggtgtcatggtggtttgctgcacctatcaacctgtcatctacattaggtatttctcctaatgctatccctcccctaaccccctaccccgcgacgggccctggtgtgtgatgttcccctccctgtgtcattcttttatagaaggcttttatttgcttggatccttggatcccttggcattaatgttcctctggtcccgttgaatgaatatcctcttttgttgtctggtactgtaagtcccaaggtgggccctacttccttgtgatatagccttatatcctgttattcattaaatacagttagataaaatagtgatgtacttaatgttacttctcttttcctatgtataagattggtatgtttttgtaaagctctattagtttgggttacaaccacatttagacctttaggttcagattgttggtagaaaatgaacaaagatattatgatgaacttttatttataatttattacatttattaaagtttttttaacacagaatcactaggtttattttcttcagtattccaaactaggcattttttaattttaatctgataactggggatgaaaatgatagttaacactttgtgctcaagtactgtgctaagaggttacatgtatatatcaattcgtttttgtcctctgtcaatcctatcaaatagaattgttagagattattatcatccctattttgcaattgacacttagaggatttaggaacttgctcataattattcagcaattgggggaaccagtatttgaaactaaccatatctgtgtacttaaccaccataccataaactgtcccccctccccccaccttttaactattcttggtgaaactaaggttaagattttgcattattttggcaagagtagaggttttgaaggagattgcctaaagttgagttcaataacaatgagaaacaaagtaacaacttttaaagtgttctaaatttttaatactacttttgtgacttacatcaacctttcatgtagataaaatgtattttaaaaataaagatatataggttcagttaatgtgcagagactagctttgaccactgctccaaattttaatctgtccttaaatatagcctgaagtattattctttcaatctaaggaagatgctattattccctgtattgtctttcagttgtagctctatctgtcttagtcttagatctaggagttatttaatgtcaatatcagaaaagcaaggagccagatgtggtagtactttttctgcatggcttagcttgctttcaggggcttgcttactccttggtttttccttatgctcctcatctgtgtcacagaagagtcattcatagttacttggttcacttttatatctactcctcataaatgattatttgggtatccacgtatgtatgatggagcttggaactgtgaaaagaacatagagattttgagtcaaaatccagttcagttactttgttagccttgtgtcttgagcaaatgacttcggaggatcactttcctgatctgcataaggaaataggaatagtaataaccttatacatcgtactattaaatggggtaagttatgtagcatttatatagtgcctggttgttagttctcttcactttgctgaaactagactactagagtctctggtggtttcctactttctatcattattttgtttttctttctcctttttcttggtagcagcacataattaatatgcttttttttttttttttttttgaggcagagttttgctcttgtcatccaggctggagtgcaatggcacaatctcagctcactgcaacctccatctcctgggtttaagcagttgtcctgctgcagcgtcccaagtagctgggattacaggtgcctgccactatgcctggctaattttttgtctttttagtagagacggggtttcaccatgttggacaggctagtctcgaattcctgacctcaggtgatccacctgcctcagcctcccaaagtgctggggttacaggcgtgagccaccgtgcctggcctaatatgctattttagtacctcttgttttggccatttagctctaaaaattatttaaggtttaagccttagatttcttttctctccccttcatatccccccacctttggagacctagttgcctgtctctgtgtggatgattatcacctctgtttttataccctaatatttgtctaatttattttgcatgttttcttgtgaacattgtcatcaccccaaattcaacttgctctatagcaaaataactcatgtttttcctaaaattagactgacttgtagagttcctgagtttttatgaaaggtattagtatttttctggtttcttggtcatctttcattctttcttcattattgattaaacattgggaagataaacgaatcttgatttctgttttctcctggttctttccattttcaattagcaatgaagatctgctggtttcttaaataaatacttctcatatttttcattttacattttcttttgtattacctactttttttttttttttttgagacagagtctcccactgttgcccaggctggaatgcagtggtgcggtctcagctcactgcaagctccgcctcccgggttcacaccattctcctgcctcagcctcctgagtagcttggactacaggtgcccgcccccatgcccggctaattttttgtatttttagtagagacggggtttcaccgtgttagccaggatggtctcgatctcctgacttcgtgatccgcccgcctcggcctcccagagtgctgggattacaggcgtgaaccaacgtgcctggccggtattacctactttaatagttctatattttgaaactttaacataatgaaatttttttgacgtcaagcttgtaataaaaatttttctttctgtgtttgaaagctgtagaagaaaaactgctgtaaactataaacacacactgtctctcacaagtgtctatatattatatatggtcatgccacataatgatatttcagttagtgacagactgcatatatgatggtagtcccataagattaaaatactgtatttttactgtacctttcctatgtttagatacacaaatgccactgtgttacagttgcctacaatatttagaacagtaacatgctgataggtttgtatcctggaagcagtaggctagaccatatagcctaggtgtgtagtaggctacacagttgtaggtttgtgtaagtcactctgtgatgtttgcacaacaacaaaattgcctgacagcacatttctcagaacatacccacatcattaagtgatctatgactgcatattatatatatgcatatatatttatatatatttatgtgtatgtatatatgtgtatatatatagcctgtacttcagagaagtttcctgtaggagtgaggtaattgaaaactatgaactttgtgctatgtggagagcagggcttcttagcagccttatcattttgagttggataattctttgttatggtgggaggcgtgtttcctgagtattgtaggatgttttgcatcatccatccctggcctctattcactagatactagtaacatcccctcccctcacaagttatgacagcaaaaaatgtttccaggcattgtcaaatgtcccttgatgggtacaaaatcttcacaagttgaaaagtagagaaacctgtatgggcagtagatgtagatatagaaatagatatggaatgttcatttccacacttcacatggcttcctaagaatgttcattactacacaatgaaaaattgatgaaagaggatagaaaaattcatgcttatgtacatttttagacttcatcctgagaagatgtgactgaaataatctttttagggaaataaagacaacctaaaaatgatatatatttttatgtgagggtgcactgtgaatttggtgaaaagttgtacatgtttaggtattaatgtcaccaatattggtttctaatttcttttctagcaagaacttgtgacttgatgaaacattaggaacttctttttgagcagttaccctttacttcactaccaatttatagtttccactacttttgttttaagaagtttgaggacttatgcttgttggtaaccgatcacagttatagttctttgatactctcatttttcttctaaacatttgtgagtttctagaaaatattcctgttttctttttccttcttactgtttcttgtccacagtgcacctctctaccttaaaaagaaatacctgagcttgtccagaataatcccatggttcaaattctgcgatgatcataaggagcaaacttctgagtaacagaacacttctaagcatactatctataatattttatctagacagatttctaagccctcaggatgatttagtcttctagagttgacccaataaaatatgacctatatatgaattcagaaggtttgagattatgatcttaagtaactagtataacttcttagtgttcctctttgtaaaaatgaaggattatttttagcagatgaggtttgaaattaatatcttattttcttcatttcttcgtaggtgggtcattctaatctgggcattaatgagtctttttcatttttattgccttcatttgttccacataagccaacaagagagtcggaatatcactcttcagatctcagaatgttgaggatgtctcctgacactgtgccaaaggctcctaaacatttaaaagcaggtacgtagaaaaaggagatagtaaatgtcctacttacggataccttgtgaaaaaatatcttgttaggtctatctaattttgtattttttaatatctataataattatacttcagattagatgtgtttataaatcctgtcttagtctctttagactgctattacaaaaatatcttagtactttaagtatggcttataaacaacagaaatttgtttcttgcagttctagaggctggttccaagatcaagtgctgggagattcagtgtcttgtgagggcctgtttgtcatagatgacatgttcctctgtgccctcccgtggtggaaggggcagggggtctctctggagtcgttttttgtaatgggcactaatcccaaacatgtggcctgtgtcctcatgatctaattgctttccaaaagccttacctccttaatttcatcaccttggggattaggatttcaacctatacttttcaggggggacacaaacattcagaccatcacaagtcccctgatgttttattagaggaatcatttggtttttcatcgcattctacatggcagtgtttagaactgaattatatggaggagtctgatgttagaatctgtttattcctttgtgtgacttgaagggaaaaaggaattgattgagcccaagatgacaagagtggatgcagataagtttgtagagaggaaattgagagaaatcagttttgaggtaaaagcaagattatctgctgagggaggtgagtagtggtggaattaggttagaggcattgaggagagtggtttggtgaagacttacagtttatgttgaagtgaatttgagatggagctgaccaagggaaagtaaaaggattggagggcagttctgagaagtcagctcaggttagtgataatgattttataatattgtcagcctgtatagaatctctgatttgtttttcctgctaacactcaggaatggagatgatgaattacagtattgatccttggttcaggaatacattgaatgggtatggtagaaggatagcagtcaaagagagaagagttgatcacctattggtttcagcctacatagggaaagagaagccagaagagttgttattctaggagaaaatagaaggaccagagatttctttatgaagttgattagatgaggtgggaataagttactgagagcactagaagaataggtaattttggtcagattgaataagtagatttaaatgaggatcagtttgaagggtgatgaaatccattaaatagccctgggattggatggtagaaattgaataaaaattactggagtaaataaaattttgggtcaggtacagtgtcttatgcttgtaatctcagtactttgggaggctgaggtgggaggatcacttggaagagtctggaaaggattggtattaattgtttttgaatagaatttactgtgaaactacctgggctgttctttgtaggaagtttttaaattgctaatttcatctctttccttgccataagtctatttagattttatatttttcatgaatcagcttttgcaatttgtgtcttaaatagaatttgtccatttagctaggctatctgtttacatatatctgttcataatattcccatgtaatctctttcatttcagtaaggttagttacaatgccctctctttcattcctgattttagtaacttaagttttcccttcttttgttctccctttggtgaatctagttaaattttgtcaattttgctgattttttcaaataaactggtttctttatttttttctaatctttatttttcttttctgatttttgtttcatttattttcattctagtcattatttttccttccttccatttgctttgggtttagtttgtgcttttattctgttttttaaggtggacagttaggttattgatttaagctctttcttcttcttattacaaatatgtatacaaattgataaattcctaagcactgtgttagctgcatgtcctaagttttggtttattatatttttgttttagttcatctaaacttattttctagtttacattgtgatttttctacatttaccctttggttatttaggaatgtgttgtttaatttccttctgttattatgtttcatctggttcaatttttgttggaaaacatactttgtatgatttctgtctttaagttttattgaggctcgttttatgttttagcatgtagtttattctgtagaatgtacagtttgtacttgagaagaatgtgtattctgctgttgttaggtggtgtgttctatagatgtctttcagctctagtgggtttagttgttcaaattttctgtttccttgttggtcttctgactagctgttttctccattttcaaaagaagggtactgaagtcttcaactctttttgtttaattgtctatttctccctttttttctctcagatttgcttcacatattttgacattatgatgttagatccatatatgtttataattgttatatattcctgatgaattgacctttttttggagacagagtcttgttctgttgcccaggctgaaatgcagtgcgtggctcactgcaacctctaccttctgggttccagcgactctcgtgcctcagcctcctgagtagctgggactataggcgtgtgcccaccatgcccgattaattagaattgaccttttaattgttataaattgttcctccatattttgagtaactttttgttttaaagtctgttttgtcttaggttagaatagacacttcagctcttatggttgctgtttgtatggtttatcttttaaaatccctctactttcaacctatttgtattatcaaaaatgatgtatctgctgtaaagagcatatagttaaatcttgagtttttaattttaaaattctatctgtttttgccttgtgatgtgattatttaatctgtttgcatttaatgtcattattgatgtgattggattcacattttctggcttacgtttggtttttcatgtgtcttgtgtcctttttctgttccccttttattattgcatgaagtgaatattttctagtatgacactttcagtttaatttttaaaatgattttctaggtagttttttttaaagttatattcttagtgattactctggggcttataatatttatcttatcagaatatacttctgattcaatttatactaacttaattctagtatggtacagaaactttactcccgtatagctctattccctctttttttttggtgctattattgttatacatactactcacacacgtatataaatgcctttaagtttttgtttttttttttagtcggggacttgctctgttgcccaggttggattgcagtggcatgatcatagctcactctaacctgagctcaagtgatcctcctgcctcagcctcctctgttgtgaggcccacaggtgtgtaccactacactgagctaatttttcaaaaaatttttttggtagagatgggatctcactatgttattagtcttgaactcctgggctcaagcagtcctcccaccttggcctcctaaagtgctgggattacacgtgtgagccaccatgccagcctgctttatatattttcaaattgctctttaaatcagttaacagaatacaggaaatgaagtatgtctttttgtagttaccgatgtagttatttttactagcactatttgttttgttatgaaaatgttactactatctggtgttacttgtttttcagcctttggaacttcctatgttatttcttgtaaggtggatctgcaagttccctgttttatgtatctggcgtgtttttatttcatctttttgaaagatagttttgctgggcttggaattcttggttgacagtctttttcttttcagcactttgaatatgtctcttcactatcttctggccttcatagttttggatgagaagtcagctgttatcttattcatgttctcttgtatgtaatttgttttctcttgttgcttccaagatacgctctttgtctttcactttcagtatcttgattatgatatgtctctctgtgaatctctgtgtttattctactttgagctcactgaacttgtcagatgtatagttaatatcttttgtctaatttgggaagttttcagccatcatttctttgaggattttttctgcttctttctcttttttgcccagttatcatctcttgcatcacagtccacatatatcagcacccctaatcttgtctcactggtctctaagcctttgtttgtttttgtttcttctttctttgcttcagtttgcatagtctctattcatttatcttgatgtttgctgatttttttcttctgtcttgtccatatctactgttgagcctctagtgaatttttcacttcagttactgtacttttcagccttagaatttccattttgttattttctaagttctgtctttcattctgtatttgatgtgactttgccatcatacctatctttaattctttaagcatccttttcttccctttgaatatgtttataatagctgcttttaattgttactggctaagcccaatgtgtgtgccctctgaaaggtaaatttgcctattttgttccccctgtgaaggggtcacactttcttttgcacatcttacttttctgttattgttctaaactggacgttttggataatatcttgttgcagctctggatattgatcccttctctgggctggtaacgtttgatatttttgttgtttcgttatttagtgtctggtttggattagttcttaattgctcaccaccaagatctccattgtttttgtcagtgtccttaggcttgagctttttatgctctgtttcaaacaaagtcattctccttatggagatgtgtggagctctctgttcttatggcttgcctctgctgggcagaagctttgtggcactgctctgtatctgggggcaggttcattggtctacttctcttggaataacacaccccttctctatgattgtgatgctgaaaggggtagtagttagtccctgttcttggattgcctctcctggagtggaccctcactccacctacaagtgagctgggggtagggatgattagagcttggtattctcaggttgggataaatcttccactctataagtggggactgggtgaaggtaggttgcttcttgtgttgtttctttttcacttattagctaacatcaacagccagtgttctttctttacagcctttctcccatgacatcccttccattctgccttgttactttatggatcgtatctactgatgtacccagttgtaccattttaattatttggttaaaatggtacatctcatttctaccagtaagatcctgagctcctcacttatctctcagagtagtattgtgctgtatgggctgacattaaagatttaatattatgcacagtcttgacatctgaaactgcgaggtcctcaaagggcctaaccacaagtttacctgccagatatgccctctactcagtggagaggcttcctacacagccagttcttctatcaacgagaccaactgtattctacctggtactcaacctcagatttccatcccatgctaacctgtgaaattattcaaacaagccaatcacaccctcctacagaaataaaaaaaatcacgctcttttcttgctactacaagcctgcctcctatggttcctgtttactcgttctgttcccatgtacaatccctgtgtggccctgcatgtcctgtgtcttccccagctgtgagtatatgtgactaataaactaccgtcagtctcctctgtgcagtgttgtatttagccaatccagatctatcaggcagcaatccctccctcatcaatagggtgaagaggaggcaaaagaaagaaatatttgtgtccatgtttgattcatattgtattgaaatggtcccttgatattagttgccctgatttcttatttttttattggcaaacctctgggtcctattttataacaagcagaaagtaactgccaagcttcatttcaaattggctccaaagtatgagtcaagataatttacatatcaggtaaagtagacacacttaacataatttgaatagtttagattacaagataaattggaaacaagtttggatctggattattgaaaaagaatcggtgacaccattagaaagtagggtagtgaatttagttttggacatactgagtttgatttgtcgggagatcatttggtttgaagtgtcttcaaagccagttgaacaaatgggaaataggaaatacaaatttggaagatcttaaataatttgtgattaaaattatgccgtaagagtagttaagctttctgaaggagcatgggtagagagaaaagcaaaatgtcaaggatggtacctcatggaatacaatagcagaaagaggccaatagaaaataccaaaaaagacagatattttgtttaaattcttactctgatttagttcttacctcttcagtttccattccaatttcttagtgcctttactatatcacactggattttgttgcacgaacatttaggattgctttgtcttcttggtggattgatcctttacaattatgtaagaattctctttgtccctcgtaattttctttgttctgaagattatcttatatagccactcctatagaatagttcttttctttcttcttcttcctcttcttcctctcctcctcctcctttttttcttcttttttcttcttcttcttcctcctgctcctcctctttcttcctcttttttcttctttcttctttctttttctcctcctcctcctctttttttttttttttaaataaagataaagtctcactctgttgcccaggctggagtgcagtgatatgatcatagctccacagccttgaattcctgggctcaagcagtccttctgcctcactctctgagtagctaggactataaatgcacactaatatgcccagctaatctttttttttttgtagagacaaggtcttgctatgttgcctaggctggttttcagctcctggcctttcaaagcctgatcctcccatcttgacttcacaaagtgctgagattacaggcatgagccaccgtacccggcctttttatctgtcttttagtttcaaccttactatgtcattatgtttgaagtgaattttttgtagacatcatataattgggtcatttaaaaaaaatcctgtctgctaatatctgtattttagtttgtttgtttatttattttgagatggagtcttgctctgtcaccaggctggagtacggtggtgtgatctcggctcactgcaacctccacctcccaggttcaagcgattctcctgcctcagcctcctgagtagctgggactataggtgcacaccaccataccaggctaatttttgtatttttagtggagacagggtgtcaccatgttggccaggatggtctgcatctcttgaccttgtgatccacccgccttggcctcccaaagtgctgggattacaggtgtagtttgtttatttatacaatttatacctaaagttaatattggtctattatgccttaagtctgcaattttattatttattttcactttattcctgtttctcttgtcttgccttactatgggtttcatgaacatactttagaatttcactttaatttttaaaaattatttatttatttttgagacagagtctcgctctgtcgcccaggctggagtgcagtggtgctatctcggctcactgcaagctccgcctcccgggttcacgccattctcctgcctcagcctcctaagtagctgggattacaggtgtgtgccatcacgcctggctaattgttttatatttttagtaaagacggggtttcaccatgttggccaggctggcttcgaactcctgacctcaagtgatccacctgcctcagtctcccaaagtgctcgtattacaggcgtgagccaatgcacccggcccttggtgtggatttctttgggttttcctgtttggagctgacttactttctttaatctgtaagtttatgtctcatcaaatttgggatgttttcagactttgtttctttgaatttgactcatcttatttgcatcatttgatcgtcttctccctctctctcgcgttcgctgtctttctctctctctctctcttgctgtctctttctctctctcggctcactgaaacctctgcttccggggttcaggcaattctcgtgtctcagcctcctgagtagctggaatcatgggcgtgtgctaccacgcccagctaattttttgtatttttagtagagacggggtttcatcatgttggccaggctggtcttgaactcctgaccttaagtgatccacccacctcagcctcccaaagtgctgggattataggcgtgagcaaccacagccagccttgattgtcttttctcagtttgtgattttcctggttcttagtggtaaaaatgaattttgattatatcctggacattttggatattatgttaggagactttgattcctatttataatcttctgtttagcaggcagttgctctatttaggttttccatataggctctggcctatttatgtggctgtgatcccaaagataatttagttttcaggggagttgcattctggtctacttcagtggtaccattgaggctcccactcagtccctgttggtgatgcttatgtgggtggaatggtcttcctcaaggcctgctggtgctgtgtgggaagggggagatgctaacccacagagtagagaacatttccctgggcctgcccctggaccaactggtgtcagtgggtcacccacttgattcttgttgatggcattcatgggggtagaaaatgcttttctaggcctcctgatgcatctaggtaggatgctgggcccctgcgatggagaacatttccttgaacctactctctgggtttctcaatgctggtggacttcccattcaatttttgccagtgccactggggaaggaaagtgcctacctgagctgtcttttaccacaggagagttaggagatggtggacctaggtcttcttttgttactggctagaggacagggagatgccaaacctgttgggactctctgcctggtttttgctggcactacagttctggtggtgcaagcctacctgttgctgctgggttggagtagggtgtggggagatgggactgtctgctaagtctgctgggctgcccgtttcttggtccatggcccacagacagcaggcttttcttggacttctttctgccctcctttgttccctttctccttcccactattcctattcctattcctatttctggtcttagttccacactgcaggcctctccagggtccagcctcagatataagagagttaaaaagaaaactaaggaagtcattgccatgttgttctccagtctggaggtccttagctagtctgcgttcactttctacctttcagttttttttttgtcttttggtttctagggaagtggagggaaaagcaaatttatatcattttgtcagggaccagaagacaactggagttttgaaaacttgacttagatgtgctattgtctttggttgttggtagaaataatcatatgggggaagtgaggtaaagatctttctcaggcaatattgaataaactcagggatctcaagccacagaagatggggacacctatgccatgaaactttcctaacttttctaaaatctgcagcccgtgtcctgaactattaataatagctgacatttattgcttgttcacattgctaagcattttatgtattattattataatgtatattatataatacaggttgagcatccctaatctgaaaaaccacaatccagaatggtccaaaatctggaactttttgactgctgacatgatattcaaaggaaatactcattagagcattttggatttcagatttttggattaggtatgcacaatatgttcttttatcatattattattatgccatattgttttatatttttaatctgacctatgatgatgggcactgctattattctatttgctatctgagcaaaatgaaacttagagtgacttgcccaaagtcccactttctctaagaggattttgatagcttcattccatattgttctctctgtttctcaagttttaaatgcctttataaccttaccataaacatatcacaccatcagtttttccaaattctttctcagagagggcaccaatttaatttctattatatacttaacactaatcttggcatatgataaaggcatgaaagagtctcgatgattgtttgctaactgaagagttcatcagttagtggtacagtactggctgcctcagcttgtttacagcatcaggtagtgacatagtaggaaacaatgctttgtgcaagaaaggattttaacttcttcctaggtaatatcaacacccagggcttcagttatttcctatgactgatgagttccaattgtaggactctatctagatatatctcatactccaaatgtttgtatctgactactatgaaatgtcttcatttggatgtcccataggtatcttaatgtcagaactttaaaaatggagccaatcatctctttaaacctactcttccttctctatttcttctcagtgaatgagtgtctacttattagccaagctagaaacttgtattcttctttcaccctcatccctgcccaatcacttaatctcgttgattctatcagactcccattctcttttctgaattactgcattagtaatggaaaactgatcatcttctctgccacttattttcagtattaagccaaaatagtctgtttacagggcagacttgataatgtcacttcctagtttggagttcttgctttccattgttaaccttggggtaaattctaaactccttagtacatagtagaaggtccctgcttaccttcttagccttatacttgcctcttttttcatagtgaactactctcatttcttcatgatgctagaccctcttgtctccttgatctcatagatgctattttctctacttggaatgcttccctattttttatatgcccatctttgcctaatttctggtttttatcctttcattctgagctttgctgtctttcaggaaaatgtttctgtttttcactgttcaccatgactctttaagaaagagccagatactccttacatatgttgctatagtatcctgtaaacagcctccctaatcactgcccttacactgaatttagtaattgcttttttttacttgtttctgtctcccacaggactttaagctctttgagggtagagctcgggctttgctaatatatatatttttgcacctggctgtgaaagctactcaataaatatctgttgaatgactttatgaattgatgaatattaaatgaattaacatgcctgggtagactgggggaggggtagaataagatggtaggctttgtattttggcagggatcagttctcaagaaagtggatcaaataaatgtaagtatcatatttcattgactatatgtcagttgtaatgaaggcctatggattagtgtcttatcactattttattgatctctggttaacatgaggctgtctctgtgacttgaatggcctatatgtctttctttatgttttttggtgggtattggggtttatgttccctgcctctaaacctaattgatttatcttttagttttcctgccataatttttattgacgcccagtcttttgtttaaccttactaccttaggttgttatttgttgggtatcttctcccttgaagatgcaagttactcagggcagggagggaacctgcgtgtggctcagagtaagggaggactttagtttggggcaggactttgaagggttctcttaaagatgaggagcctggaagcaagatctgaaattacatcttctcctgtcccagagggaatttctttgagtaggggtgcacctatcagggtggtttgatgactgggtattactatgaccaggttataactttcccagggttattctgttaggaaatagtgtttgggatttgatgtttgagtacagagttcatgaacttttcacaacaccagcagttcattagctttttgaaacctctgcccacttaggaatgaggaagagtctataacgcactttacctaacaattcctgctttcgcattgaaaaagaacttagtgatagcaacaacaaaattaggaattaaattacaggctataatgttagctcgtgtatgtgatttttgtgttataaaacagtgccctattatcttttgaaactaagcaattttattacatttaacttgattttgtattgcaagttatttaaatggcatacatttatcaacaggacaacgttaatgaattatcagtatgcaggaactttggaagggttatatttacgtccactgtggtaataagggtatcaaaaatcctgtttgaactgtgatatattgtgttaagtttagttatgagagaatatagtttaagataatgaatgtagagataaacatctatgagttaactgagggattaacgaaatacaacacaattataattatttagttatcaataattaataattaggaacttataaaaatgatatagtaattaattagaaagcaagaataacaacaatgaagacaaagacccatttaaaatatcactggtgtctttttaaaaaaacatgaatttgagttttacttctctgtacacacaataggtgcttttgccagactttttaaaaaaaaatcttttttatttttaatatttatgagaacatagtaggtgtatatatttatggggtacatgagatattttgacacaaacatacgatgtgtaataatcacatcaaggtaaatggagtatctgtcacctcaagcattcattatttctttatgttgtgaaaattccagttatactcttttaatttaaaatgcgttataaataattgttgactgtagtcaccgtattgtactatatcatattctagagcttattcattctaactacatttttgtacccattaaccatcctcctcactaccttcccagccccgttacagacttattagtgactgaattagagggctcaaaatgagagctatagtaatttatttgtgtgtgctagtattaaaacccataataattgacttggaacgattactagtaagaggctcttagtcatatgtaaaatggaagtatggaattgtacctcattttgtctgtgagaaataaagggcttgcttattcttcttatgtcagaatatacttggggaaataaaaccgtgctgtcttcgtcacctaaggaagccttctgtgttactaagcaccttagtatggagaagagttcttgagtaaattgtacccaggttgttagtcttaatgtcatctctaagaggcatacagttcccacccaatatacaactttggtgtagtatagtctttttctggcagccatcttcctcttcttggtcgaaacttacctcttcaactcacccctagttctgaaaatgaatctccaaagattatatcagtatgtagtaatattgttaacactcacacttagtgtattcttctttcccagggctgagagaataataaggactctaaaaacataccatttttcatcatgaactccttatgtacatagacacattttataaatcatagttaatggatttgtgatcaccattcttctgacagtttgacatatatgtccttaactttatatagaactgacaagaattcttctttaacatcgtgcatctcctccctcgcttttaacagcttaacctatagtcgttcttccagttttctttactaatcttttcctttacccctgaggttaaaaagaccttatcttatgtaacctggatctttcaaggacctgggctgtacatcttaactccttagctatttatctcatttgtccccattcatggtgtcactaataatttgtaatggccaaagggatataaaaactttgagaaatcaggaaatcatttagaaaaacaaggttttgttttgttaatctgttttggtttattagcttcttgagcctgttttgtttcctcacaaaaacttttcttattttctttagacccagcaggcaagaacctcacaaaattttgtaactcatattccttctcaggttacaatgcatgttacatttttaaattttttacttttcttgaagagttaatacttgatacttctagttctttactttgaaattcactcctcaacccatttcattctatattcagctcctttgaagctcgtcagtggccatagaaagccagtcagttgtagtggaaagagctcagaacttggatttagagtttaagggttaaagtaccagtttttgtcacttacccacctacaattctagaaaaactatgtatctttgcacttaaaatgtggtctgaggaccaataacattgggcatccctggggagcttgttagaaatgcagaatttcaggtcccacccagacctactgagtcagaatctgcaagttaacaagatcccaacattgagaagcactgttacatggtcatctttgcaactcggtttccctatacgtaaaaaatagataatacttgctctatatatcaatcatcttaacaccatctgacacatcatatgttttaccaatttattgtcagcctcctcctgctagaatacaaattagctctgtgaggtagggattattgtctgtttgtttattgctgtatgtagaacagtgcctggaacatagtaagcattcatgtattttgaatgaacaatgaatgaatggacagcttgtcaaatcctgtcatttctgttgcagtcacttactttacactgctgtttaaaactgctttcatttagaattattgtattagtgcaaatatagaacatttctatagaaatgtttgttggattgtgcaacctagatttttacattcccttctcactcatcttgaaaactttaaaactgtaaacaacttgccatgctatacagaattaagttaaaactcttcagagtaacctttagagttttttcagttttatgtacttaaatatatatatattatacagggtgcatttgttgggagagtccttcaaactcactgcacgcatagcatccctctaggccatattgtactgcccctgtgggacttgggggcaggaggaacccgtgaaaataagctgatgagcctttgctgtaccagggatcatgaagtcttttgtctctgactgaagaccttatgtcttctgccagcctgcaagacacaataacagattgtaagtagggtgaaatcaaatcctagacccaatagcattatcccatctcattgaaaattctcttaaaaatccaagttgtaagatccatataatatttcatccactggatatactgttgtttataaccattactctgttgttgaagattaaaatgtttttactttagttttctaattaatatctttgtgtgcaaatatttatctcctttgatggctgtttccttaggattcatttctagaagctttttaaaggctcaaagctggcttttttccagcacatagaattttaaaatagaaaattttatatactattaacaaatctctttttctttaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatggagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagtttgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatggtaagaagaaagtttcaggcttataaacgttatagtttaataatgtgtttaaagttagatatttatgttttgaggaagcttagccaatgaaaaatacaagcaagatcaagaaaaaaaatgaagttagatatttggagttctaaatgtattttccaatagaattgttagaatgactatatttcttctaacaatccataaaaagcctatttaaccaataatgtagttaagttacagtattaatagtaccagcctgagtttacgttcttgttcttaggagaagtagattctgatgtatgacagagagtaaagaggtcgcttgggctcctgagctcctaaagctatcacgtttctctaatcctcccattatagtatccttattctgaaggcagaaagagcctccaatttgctgtgctctaaattgctttttgtcctaaaactacatatattttctctttcccttttctaatagaactcttggtgttgatctcagacatttgaaaaaaaaatcaatgtattttatactaaaacttgggttagaggtttaaaagagaatatttacaaatctcattaatttctaatagaattccattaaaaacaaaaatctgtaagacaatatggggaatatattttgggaggcaatttaaaagcaatttaggcctacctagaaatcgtcccttgaggttaacttcctacgctgttccctgcacatttttattctacaaaaaaacctccaagttgtatttattacttttaaatatcagctgtcatggaattatgagtaattgtagcaggaactaaagggagaggtaaagaaactcatgattaaaaggaggattaagataaatatgattgattacccgatttaaagtggcttttttgtagaattatctatagagcatgacttaagaaaatcagactttgcagtgaaaggatctctgtcaagaatttctaataggttgtcataattgagaagaagacatactaagcattgcagtgggtattaaattgcatatattgatgatcttctgtgttgcaattgttgacaaattatcacttttgcattgtattatctcaagtgtatgctttctctccagcctggaatatgaagttcaatttagcacatgattgtggatactccatttcagaattaaatgaagatgacaggaggaaagtagaagagatcaaggcagagttatttggtcatggaagaacaactgacttgtccaaggtataaaagaaatctggaaatgaagaaagtaaatatgaaagaatgggtgatggaattaggatctcttacttgggcatcagttgagttgctgataatatttggctaaagccttttttggttttgtttttgagacagtcttgctctgttgcccaggctgaagtgcagcagtgcaatcacaggtcactgcagccctgaactcttagactcaaggaatcctcccacctcagcctctcaggtagctgggaccacatgtgtgtaccgccctgctcggctaatttttaaatttttggcagagacagggtctctacgttgcccaggctggtcttgaacgcttggattcaagcgatcctcttgccttggcctcccaaaatgctgggattacaggcatgagccactgtgcctaggcaggcatcttaatttttcaaaagttaagatataagtattagattcttacagtctagatatgttgtttttattgattccaaattcatattttgaaaaatttatcttcttagaaaaataagaactgatttgcttgttttatcaattttttttttaagaacagagaagactaaatgtcacccttattttctcttgaaagtggtatcttgaaatccagctattttcaaatgtttattttaaatacttgagtacacagctataatagcttatgtataaatggctttcattttaatagtacatattttccttctattaactatttcatatgtagaaaagagcatatatgaatcatttatgtaaagaatagcagcaagtaaaaataattcccatatatttactatcgagcttgagaaatagaacattaccaaatactgttgaagttctttgtttctcctttcccagtcatatcttttttatttcttattttgatatataatgattttccttctcttcagtatggttttgaactctaagatggaatcaatatgatacatattcttttgagaactaggtgtttcacacagtgttagggttttgagctgcttctatgtagatgtgcagagttttcatttgttccttattactgtacagtattccagtgtgtgattacatgataatttattctttctcctgtggataaggcattttgtctgctattttgcatagtaatagggtataataatgcctatcgtagagggttttggtgtggattatgtgagataatgcctataaaatgcttagtagaacgtgtgatgtctagttagtactcagtaactggcagctattattactattattaatcctgaaagaattgatatagctatcatgcaaggatttcatggcctgattcatacaaagtttcttagaaaactattctccagtgatatagtttatttggattatctcaattttggaaaagtttgaaaagtacaaattagattggattttaggttttacgtatatgcttgtgaaaaacaaaattgacaaaataataagaataataaaatgggcaattggttgtcttagcaccatttgtatatatgctgccaaagtgagcactatcctagcatcatttgtttaaaattacatagttttctcagtgatctgtgtttccctatttttaaaaattattttcttgcgttcatatttccagatccctcagcaagcaagttgccttcctttgggtagactctggtttgtctgtgtttttcttaaaataaggtgtcctgaattagatgaaacacaatttcacttctgatctgaccagcatgaagtatattcagtaattctctttctgtcaatgtactgtgagatctttaatggtcacagcataattgggcattaaaaaaaaccatgtactgctttcaaaacttaaagctgtaggaaaaaagcaaagcaaaacaaaccaaacaaaaaccatgaactgctgccaagattcctattctcatttcttgtatctatataatacttttttaaaaatcttcttatttttgagacagagtctcactttattgcccaggctggactgcagtggcatgatcttggctcactgcaacttctacatcccaggttcaagtgattctcctgcctcagcctcccgggtagctgggattacagctgtgtgagtggcgcatgacaccacatccagctgatctttgtatttttagtagagatggggtttcactatgttggccaggctggtcttgaactcctgacctcaagtgatccgcctgcctcggcctcccaaaatgctgggattacaggccattacgcctcgccctatgtaatactttttaactctcctgtatttctttttattgcttttatatcagtgttcaagcctattggaatgatttttaatcaaatttgatcatttattttattaaaatatccctttcagctttgtgccatttatatatttgataagtatttttatccaaattagcaataaaaatgtttactaagggctatggataaaaagtctaaaacttttggctgggcgcggtggctcatgcctgtaatcctagcactttgggaagccaaggtgggtggatcacttgaggtcaggagttcgagaccagcctggccgacgtggtgaaaccccgtctctactaaaaatacaaaaattacctgggtgtcatggtgcatgcctgtaatcctagctactcgggaagctgaggcaggagaattgcttgaacctgggaggtggagattgtagtgagccgaagattgtgccagtgcactccagcctaggcgacagagggagactttgtctcaaaaaaaaaaaaaaaaaaaaggtctaaaacttttgaataagattactctcacacctattttgagtacttcactatactgtcattcaaccatcttgtgtttcaccatcttatgattgacttttttcagtctattaactgagtagttgcgaaatagtgtttgtctagatatgccttgtccttagggaacccatattggccacactgtgtacggttttggaccttttatttttttaacttaaatatattaggatttccctttaaaacttctctaaaagcataatttcacaggtatgtaatatcccattgtatgaacataacaatttattcactaccctactgttggacatttattcattcattccaaaaatacatattgaatgcctgatatgcgccatcctcatctatagcctgaggacacaccactgaacaaaatagacaaacatttcttcatcatgagcttacattaaggaagagtatatgaataacaaccaaacaagtaaaataaatgtcagatggtgggataagagccagggagacaaagcagaatggtcaacacagaacctgagaaagaggtattgaattaaatatctgagtaaggtgagaaagtaaggcagttaacagtgacaagagcattccagacagaaatagcatgcacacagttgctgaggtaaagtgtgtgaaaggaaagggaatgttaaaggaaagggaggaggccagtgtgtttggagagtgagagtgaaagggagaagactagattgtggaaggcagtggttcttgacgggtagtaaatgcctcccaaagagatattttggaaaattatgtgatttttcttgggtcatcactgtaattggggattgtttctggaatgcagtagataggtgtcaggtatgttactatttctataatgtacaagacagttccacacaatgaagagttgtcccttgtcacatacagcttttgaatgtccctgtagatattaatgttgatgaaaaacctgttataaattacttcagtgtttgtcatgttttaaatgattttttttttagtatagggtgtttcttctgttttttctttctttcatgactgacatttttgaagagtacaacctagttactttgcagatttccctcaaattgaatttatctggtgttttatcatgatttgattcagatttgatttttatgtaggaaagccacagaagtgatgtgcttttcatgcttgtcaggaggcacattatgttgatttgtctcaatacttgtaatgttaactcataccacttagttaaggtggtatctgctggtttgtgtgttttacatattaattaataagttaataaatattagggagagattctttgagactgtaaatatctctagtttaggatctagtgtttatacttgcctgaataatttattaataaaatagctttaatttggttattgaaaaaaattccatcattgcttcaacatttcattggagttctgtggtaagttaaaagtgtcccttctccatttatttatttatatcattatggactcttggatttttcgtttactcaaagggtcacaacctatcactatcattgtttattttgatactcaaattatcccacacttgcccactggaaccattttaagctggttcctgtgtgttcttatgatcccatcatttcatgagcattcacccactttctgagctaggaagacactctaggaatatcttatattttcttttcaccaaccctagagctgtccatttctccaaggggcgctggttctttttagcagagagtggcatgtagaaactaagatctgtatgcttggtgtgcttattgatactatgatgctgttgcctttatgccctttcagcagacaatgtgtgtgtacataattacacgcacccccctctcccctgtaggcctgtttccttatctattacttttattataaaatgagagctgagtttatactagtacatccaattccattccagtactacagggttattctagcctttttttctttctttatttgtaactcacttccctgatagtaagaaacttggctcccattatcctccatatatttacttgtttaaactcccttgtatgtttctccctcagccccactgctcttcatgcctgcaacagattgaatttctttcccagccccaactctttcaacccacaagttttatatgtaatataattattattataccattccagatatttttaaatttccattatgatttctttcaacaatgaatggtgatatattaggatgataccttcagtgtgctgaaagaaaataaattatatctatctagaattgcatgtcagtgaaaatctgttttaagaatgtggtaatataaaaatgattttagacaaaaacagttcattcagcactcattaaaaaattcgggtggagccaagatggccaaataggaacagctccggtctacagctcccagtgtgagcaacgcagaagactggtgatttctgcatttccatctgaggtaccgggttcatctcactagggagtgccagacagtgggtgtaggacagtgggtgcagcgcaccattcacaagccgaagcagggcgaggcattgcctcactcgggaagtgcaagggttcagggagttccctttcctagtcaaagaaaggggtgacagacggcacctggaaaatcgcatcactcccacgctaatactgcgcttttccgacgggcttaaaaaacggcacaccaggagattatatcccgcacatggctcggagggtcctacgcccacagagtctcgctgattgctagcacagcagtctgagatcaaactgcaaggcagcagcgaggctgggggaggggcgcctgccattgtgcaggcttgattaggtaaacaaagcagcctggaagctcgaactgggtggagcccactacagctcaaggaggcctgcctgcctctgtaggctccacctctgggggcagggcatagccaaacaaaaggcagcagtaacctctgtagacttaaatgtccctgtctgacagctttgaagagagtagtggttctccagcacgcagctggagatgtgagaatgggcagactgcctcctcaaggtgtccctgacccccaagcagcctaagtgggaggcaccacccaggaggggcagactgacacctcacacgaccgggtactcctctgagacaaaacttccagaggaatgatcaggcagcagcatttgcggttcaccaatatccgctgttctacagtcactgctgttgctagccaccgctgctgatacccaggcaaacagggtctggagtggacctctagcaaactcccaacagacctgcagctgagggtcctgtctgttagaaggaaaactaacaaacagaaaggacatccacaccaaaaacccatctgtacgtcaccatcatcaaagaccaaaggtagataaaaccacaaagatgcagaaaaaacagagcagaaaaactggaaactctaaaaagcagagcgcctctcctcctccaaaggaacgcagctcctcagcagcaacggaacaaagctggatggacaatgactttgaagagttgagagaagaaggcttcagatgatcaaactactccgagctacaggaggaaattcaaaccaatggcaaagaagttaaaaactttcaaaaaaattagacgaatggatacctagaataaccaatgcagagaagtccttaaaggagctgatggagctaaaagcaaaggcgcgagaaccatgtgaagaatgcagaagcctcaggagctgatgcgatcaactggaagaaagggtatcagtgatggaagatgaaatgaatgaaatgaagcgagaagggaagtttagagaaaaaagaataaaaagaaacgaacaaagcctccaagaaatatgggactatgtgaaaagaccaaatctacgtctgattggtgtacctgaaagtgacagggagaatggaaccaagttggaaaacactctgcaggatattatccgggagaacttccccaatctagcaaggcaggccaacattcagattcaggaaatacagagaacgccacaaagatactcctcgagaagagcaactccaagacacattaattgtcagattcaccaaagttgaaatgaaggaaaaaatgttaaggacagccagagagaaaggtcggattacccacaaagggaagcccatcagactaacagcggatctctcggcagaaaccctataagccagaagagagtgggggccaatattcaacattcttaaagaaaagaattttcaacccagaatttcatatccagcgaaactaagcttcataagtgaaggagaaataaaatcctttacagacaagcaaatgctgagagattttgtcaccaccaggcctgccctaaaagagctcctgaaggaagcgctaaacatggaaaggaacaactggtaccagccactgcaaaaacatgccaaaatgtaaagactgtcaaggccaggaagaaactgcatcaactaatgagcaaaataaccagctaacatcataatgacaggaccacattcacacataacaatattaactttaaatgtaaatggactaaatgctccaattaaaaggcaaagactggcaaattggataaagagtcaagacccatcagtgtgctgtattcaggaaacccatctcatgtgcagagacacacataggctcaaaataaagagatggaggaagatctaccaagcaaatggaaaacaaaaaaaggcaggggttgcaatcctagtctctgataaaacaaactttaaaccaacaaagatcaaaagagacaaagaaggccattacataatggtaaagggatcaattcaacaagaagaactaactatcttaaatatatatgcacccaatacaggagcacccagattcataaagcaagtccttagtgacctacaaagagacttagactcccacacaataacaatgggagactttaacaccccactgtcaacattagacagatcaacgagacagaaagttaacaaggatacccagcaattgaattcagctctgcaccaagcagacctaatagacatctacagaactctccaccccaaatcaacagaacatacatttttctcagcaccacaccgcacctattccaaaactgaccacgtagttggaagtaaagcactctcagcaaatagaaaagaaattataacaaactatctctcagaccacagtgcaatcaaattggaactcaggattcagaatctcactcaaaaccgctcaactacctggaaactgaataacctgctcctgaatgactactgggtacataacgaaatgaaggcacaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaagaccgctagcaagactaataaagaaaaaaagagagaagaatcaaatagacacaattaaaaatgataaaggggatatcaccaccgatcccacagaaatacaaactaccatcagagaatactacaaacacctctatgcaaataaactagaaaatctagaagaaatggacaaattctttgacacatacaccctcccaagactaaaccaggaagaagttgactctctgaatagaccaataacaggatctgaaattgaggcaataatcaatagcttaccaaccaaaaaaagtccaggtccagatggaatcacactgaattctaccagaggtacaaagaggagctggtaccattccttctgaaactattccaatcaatagaaaaagagggaatcctccctaactcattttatgaggccagcatcattctgataccaaagccaggcagagacacaaccaaaaaagagaattttagaccaatatccctgatgaacattgatgcaaaaatcctcaataaaatactggcaaactgaatccagcagcacatcaaaaagcttatccaccatgatcaagtgggcttcatccctgggatgcaaggctggttcaacatatgcaaatcaataaacgtaatccagcatatacacagaaccaaagacaaaaaccacatgattatctcaatagatgcagaaaaggcctttgacaaaattcaacaacccttcatgctagaaactctcaataaatgaggtattgatgggatgtatctcaaaataataagagctatctatgacaaacccacagccaatatcataccgaatgggcaaaaactggaagcattccctttgaaaacaggcacaagacaggggtgccctctctcaccactcctattcaacatagtgttggaagttctggccagggcagttaggcaggagaaggaaataaagggtattcaattaggaaaagaggaactcaaattgtccctgtttgcagatgacatgattgtatatctagaaaaccccgttgtctcagcccaaaatctccttaagctgataagcaacttcagcaaagtctcaggatacaaaatcaatgtacaaaaatcacaagcattcttatacaccaacagcagacaaagagcgagccaaatcatgagtgaactcccattcacagttgcttcaaagagagtaaaatacctaggaatccaacttacaagggatggaaggacttcttcaaggagaactacaaaccactgctcaatgaaataaaagaggatacaaacaaatggaagaacattccatgctcatgggtaggaagaatcaatatcgtgaaaatgccatactgcccaaggtaatttatagattcaatgccatccccatcaagctaccagtggtaatttatagattcaatgccatccccatcaagctaccggtgactttcttcacagaattggaagaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaaacaagaaatggggaaaggattccctatttaataaatggtgctgggaaaactggctagccatatgtagaaagctgaaactggatcccttccttacaccgtatacaaaaattaattcaagatggattaaagacttacatgttagtccgaaaactgtgaaaaccctagaagaaaacctaggcaataccattcaggacataggcatgggcaaagacttcatgtctaaaacaccaaaagcaatggcaacaaaagccaaaattgacaaatgggatctaattaaactaaagagtttctgcacagcaaaagaaactaccatcagagtgaagaggaaacctacaaaatgggagaaaattttcgcaacctactcatctgacaaagggctaatatccagaatctacaatgaactcaaacaaatttacaagaaaaaaacaaccccatcaaaaagtgggtgaaggatatgaacagacacttctcaaaagaagacatttatgcaggcaaaaaacacatgaaaaaatgctcatcatcactggacatcagagaaatgcaaatcaaaaccacaatgagataccatctcacaccagttagaatggcgatcattaaaaagtcaggaaacaacaggtgctggagaggatgtggagaaataggaacactttacactgttggtgggactataaactagttcaaccactgtggaagtcagtgtgtcgattcctcagggatctagaactggaaataccatttgacccagccatcccatttctgggtatatacccaaaggattataaatcgtgctgctataaagacacatacacatgtacgtttattgcggcactattcacaatagcaaatacttggaaccaacccaaatgtccaagaatgatagactggattaagaaaatgtggcacatatacaccatggaatactatgcagccataaaaaatgatgagttcatgtcctttgtagggacatggatgaaactggaaaccatcattctcagcaagctatctcaaggacaaaaaaccaaacaccacatgttctcactcataggtgggaattgaacaatgagaacacatggacacaggaaggggaacatcacactctggggcctgttgtggggtggggggaggggggaggggggagggatagcatttggagatatacctaatgttaaatgacgagttaatgggtgcagcacaccaacatggcacttgtatacatatgtaacaaacctgcacattgtgcacatgtaccctaaaacttaaagtataataataataaaataaaaaaattctaagtggttacctcagactaaacggaaataatctaatatgggaaatttgtgatgtaggaaatattaaagagcaaaagatgtgttaagtatgtggataaataaagctaaatacttaagtatatgaaacaaaaatactaggaccttcatgactgagatgaaatgttataaacttaaaatatatgacaacaatatcttacaggttagaagctgcataaatggagttaattttttccaagtttcttaagtgtttgggaaaaagctgttatttactttagcttgataactatatgtgttataatttctataataaccctgtcccctacatcataccttactacaaaattaatttgagatggatcatagactttacgttgaaaggtaaaataaagtttcttgaaaatctcttcatgatgttgggttaggcaaaggtttcttaaacaagaacaaaaatacactattcataaaagaaaggattgctaaattgctcttcatgaaagttaagaatggtaatcaaaaggcagcatgaagagtgaaaagtcaagctacacagtggaagagggtatttcggatacatatatttgataaaggacataaattcagaatatataaggaagtcatgcaaatcaattattcctacccaaagacttcactaggtgtctcataaatgaagatatccaagtggacagtaagcatttgaaaacattgtcaatatcactgcctgtttggtaatgcaagttaaccataatgagatactgcttcatatcagagtagctaaaattaaaaagaacaatgctaaatattggtaaagttatgaagcaactggaatagtcatttattgctgatgggaaggtaaactggtacacaactcttaaaataatttatagttatttcataatggtaaacatgccttacctgggacacttcattcctacttctttttaggtacgtactcaagaactatcagtacatatgttcaatagaagacatggtcaataataattatagccccaaactgaaaactacataaatgtatatcaagagtagaatagatgaatcaattatgctttattcatccagtgaaatcctgtgtagccataaaagatagcaaactactactgcctcaacaaccttgaaagctgtcacacacgttatggttagcaaaaaagccagacacaaagagtcatactgaataattccattcatatgaaattcaaaaactaatcaatggtgagaaaagtgataagaatggttacctctggtggagtcaggtgtgtggtattgactgggaagacgcacaagaggtcttctcaggtataggaagtttttgtatatctggatatgggcagcatttacattgctgtcatcacatataaaaaataaactacctgacttcagatttgtacaccttattaaagatttattatatattaattaaaaggaaacattgaacaagagatacaattgaaatcatagaaaaggaactttaagaaggcaaccatttctaatcatagcaaaaactttataaaaagcatcaaggcataaatctaacaagatttatgagatcttttattggagaatagtaaaatttattttgaaaggctagtagaagtcctaagtacatagagaaatacactgtatttattaataagactctatatccacctagcacaaactgcttcaatgaatcaaggcagatgtttctttaaattttttttatcatggtaaaatacacaacacaaaatttacctcaactgtttttaagtgtacagtttactggtgttaagtacattcatattgttgtgcaaccaccaccaccatccgtctccaagactcttttcatcttgtaaaactgaaacttatacccattaaataataacttctcattctgtcttcccatctgccccaggcagccaccattttcctttttgtctcatatgattttgattactctgagtacttcctataaatggaataatacaatatttgtctttttgtgactggcttatttcacttagcctcatgtggttcatccatgttgtagcatatgttataattttgtaaagtgagtctgttgtagacagtatatagttggatcattctgccaatctctattgattaaatttatttacttttaaagtaattaacaataaggaggaacctgcttctgtcctttttctatttgttttctacatcaaggtacaaattttatgttcagatacaattccaaaccacgatgaggatttatcttaactgtcctctaccccacagaaatgcagaggccaacaaatcacatttgtaggctcctaaaggaaactctcttagattgcttgtcaaaaactgttgagatcattttggccccttccatgctatgagaacgagatccacactgtacccaatgatttactgacttctctcggcagaatactgtctcttctccttctctcttctgtttggtaatgaagagaagaaaagtttgaagtcagtactttatatcatttagtatatggaccaataactcaacaagtttagaaaaaaaaaccatgaagtaaactttacttatactctaaaataaaccaaaccaaactacgaaagtagtaaggaggaaattataaaataaaatctatcagttaatgaactagaaaacagaaaaatgatagaattgagcattaaaatctagatttggaccttggaaaaattccaaatcagcagacaagttctgactagctagaagatgagaaggaaaaacatacaatgtggtaaatgaaaaggagcatgccagatataccacttagaaaatttgaaataataggagaatataatgtataacatataactctcgttaggtataaaattttcatgaaatgactgattttcttagataatataattaaacagaagcgtgtaacagattaaacattatgagagagaaaaactttattgatcaaacatttggcttccaagaaaagtacctgacctagctcaatattaggtaacattatgaagtatttcctgggcatgataatgacattgtggttatatgataggtgaattatttagggtcgaagtgtcaaatcagtgtctttgtggagggataaagctttgtggagggataggggaaaatgttcgacaattgttgaatctaaatagaaggaattcacatgtttattttaacattctatcaactttttggtatactcttaacaaaaagaaaaaaacaatgcctgacttagatgtttatatgggtgactcaagctatcaagtaatggataactcctgtgccatataaacagttccaatacactaacaaaaacttcctaatttacttgaggacattaacaaaaacctcagaagacatacctgaaattatgaatcttttgcatcagtgtgatgtctccacttttatttctgattttatttatttgagtcttctagttttttcttagtctagctaaatgtttgttaacattgtttttaccttttcaaaaactaacaatttagttgatttcttcctgtttttctattttttatttctgctctaatttttattctttccttttttctgctaactttgggcttagttttgttcttttttttctagttccttgagatgtaaagttgagttgcttatttgagatctttcttcctttaaaaataggcaattatcattagaaacttccctcttagtcctgattttgcttcatcctgtaagtgttcatttgttgtgtttttgtcttttttaaaattttccttgatttcatctttgatccactggttgttttaagagtgtgttgttaattcccacataattgtgattttcccagttttccttctgttactgatttctaattttagtctattgtgcttgggaaaaaaaggttggtatcatttcagtcttcttaaatttgttcagacttgttttatgacttaatatgtgatctatcctggagaatgttctatgtgcagttgagaagactgtgtattctgcaactgttaggtggaatattcagtatatgtgtgttctgttcattattgaaaatggggtactgacatcttctactgtattgctaattgctatttttcccttcagttctgtcagtgtttgctttatgtatttaggtactctaatgttgggtgtatatatgtttatacttgtgatatcttcctaatgaattgactcttttatcatatgaccttctttgtctcttgggatggttttttatttaaagtctatatcgtctgatagtgtggccacacctgtgctcttttggttgctatctgcatggaatatattttcctattccttcacttttagcctgtgtgtccttaaatctaaagtgagtctcttctagatagtatatagttagatcttatttttaaaattaattcagccactatatgttttttgattagggagtttactccatttacattaaagtaattattgatagggaaagacttactagttccattttgttaattggtttctttcttgtagttgttttgtcccttttgtcctctcttgctgtcttcctttgtgatttgttgattttgctttgatccttccttttttttttttctttcgtgtatcttctataggtattttctttgtggttaccaaagtcttaacagaaaacaacttatagctacagcgaaagcaatttaaaaaaatagacaaacaggactgcatctaattaaaaagcttttgcacagcaaagaaaacagttaagagactgaactggtaatctatggaataggagaaaatatttgcaaaccatgtatctaatgaggggttaatatccaaagtatataaggaacacctgcaactcaacagccaaaaaaaaaaaaaaaaaatccccaaaacaaaaaacaaataacctggttaaaacatgggtaaaggacttgaatgaacatttcttaagacatacaaatgtgtaaggtgctgtatatgaaaagatattcaatatcgctaatcatcaggaaaatgcaaatcaaaaccacaatgactgaacacttcatatctgttaggatggctgatatcaaaacaaaacaaatggtaacaagtgttggagaggatgtggagaaattagaaccctgtacactgtagatggtcatgtaaaatggtgtagctgctgtggaaaatagtatggagattccttaaaaaataagaatagaattaccatatgatcccacttctgggtacatatccaaaggaaatgaaatcagaatcttgaggagatcccatgttcacaatagcattaatcacagtagccaagatatataaacaagatgtataaacatctatagatgaatggataaagaaaatgtggtatatacatacaatggaatattattccaccttaaggaagtcctgctgtatgtgacaacatggatgaccctgcaagacattacactatgtgaaagaatccagtcacagaaggacaaatactgaatgatttcacttatatgaaatatctaaaaatagtcaaattcagaaaacagagagtagaatggtgattgccaaggactgggaggaaggggaaattgggaattgatgttaggtaggtatcacaggcaaagcagatagttcaatattgggaaatttataaacaagtttttacattagtagatctaatggagaaatgattatttcattaagctccaaaaagtatttgggaataaaaataaaatctgtaattaaaaatatttctttagagtagaatatttctttatagtagaataatacctcaaatatgataaagaatatgtatttgaaatttgcaatcagcataatcaaagtcaaatacttttgttatgcatataaaacatttgtgagaaaagtcatataatatggtggagtagggaactctagggctcttgcaaaaacacctaataagcttccagaaactatcagaattagttttcgtagaactctggaatttagttaacattaaaaaccaggaaaagtagggagctgtagcgctgcagaaacagaacactatggcaccttaaattgctcacctaccattccttgtgcctagatgaacaatgactttgaagacagcagcttatactcatggtgcaggctgttagcacgagaaggattagtacagatcttgctctcaaaaaattgtgatcgttttaacctgtctgaagtatctgaaggaccagtatagagcttccttttgttttacacagctcagagctttcctgggactggggtggcttgtctgtcatcacgtgtcaaaagtatttaaaagccagagtatcagctgtagaagcctgagtctggggataaaaattaggacaatgaataggtagacaaaaagccaggaaggaacggttgaaaaggagatacggggtggtataaggacttttaaatgcttttttgtatgctgagaaattgagaatgctacgtacatgcctaggattggacaactcctcagagaaggcttgagaagaccctaagctttcaccactagctgaccttcaggctctgcctaactaagtaggatgtgaaggctaagatatagttgtaaacagcctggcttagtgttgatggaatgccccaacacagagcaaaaaagactgggagtgtttttttttctttcctattaccttttttctttccttggctgcaggtgtttaaggaacctgtcaaaatagtagttgaccctgaagctaagtgagcacagacttcagttccatgcacaacaaagaatgtaagctttatgaaatagtcactaaacaacacttacaacaagcagtaacagcaaactccagggaagggggagaatccagtatccagagttgtcactttataatattcaatatgtccagttttcaacaaattataaggcatgcaaagaagtaaaaaagtgtgactcattcaaaggaaaaaagagaaattaatgaaactatccctgaggaagcccaccttaaatgtactcaatgagctgaacaataccatcagcaaagaactaagggaaaccaagaaaaggatttcccaccaaaaagaaatatcgacaaagagaaattataaaaaggaaacaaatagaaattctgcagctaaaaagtacagtaacaaaaattctttagaaggattcaatagctgagtagtctgaacaaagaatcagtgaacttgaaggaaggtcagatgatttatttattcgaggagaagaaagagaaaagaataaagaaaatgaacagggctatgggacatccccaagcataccaacatatgcattatgggattcttagagggaagagagagagagagagagagagagaaaggggcggtaataatatttgaagaaataatggttgaaaacttccctaatttgttgaaaaatgaatttcaaatgggttaaactcaaagagacccacaccatgtcacattatagtcaaattgttaaatatttagcatagatgttggttctattagtagaaatatactttccttaatgaagtcagctttaacagattttttttttaaatctggttttgaagtcataaaatacaaaactatgagcttcttacaaagttattcctgccgtaaatactgtggtaatttatatatttaaaaaattgagaatttttttaaaacaagtgtttccaaaagcttattgatttttaagtaagttttgtatcacatggtaatacgtttcttttatttgtagaaagtagatttttactttttagtgcttgttgactctgtgtgtgtgtgtgtgtgtgtgtgtgtgtgtgtgtctgtgtctgtgtattggtttacatgacggtgaagaactacttatttcttttttggtttgttacatgaagtctttgacattgtttgtttgtttgtgacagggtcttgctcagtcaccgaggctggagtgtagtggctggatcatagctcactgcaatgtccacctcccgagctcaagctatccttccacctcagtctctcaaagtgctggtattacaggcttaagccactgcacctggctgatgtgtcattaagctggatgatgagagaataatataacctgataaaactcatgtagatcttttgagaagagataattttaattgtgaaatagcatctggaaatcagtaaaagacatattttagctaaccagtaatttcataacatctttatctcagtataatttactataatacataaggtttgcccatttaaagtgtatagtttatttatagaattttacaatagcataattttagaactttgttgtcattagcccctctcccccaattccctagccctaggcaaacaccagtccactttctctcccaattcttttttgccaattctggacattttatataaacagaattgtaatgtatgatcttttgtgactgccttcttttacttagcatagtgttttcaagagtcattcatgttatgttgtaatgtgaatcagtacttcatccctttttattgccaaattacatttcattgtatagatactttgtttactcattagttggtagacatttggattttccactctggccattgtgaatagtgctgctatgaacatagtgtttatgtgttagggtaggtgtttcatttctcttggttatatacctaacagtagaattactgggacatacagtaactccatgtttaacatgttgaggaacttctaaacttttttctgaagtagctgcactatttacattcccatgagcagtatatgagggtttcagtttctccacgtcctttccaacatttgtcattttctgtctttttgattatagcctggttgggtgttaaggggtatttattgtgttttttacctatttctaacaactaatggtgttgaacatcttttcatgtgcttattggtcatttatcttttctgatgaaatacctattcaaattctttacccatttataaatttatcactgtacaaatttgttgagttgcaagcattctttttatattctggatattagacctttagcagatttatggacttaccaatattttctcccattctgtagacttttttactttcttgatggtgacctttgatacgcaaaagttttaaattctgatgaactctaacttatcagacttttattctttgcacttttggtgacatatctaagaaatcagtgcataacccagggtcacaaagatttagtgttttcttctgagagatttagttttagtttttatatttagatctgtggttctatttgaggcaattaaaatttttatttttttaattgtgataaaatatacataaaatttatcatcttaaccattgttaagtatatggttcagtggcgttaagtacattcatattgttgtttaaccaatctctatagctttttaaatcttgtaatactgaaactctatatccattaaacaacaactccccattttccccttccccttaggccctagcaaccaccattctactttctgtctctatgaatttggctactctaggtaccttatagtagcagaatcacacagtatatgtctttttgccactggtttatttcattcagtagtatattcttaaaattcacccatgttgtactatatgtcagaatttccttcttttttgagattatgttattccattgtatgtgtatgccacaaacaaaagtttatccattcatctgttgatagacacttgagttgcttctgccatttggctattgtgaatagtgctgctgtgaacatgcttgttataattatctcttcaaggtcctgctttcacttcttttgggtacagacccaaaagtggaattcctggatcatacagtcattctacttttaagtttttgaggaagctccgtactgttttccataagggctacactgtttacattcccaccagcagtattcgagggtactgatttctccacatccttgccaatacttgttattttctgtttttttttgtttgtttttttccttcttaataatggctattctaacaggtctgaattgatgtctcattgtggtggtgattttcatttcccttatgattagtaatattgagcttcttttcatttttggttggccagttgtataccttctctggagaaatgtctattatttttgcctatctttgaatcaggttttgttgttgttgttcttgagttgtaagtgtcctttatatgttctggatattaaccttgcatcagatacagtgagtctttgcctcacatctttgttaagttcttggaaactgacccgtaagtgaagtgacgtatagcatagcaaaacaaactgatataagttaattgataaaacaagagttaagttcctatggtattcagtacattgtttcacttaaaggtgcaatttctaagtacctattgatgatgttaagtgaagacttattgtacatgatttgcaaatattttctcccattttctaggttaccttttcactctgttgatggtgtcctttggtgaacagaagttttaaattttgatttagtccaatttatcaacttttacttttgttgcctttctcctttgagtcagtttttatgtatggcatgcaaattcgtctttgcatatagatattgagttgtttcagcactgttgaaaagactcttctttccctgttgaattttcatgacctctttgctgaaaatcaatttaccataaatgttagtgtttatttctggactgtcggttctatgccattgatctacatgactgtccttatgccagcactgtgctgtcttgattattgtagctttggagtaagttttgacatcggaaagagtgagtcctccaacgatgtttgtcattttcaagattattttggctgttctgggtttatgatctgcttgtcaattactgaaaaaaaaaaggctaggcttttaataagagttgcattgaatctctagattactatgggaaatattaccacttgaatctctagattagtttaggaagtattaatctttcagtccataaacatgagccagttttctagttattttgattttcttccatttcattctatgttttttagtatactagacatatatttattttgctaaatatattctcaagtatttaattctttttcttgctgttgtaaattgaattttttttaaaaatttatttttggattgtgaattgctagtgtattaaaatacagttgatttttgtatattgcactggcatcctgcagctttgctgaacttattagtcttaattggtttgtcctggtttccttgggatttcctgtatgaagttcatgtcatctgcaaatagatatagttgtacttctttctttccaatctagatgtctttaatttcttacctggttgccctggcaatatgtaacatccaatatgatactgaatagaagaggtaagaatggccatacttgtcttgttcttgattgtagggagaaagcatctagcttttcattattcggtattatgttagcgctgagtctttcataggtactcttcatctggttaaagaaatcccttccattcctagtttgctgagaaattttatcacaaaaacgtattgggttttgttgaactgaacagtagcttttaagagcctgttacatatctaatgacatgtggttggtttgttgtaaaattacttggaaatggttatgtgaaaatactgaaatttacttggcaaatactaaagctacaagaatttttaaaatggaaaggttattatgaaagcttgaaagatgcaatgggaggaggtagagcatgaagtgttaaaaaatttgtaagatataattgttggaaaggaagaagagaaatatattttgggatgagtataaatctactcatgcatacttttaagaggctggaataggtttatgtttctcaaattcggatatttgcttcccactgatatgtcaggaggtatcaaggcaataagaagccacagaataaaaacaacattttttttgcccaaataaaatttttacatctatttttatcagctaatgacagaatatttttatttatttagtaatttattcgtttatttatttatttatttatttattttactttaagttccaggatacatatgcagaacgtgcaggtttgttacacaggtatacatgtgccatggtggtttgctgcacctatcaacccatcatttaggttttaagccctgcatacgttaggtatttgtcctaatgctctccctccccttgcccctgaccccaccgacaggccccggtgtgtgatgttcccctccctgtgtccatgtgttctcattgttcaactcccatttatgagtgagaacacgtggtgtttggttttctgttcctgtgttagtttgctgagaatgatggcttccggcttcatccatgtcccagcaaaggacatggtcttattcttttttatggctgcatagtattccatggtatatatgtgccacattttctttatccagtctatcattgatgggcaaaaagtggcatttttaaagtgttagttttgtccagtggtatttaattttttttaagtcaacattttgttttgaaataattgtagtttcacatgtgataaataatatagagatatcacatatacccttcacccaatttccccaagtggtaacatcttgcataactgtggtgatatatcacaaccacaacgttgatattgatacagccaagatactgaacatttacatcactacaaaggtgcctcatgataccttataatagctacttccacttctctcctgccccaccttttactgagctcctggcaaccactaatttgttcctttgtttctataactttgtaatttcaagaatgtcatataaatgataacatatagtatgcaaccttattgtattggcctttttttcactcagcatacttatctggagattcatccagactgttttatgtatcagtagtttttcttttttattgatgtatagtattccaaagtatgaatgcaccacagtttaaatattcactattgaaggacatcttggttgtttcccagtttttggctttaccagtacagctgctgtaaacattcatatgcaagtttttgtgtgaatatgtctttgtttctgtggggtagatgcccaggattgcaattgctgggtcatatggtagttgcatgtttagttttttgaaagacaggccacacctttttccagggtggttatatcatttacattcccaccagcagtgtgtgagtaatccgtctactccatatcctcaccagcatttgatactgtcactatttttattctagtcattctaataggtatgtagtggtatcttattaagtttttaatgtgtatttccctaatggtttttgatgttgcacattttttaatatttctgtttccagtctctttctcctgttaagtgaaatgtctgtatcttttgcccattttctttttttatttttatttttatttatttatttttattattatactttaagttttagggtacatgtgcacattgtgcaggttagttacatatgtatacatgtgccatgctggtgtgctgcacccactaacttgtcatctagcattaggtatatctcccaatgctatccgtccccactccccccaccccaccacagtccccagagtgtgatattctccttcctgtgtccatgtgatctcattgttcaattcccacctatgagtgagaatatgcggtgtttgctttttgttcttgcgatagtttactgagaatgatgatttccaatttcatccatgtccctacaaaggacatgaactcatcattttttatggctgcatagtattccatggtgtatatgtgccacattttcttaatccagtctataattcttggacatttggattggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacattgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgtccagtgatgatgagcattttttcatgtgttttttgcctgcataaacgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtttcctgttcactctgatggtagtttcttttgctgtgcagaagctctttagtttaattagatcccatttgtcaattttgtcttttgttgccattgcttttggtgttttagacatgaagtccttgcccacacctatgtcctgaatggtaatgcctaggttttcttctagggtttttatggttttcagtctaacatgtaagtctttaatccatcttgaattaatttttgtatacggtgtaaggaagggatccagtttcagctttctacatatggctagccagttttcccagcaccatttattaaacagggaatcctttccccattgcttgtttttctcaggtttgtcaaagatcagatagttgtagatatgctgcattatttctgagggctctgttctgttccattgatctatatctctgttttggtaccagtaccatgctgttttggttactgtagccttgtagtatagtttgaagtcaggtagcgtgatgcctccaggtttgttcttttggcttaggattgacttggcgatgcaggctcttttttggttccatatgaactttaaagtagttttttccaattctgtgaagaaaggcattggtagcttgatggggatggcattgaatctgtaagttaccttgggccgtatggccattttcacgatattgattcttcctacccatgagcatggaatgttcttccatttgtttgtatcctcttttatttccttgagtagtggtttgtagatctccttgaagaggtccttcacatcccttgtaagttggattcctaggtattttattctctttgaagcaattgtgaatgggagttcactcatgatttggctctctgtttgtctgttgttggtgtataaggatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaatagcttttatttccttctcctgcctaattgccctggccagaacttccaacaccatgttgaataggagtggtgagagagggcatccctgtcttgtgccggttttcaaagggaatgcttccagtttttgggcattcagtatgatattggctgtgggtttgtcatagataactcttattattttgaaatacgtcccatcaatacctaatctattgagagtttttagcatgaagtgttgttgaattttgtcaaaggctttttctgcatctattgagaaaatcatgtggtttttgtctttggctctgtttatatgctggattacatttattgatttgcatatattgaaccagccttgcatcccagggatgaagcccacttgatcatggtggataagcttttcggtgtgctgctggattcagtttgccagtattttattgaggatttttgcatcaatgttcatcaaggatattggtctaaaattctctttttttgttgtgtctctgcctggctttggtatcagaatgatgctggcctcataaaaagagttagggaggattccctctttttccattgattggaatagtttcagaaggaatggtaccagttccttcttgtacctctggtagaattcggctgttaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcatttttaattgtgtctatttgattcttctctctttttttctttattagtcttgctagcagtcttttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttgtgccttcatttcgttatgtacccagtagtcattcaggaggaggttgttcagtttccatgtagttgagcggttttgagtgagattcttaatcttgagttctagtttgattgcactgtggtctgagagatagtttgttataatttctgttcttttacatttgttgaggagagctttagttccaagtatgtggtcaattttggaataggtgtggtgtggtgctgaaaaaaatgtatattctgttgatttggggtggagagttctgtagatgtctattaggtccacttggtgcagagctgagttcagttcctgggtatccttgttgactttctgtctcgttgatctgtctaatgttgacagtggggtgttaaagtctcccatgattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctttgccttttaattggagcatttagtccatttatatttaaagttaatattgttatgtgtgaatttgatcctgtcattatgatgttagctggttattttgctcattagttgatgcagtttcttcctagtcttgatggtctttacattttggcatgattttgcagcggctggtactggttgttcctttccatgtttagtgcttccttcaggagctcttttagggcaggcctagtggtgacaaaatctctcagcatttgcttgtctgtaaaggattttatttctccttcacttatgaagcttagtttcgctggatatgaaattctgggttgaaaattcttttctttaagaatgttgaatattggcccccactctcttctggcttatagggtttctgccgagagatccgctgttagtctgatgggcttccctttgtgggtaatccgacctttctctctggctgtccttaacattttttccttcatttcaactttggtgaatctgacaattaatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttgttcttttcacatagtcccatatttcttggaggctttgctcatttctttttattcctttttctctaaacttcccttctcgcttcatttcattcatttcttcttccatcgctgataccctttcttccagttgatggcatcggctcttgaggcttctgcattcttcacatagttctcgagccttgtttttcagctccatcagctcctttaagcacttctctgtattggttattctagttacacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgtgttcctttggaggaggagaggtgctctgctttttagagtttccagtttttctgctctgttttttccccatctttgtggttttatctacttttggtctttgatgatggtgatgtacagatgggtttttggtgtggatgtcctttctatttgttaattttccttctaacagacaggaccctccgctgcaggtctgttggaataccctgccgtgtgaggtgtcagtgtgcccctgctgggaggtgcctccctgttaggctgctcaggggtcaggggtcagggacccacttgaggaggcagtctgcccgttctcagatctccagctgtgtgctgggagaaccactgctctcttcaaagctgtcagacagggacatttaagtctgcagaggttagtgctgctttttgtttgtctgtgcccttcctccagagatggagcctacagaggcaggcaggcctccttgagctgtggtgggctccacccagttcgagcttccaggctgctttgtttacctaagcaagcctgggcaatggcgggcgcccctcccccagcctcgctgccaccttgcagtttgatctcagactgctgtgctagcaatcagcgagactccgtgggcctaggacgctcggagccaggtgcggggtataatctcgtggtgcgccgttttttaagccggttggaaaagcgcagtattcgggtgggaatgacccgattctccaggtgcgtccgtcacccctttctttgactaggaaagggaactccctgaccccttgcgcttcccaagtgaggcaatgccttgccctgcttcgtctcgcacacggtgcgcgcacccactgacctgcgcccactgtctggcactccctagttagatgaacccagtacctcagatggaagtgcagaaatcaccgtcttctgcgtggctcacgctgggagctgtagaccggagctgttcctattcggccatcttggctcctgtccctcttttgcccattttttaattggattgtcttttttttccctttttactgttgtgaattgtatatatatgttagtatatatgttagatgtaaggctagcagatacaagacctttgttggatatgaggtttgcaaatattttcttgtaacctgtagctgggagagagaggggcattttgttttgctggatagtctaggtaggcttcgctagactttcactgacgccgcaaggaagggatagcactttatcagccagcagagatgaaagtaagtcctgggttcctcacttggcctttgctggtgttggtgtgagtgggtctagttttttctgtgatggttggctggagtagaatggttattatttaaaagttctctcttttgctaggcttcacctctactgggtttttagctagtgagaaaagctcttgttagggttttttgtctgtgtccattgttcctgggtagctgacttcttcagctccaagtctgtatatgcaagagaaaaagaaaacccagtgattgcaccacagcataattcctcaggtccctagatctctagctaatctacgttcttctctacatctttcagattcttcttacatttgttttatatatattttccagtgggctgaattatagttagcaggagaaatagggaaaagtacatctggccaggcgcagtggctcatgcctgtaatcccagcactttggggaggctgaggcaggaggatcccttgaatccaggagttggagaccagcctgggcaacaaagtgagacccagtctctacaaaaataaaaataagaaaattagcccggtgtagtggcatgtgcctgttgtcccagctatccaggaggctgaggtggcaggatcgcctgagcctgggaggtcgtggcttcagtgatagtgccacagcattccagcctgggtgacacagcaagaccctgtcttaaacaaagaagaagagaaaagaaagaaaaatgtcacaggatcctcagggtgtcagtttgcaagctggaaaccactgtggccagcagcaccttctgcctgagtattgttcacactgctgggcacattctccgcacttggcctggcaggctgtgcttggctcgcactactatgctatgtcttacacctgccaagcatgagccaggtgtggagtggtgaggggtgtgtgggcaagcaagtgtggggtctagccactgtacacagccaggcatgctgacggctgtggtagggcaggcagctccagtgctggcactggtgctggcgccacgcaaggctgcagctggaccagatgtactgtgcgtggcttctgctgtgggcacccacatctgggtgagggaaatgtggtggtggcaactggaagcttggaagacaccaggaaccacaaaaccccaaagagggtgtcatagtcctggctcggggaccccctaggtctgggcttcccgaaaggccacagcttgtctcttcttcttgttccctgcaacatggcaggcggggagggggcatgtttcagccctgtttgtgttacagctcttttagtcccaccatttggtggatcctgagctcttgtcctgcatccatgaagaatgaggtatgtggacaactggagggtgagcaagatggagaggagtttcatcgagtggcagaacagttttcaggagacccaaagtgggtagctcctttctgcaggcaggtcatcctgacgactgtccatctgtcagtggagaggagaacctagagtgggtagctcctacctgcatgcaggtcatcccataatctgcatctttcagcagagaagagacccggagtggctagctcctatctgcaggcaggtcattccattgtctctccaagtctggctgagtccagggtttttatgggcttcaaaggggaggagatgcatgccaattggtccatgggcaggcccggaaaaagcactataagttctcctttctgcgaaactggcagcccttcaacccatccctggcttaaaggtggagcttcactggtgacctgcccctttctgcccaggagcctgtctgccatctctgccatctacggtacccatggcacacccaggctgtttatgtcagggggcgcctgcaggcccactctgagctgccctcagccctccctgcccctgcaacctccctcctgtgcttgtgggtgcccagtgtctggaggggcggcagggggctggtgtgacagtgctgtcccaagtgtgcgcacacctggctgggtcgcaacagtgcctggacttggcctcaactttgctgtgtaattggagcgggaaccaggagtggggagaggcctggcagtgggagcaggcacttctgagcctgcaggggcagggggagttcccagatccccgaaagtgcagtggtgcctgggtctacagctgtgactgggcagctgcagctgtgcccaggagggtggggttcctgcccctccaactcagaagggagtggggcttctgcctgttcctggctcccaccacctcagtacagcgagtagccctagctgttccttccccactgcagctggcatcattgcagcagccactccagatgggatgccgctgccatcaaaaatatatctactccatcacctggggagatgcagcataatttaaaatatttttatctgaaatcagatgttgctatatcatcaaatagaatgccaagttataatgactgtataggtaaaatacagaaatctcaaagaaatgttatatttatggtagctttgagtactgatcctatgcgccaggaaacaaggtcttggttttttccccccattgttaggggtaaaatattaggatgtaggtcaagcttctgtaatagccaaacatagagtggctcaaataagatagaattttattttttcacgtcattgttcatgttaggaaagtgagctctgttccttgatgtcatccagggacccaagctggctggacaactaagctgtcttacacatgacttccaaggttgttccatgcattaccattttcaggaggcaagaaaaatagtgatgatagtggtggtgatattgggggaacatgcaggtcaagaacttgattttaaggacaggaagcagaagttgtacttgatgccttcattcatatcccattggtgtcagtctagtaatgtggttacaactagctgcagaagaaacaggaaatgtctcccacttggtggctatgtggccagcaaaaatttgagtaaggcatttctattattaaaagaaaggtgagaatacttactggtggacaatagtaatctttgctgtttactttagtggaaattttttagaagaactctctgagtggtcttaatcattgtgagccattttattctgtagttaactgtcttttttgcttgctgtgctctttgtcctgttatattataaaagaatgacatgaccttcatggtctaatcttagcgtgggtataaaactgatttgtataaaactgatttgtttataactacttggactacttcaaataagaacctgtttgtttgtatcttctagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcggtgagtctcattgtgataacaagcaagctggatggactttgtaataaagggtttcaaatacttaagtagatatcggttcttgggggaaaggccgtgtgatttctctgagtggaggttgtgtctggctaattactagaagtctttcaaggaataaatgtgttaagtaagagagaacatgtgacagtaatgcatttatatttcagagggcttttggcaagacttgacatcaagtgtttttaaaaattgaatgaccttgaaaagaatctttgatcatccaatgatacaattacgaatttatttactgtgttggacatatgctgaagatctcctttggaggttgcacacacatacatgggtgcttggtcactctctctcccgctctccctctctctctctcttctccagctctctggttccatttcatgacttccctcaaatatttagtatttacaaagaaagtggctttacagtggaaaatcctggcagataccagtttagtcaaatgatgaagattagcatcgccagtaaaacatctgtcaacataatgtgctccctgatatgatgccccacctcatagagtattgtaggaaaggaaacccaattcagggataagttcgttagatttatattattcagcccaattttagcacattgccattaattcagttttacttaatgagcctcttatgatatggtgaagcagaactacctgtatgtttagtattttaccttatagttgaagaggcatcgtaccacagtggagagcgctaggcttggaaaggaggaagaaagaaatgtttattcataatctacatgtggtagtagtcatggcaataaggaacttagatatgctatcctacttagttctcatcatgatcctatgaagcaggtgatgatatctctattttcctactgggaaatcttttgtgccaaaagatgttgtttgtgggcaagagaaagagcattcaaatgcattctgtttaatcagagtaaggatttgttcctctacacagtactctgtcctagaatttgaaccctaattccaacacttccaaccatgatgctggacaactgatttaatatccttggcactcatatgtagaaggaaagggttggaatgctgaaaagtcccttatagctctaaaagttagggattgagataatagattggggcaaaaaaacaaggtcaatctctgatttcaatgttaaaaatagtagagtgccatagagatcagtaatgatacctttaaaatttttttctttgagacagagtctcgctctgtcacccaggccagagtacagtgatgtgatcttggttcactgaaacctccgccccctgggttcccgtcccgcctcagccacctgaatagctgggaccacaggcgtgcaccaccatgcctggctaatttttgtatttttagtagagacgaggttttgccatgttggcaaggctggtcagtattgatacttaaaaaaaaaaaaaaaagtttagaaattaaaacattgacaatttcatatacaatttttaaactcttcaaaggttaaatgctaaggtattgtactgaataccttaaaaatgagataaagctatgaatgagaagaaagtaatagatgattatatatatgaactaacaataatgccatttgttcagggtgtacgtttgtagtggatgcttatattatacttagtgtaataatcagaaatagatattattacctcagttgtggatttaaaaaacctgagacttagagaaaatattttgcccaagatcacatggccattgagcattggaggtggcatttgaacctaggtttatcaaactccacagtccataaataaggcaaactacacacacacacacacacacacacacacacagatgcataaaacatatatatataagtaaatatatatataataccttataaaatatttataaagggctgggtgcggtggctcacacctgtaatcccagcactttgggaggccaaggtgggcggatcacctgaggttgagaatttgagaccagcatgatcaacatggagaagccccatctctactaaaaatacaaaattagctgggcatggtggcacatgcttgtaatcccagctactcaggaggctaaggcaggagaatcgcttgaacctgggaggcggaggctgcagtgagccaagattgcaccactgcactccagcctggcaacaaagcgagactctgcctcaaaaaaaaaatttataaagtatgtatgtataaaatatttataaagtatatgtgtataaaatatattcaaactttttcattttgagataattttagacttaggagttgcagaaatagcacagagagtttctgtattatctattgctgtgtatcatgttaccctgaaatatagcaacttaataaacgtgaaaatttatgtaggtcagaaatctaaatgtagcttatttgggtacttctggcttaggttgtctcagaacgttgcaaacaaggtattggctgcaaatgtggtctcatcacagggcttgcctgagaggatatgcttccagcctcactcacatggccatggctttggccagagacatgggctttttgattctataaggcactcataatatgacacctaagcttcccttagtgaggcagtgagagggcaagagagggtgcccaaaacaaaagccacagtctttttgtaacctacccttggatgtgtcatctcgtcacctctgccacattctcttcagtagaaatgagtcactgtctaaagctctcacccaagggttgggaattccacaaggtcctgaataccaggaggtagatgtcattgggggatatgttagaggttgtccatgtaacctttactgaagcttccatttatgttaacatcttaccgtaacatcataaccataaaatatttatcaaaataagaaattattattggtgtaaaactatatagtctaacattgatttcaccaggtttttccacaaatgaaccttttttgtttcagatccaacccaggattccgtcttgcattttagttgtcatgtcttagactcctccaatctatgacagtttcccagtctttttttgtctttcatgaccttgacgctttgaagagtgctaatcagttattttgaagaagcttcttcaatttagcattgtttgatggttcaaggttagattagggttatgcattctcaacacgtcacaacagagagcacattatgttgatatacattactggtgatgttaaccttgatcacttggctaaagtggtatctgctaggattctccactgtaaggttattgtttttcctttggagatactaaacatttgagggagattttgttagactatacaaataacctgtttctgcttaaactttgactactaattttagcattcatgagtggatcttggctgtagcagttattactctggtgttttaatttttttatgtctgtcatctcttttacatttgttaattggaattcttctgtaaggagaattgttcttccctcatttattccgccctaggttatttatttacattactgtagactcattagtgtttatttcattatttggattataatccaatgctaccattactgttttgttgctcaagttctctttttagctctttagagcacttttaggttggctcctgtaccctgccccagagctggaatcaactgtttcattaaaaatccctctttttattgttgttgttgttgttgttttctttctttttgagccggagtcttgctctgtcacccaggctggagtgcagtggcgtgatcttggctcactgcaacctccacctcccgggttcaagcaattcacctgcctcagcctccagagtagctgggattacaggtctgcaccaccaagcccagctaattttctgtatttttagtagagacagggtttcaccatgttggccaggctggtcttgaactcctgacctcaggtgatctgcccacctcggcctcccaaaatgctgtgattacagacgtgagccaccatgcccagccaaaaaaccctcttatttttgaagggaggaaggagtacagtatttagaaagcaagatgtaaggacctggcatgctcattgctggtgggatgttgctgtgtctagcctttctcagtgaataaagctaagaaatataggtagatttgtaaatttatgtgtatactcatatctgtatcttttaacgtgtgtgtgtgttttaaatcatgtgtccatattgatacctctgactctagtacagatccacaaggttgattctagcctttcccctttctttatttgtaacttctgtctctaatagcgataaaactggctctcattatctgtaatatatttaccctaatatataaatagtttcagaattcatagcccctacccacatgaaaaacaaattctgcatctagagtacagtgtttatctgcagtttcgaagttatcattaaaatatctagacaaaaatgctgtttgctaaagtttcttaagtcagcatctcccttccccatattcttcagtatgagtacgtgattcatttataatatagattcattagtcacattctgcattccatctttgcctcatatcctggttcacctttgaaaatttccgtacttataaatttcactttctgtgctttacaattctatccattgctacagtttcatatgagcagttccatcaatccccaaattcccctatgccgttcctttggagacagtctttcctctgatccctcacccctggcagtccctggtctgtattcttccttagagttttgcctttctagagtgtcacacaaatggaatcataaaatatgtaacagccttttgggtctgaattttttactttgcaaaatgcatttgacacatccatcttgtgtggatcagtagtgcttttttattgctttattaaatgcagtaatattttattgtaattgagtttgtttatccattcactcactgaaggatatttgagttgtttctagtttgggaccattaaaattagaactgctgtaaacatttatatacaggtttttgtttctctacagtaaatactaagaaagaggattcctgagttatatggtacaggtgtatatttaactttgtaagaattattcagagctaaactaatactggtttttcagagtgtctgtatcattttgcattcctgctagcaatgggtgagcattctagttactccacatcctcaccgatgtgtaaattgtcaatatattttagccatttttatagttgtacagtggtatctcaacatagttttaatttgcatgtccttccttaatggctaattattatgaacaccgtttcaagagcttatttgccatcctcttcggtgaagtgctttttaaatagggttgtttgctttcttattggtgagttttgagagttcttaatatattctggatacgagtcttttctggatatgttatttgcaaatatctcttcacagtatgcgacttgtcttcttatcctcttaaaaaaggctttcaaaaaacaaaggtgtttccttttgatcaagtccaattaattgatttttaaatggatcgtgtgattgggttggcaatactttcctttcagcacttaaaaaatatgctccttccttctggattccatggtttctggcaaaaaattcatagtcatttgagtcattgttttctatgtaagaacaatgtgttatttttctctgattattttaatttttttccagcacattgattatgcttctagatatgggtttcttcttttttttaatttttaaattttcatttcagtagtttttgggataaaggttgttttggttacatggataagttctttagtggtgatttctgagattttagtgcacccatcacccgagtagtatgcacaccatacccaatatgtagtttttttaagcccataggtttacaggcatacctcagatatattgcaggttcagttccagaccactgcaataaagccggtcacctaaattttttggcttcccagtgcatgtacaagttatgttaacactatactgtactctatgaagtgtataatagcgttatgtctaaaaaaatgtacctaccttaatttaaaaattgtcgttggttgatgggcacttaggtttttatgagttacttcacttagaataatggcctccagctccatcaaagttactgcaaaagacattatttcattcctttttatggctgagtagtattccgtggtgtatatataccacattttctttatctactcattggttgatgggcatttaggtttttatgtctttgcagttgcaaattgtgctgctgtacaagtgtgtgcacgtgtctttttaatgtcttctttttctaggtatagatttctttggtacatcttgtttggggtttgctgagtttttttaagcctataggtttacaggcatacctcagatatattgcaggttcagttccagaccactgcaataaagccgatcacatgaattttttggtttcccagtgataatacaagtgatgtttacactatactgtactctattaagtgtataatagtgtcatgtctaaaaaaagtacataccttaatttaaaaattctttattgtttaaaaatgctaacaattatttgaaccttcagtgagttactttttgctggtggcagtcttaccttgatgttggtggctgctaactgctctgggtggtgattgctaaagattgaggtggctgtagaaatttctttttttttttctttttaattttcattggtacatagtaggtgtatatgtttatgggtacatgagatgtttgatacaagcatgcagtgtgaaataaggacattgtgaagaatggggtacatcccttcaagcatttttatccattgagttgcaaacaatgcaattacactaagttattttaaaatgtacagtcattatttactatagtcacccttttgtgttacatagtaggtcttattcattctttctattttgtgtgtgtgtgtgtgtgtgcccattaaccatccccatctctccccaaacccctcactacctttctcagcctctggtaaccatccttctactctctatgtccatgagttcaattgtttggatttttagattccacaaataagtgacaacatgcagtgtttgtctttttatgcctggtttatttcatttaacgtaatgatctctagttccatccatattgttgtaaatgactggatctcatcattttctatgtctgaatagtactccactgtgtatatgtaccacattttcttacccatctattgatggacacataggctgcttccgaatcttagcttaccacaaacactgctgcaacaaacatgggattgcattgaaactgtagattgcttttgagtaacaaaatcagtcttccatatactgatttcctttcttttgggtatatactcagcagtgggattgctggatcatattgtagctcagtttttagtttttttaaggaacctccaaactattctccttagcaattgcactaatttacattccaagcaatagtatacaagggttcccttttctccacgtcttcaccagcatttgttattgcctgtcttttccatataagccattttaactggggtgagatgatatctcattgtagtttttagttttagtgttttgattggattattagattttttcctatggaattgtttgagctctttatgtattctggttattaatcccttgtgagatgggtagtttgcagatattctcttccattctgtaggttgtcttcttcactttattgattgtaccctttgctgtaaagaagctttttaatttgatgtgatcccatttgtccattttcgctttggttacctgtgcttgtggggtattgctcaagaaatttttgcccagaccaatatcctaaagattttccctcatgtttttctgtagtagtttcatgatttgaggtcttaggtttaagtttttaatccattttgatttgatttttgtatatggcgaaagatatagagttctagcttcattcttctgcatgtaagtatccagttttcatttatttctgctgttttatagtttttgtcagggaattctgatatctcttttatcctagccttggtgtctgttcccatgtgatttagtttttatatttgtctcttcaaaatctcatattgaaatttgatccccagcattagaggtgggacctaaagagagatgtttgggttatgggggcagatccctcatgaatggctcagtgacctccctgtggtaatgagtgagttctggctcgtagttcacccaagagctggttgtttaaaaaagaatgactcccctcctccccaccttccacttcttttctcttcccgtgtgatgtgggctctccccttacacttctgctgtgattggaagcttcctgagttcctcaccagaagcagatgctggtcccatgcttcttacacagcctgcagaactgtgagccaaacaaacctttttacttggtaaattacccagcctcaagtattccttaatagcagtgcaaacagactaagacaccatttgagctgagatttttctggttctaaatatgatgaataattttggattgtatttcataatgacgtgttatgaaatgacaagtcttgtttaaatgccatagagaatgttgatgtttttgttttagcagacaatgacccaactagtttcaggttaaaaattccagccagccttctgtaggttgttgttccaagtccattcagttttcaaagattttgcagtgctgttcacatctgttgtctgtgtgtgtgcctagtggcccttttctaggtacttttatcccttttctatgtactttctgtgactacattgtgtcagggctgagtggcacaggacagaaggagaaaaagccaaccaggagtggtcactcttgagaccacatttcctttggtgtaagttgaaggtttcccttcttcagaactttaggctcctgccagcctctgttactgcttgtaccattgccaccatgagattactgggatgctatgactaatatacagagataaggaaaaaggggattccacactctatatagagtgttgggagacccttctttcattcctgaagcctgaactagaaggcttcgctgtgaagtctttctctctatgctaatatccacttttaggtttcaggctatattgagttcaggccaaggaatgacagaggaaacaaaaatgatggcaaactcattaccattttgatgatatttcagattttatgatcttcaatctgcctgcttctgttattttccacagtcttccaatagctgctccatgtagtctatctaggttttatagctcatctcatctaggattagatacgctaacctggaactggaaccacttctactgttttttgttcccattaactgcatatgtgagtttcagttattccacatccttgccaacactgggtattaacagttatttttaatttcactcattctaaatgtgagtatgaaacagtatggtattgtaattttaatttgtatttccatgatgactaatgatgctgagcatcttttctgtgtctcttgcccatttgcatgattttatttatgaagtatctgttcacttttatccattggattatttgtctcagtattataggaatttttataatatattccagatacaaatcctctgtgtattgtgaatattttctcatagtctgtggtgtgatttttgttttcttaatggtgtctctggggaacagaaagctttaattttgatgaattccactttggtaatttttttttaatgattagtacttttttgtgtcctgattaagaaatgttgcctaatcaagtgttgtaaaagttttctcctgtattttcatgtagaaatgttatggtcttaactttgtgatcaagtctgtgatctgtttccaaattctcctttgtggtgtaagttatgcagttgaggatcattttctttcctaggaatattctagcaccacttttcaaaaatgattatttccttattgaagttagttggaaccttggtcaaaattagttggccttatatgtgtaagttttagagtttctactctgtttctttgttctttttatttatctttacaccagtaccacaatgtcttgattactgtagctttatagtaagtcttgaaatcaggttatgtcctccaaccttgtttttgttttcaaaattatttttgctatttcaagtcctttgcattttcatacaaattttagaataagcatactgggatttttttggggattgtatggaatctgtagatcaattttgtagattgacatttgaattttcagtcttcctatgcatgaacatggtgagatttttcttccccacttatttaagtcatctttaatgtcccccggtgacatattgtaattttcgttgtgtagattttacacatctactaaatatattcctaagtagttaatatactatggtatatggcattttaaaatttaagttttctcattgttcattgcttatatatagaaatactgttgtcatgccaatttgtaggtcccaacaagttaattttaattttaatttattattctttgggtcagagctttcatgcctactgtgggatgttttagggcaatgagtgctgtagagaatttatacaaggcaaaagttccagtggttgacatatatctatttgttctctgttttatgttcagtaactcctctaagatttcaagagtttcttctttaaatttactgggatcctcaggtataaagtctattcttcatacataatcatttcaccagagaacagagcagttttactccttcctttgcagttctcatgccttttatttctttttcttgcttaatgcactggctagaacattgaatatgataccaaaacaagtagtaaaagcagacatcttgccctgttccctattcctggagggcaggagagtagagtagtgttttgtcattaagtttaatattacctgtagatttttaatgggtgccttttatcagcttgaggatgttttctaagtgagttttatcatgaatgggtgtttaatttttcagatgtttttcctgatctatggatatgatcatacatgttttctccttttttctactgatgtagtgaattacattggtccagttgatcaactgtattgttgaaattgtcatctttactgaatttttatctgcttgtttaatcagcatttgaaaacagcatacatctccagttatgtttgtgtgttttctgtttctcctttagatcttctttggagtattttgtggggaggggaacaataacaaagttatagaaaaggtaaatatggcacaaggaacttctctttctccttagttatttgggaatacgttgttgacctgctgcacaatcactttcgtgtaatatagtctcatttcctataaaaggacattctcctataggaccacaataaaaccatgagaattaggaaattcatactagtgcattacagacattatttagatttctccagttctcccagtaatgtctttttttttatttttatttttttataacactttaagttttagggtacatgtgcacaatgtgcaggttagttacatgtgtatacatgtgccatgctggtgtgctgcacccattaactcgtcatttagcattaggtatatctcctaatgctatccctcccccctcccccaaccccacaacagtccccagagtgtgatgttccccttcctgtgtccatgtgttctcattgttcaattcccacctatgagtgagaatatgcagtgtttggttttttgttcttgctatagtttactgagaatgatgatttccaattttatccatgtccctacaaaggacatgaactcatcattttttatggctgcatagtattccatggtgtatatgtggcacattttcttaatccagtctatcgttgttggacatttgggttggttccaagtctttgctgttgtgaatagtgccgcaataaacatacgtgtgcatgtgtctttatagtagaatgatttataatcctttgggtatatagccagtaatgggatggctgggtcaaatggtatttctagttctagatccctgaggaatcgccacactgacttccacaatggttgaactagtttacagtcccaccaacagtgtaaaagtgttcctatttttccatgtcctctttatcactttaaaactcaataaagttgtggctgttaggtgcctttatcattttaaaactcaataaggttgtggctgttaggtaccttttcatcccacagtaggcatgaaagctcttaggcaccttaataccccaaacaagatactcttttcccttttgtaattaagtgttttatggaaggtatgtttaaattatgtaaacatcttattcatcagcaaacttacttattaatttgtatctgtacagaatcttccttattttattcagtgagttatgatcaatttctaccttttttctttttaacttgttatttgaaaatacatatagactcacaagaaaaatatgtgactcacaagaggttacaaaaatagccaagggaggtccccactcagcttccccattgataatgtccttacataactataatgcattatcaaaaccagtaaattgatattggcacaatacagtcaagtggactacagacgctaatcagatttcacaagtttttgcatgcactcagttattctaatgcatatatgtgtaattctgtaaaatttaaacacatgtatagctttatgtaaccgccatcataatcaagatacagaagtgctctgtcactgtgaaggaattcccttgtgccttcccttttctagtcacaccctgttccctcaagccagccttctttaacccctgaaagccagtgatctgtttttctactgtataattttgtcattttgagaagttatatagatggaatccaacatgttacatagatggaacataacatgtaaactttgagatgtgttcttcttactcagcatactcacctggagatccattcaacttgtgtgtatcagtagttaatttctttgtattggtcagcattccattatttggaatttatacagtatgtttatccattcacctgttgaaggacattgtttccaatgcttattactaataaagctgttatgaacattcatgtacttttttttttatactttaagttttggaatacatgtgctgaatgttcaggtttgttacataggtatacatgtgccatggtggtttgctgcacccatcaactcgtcatctacattacgtatttctcctaatgttatctctccccttgcttcctaccccacaacaggccccagtgtgtgatgttcccctccctgtgcccatatattctcaactcccacttatgagtgagaacatggagtgtttggttttctattcctgtgttagtttgctgagaatgatggtttccagcttcatccatgtccctccaaaggacatgaactcattcttttttatggctgcatagtattccatggtatatatgtgccacattttctttatccagtctaatattgatagggatttgggttggttctaagtctttgttattgtgaataatgctgcagtaaacatacatgtgcatgtgtctttatagtagaatgatttataatcgttggggtatatacccagtaatgggattgctggtcaaatggtattctagttctaaatccttgaggaatcaccacactgtcttccacaatggttgaactaatttacacttccaccaacagcataaaagcattcttgtttctccacatcctctccagcatctgttgtttcccaactttttaatgattgccattctaactggtgtgagatggtatctcagtgtggttttgatttgcatttctctaatgaccagtgatgatgagctttttttcatgtttgttggctgcataaatgtcttcttttgaaaagtgtctgtttatatccttcgcccactttttgatggggttgtttgtttttttcttgtacatttgtttaagttccttgttttcattcttaagtaaattaagtttccttgatttttgttcttttgcatttgctgaggagtgttttacttccagttatgtggatctcagccctttttcagatggatagactgcaaaattttctaccattctggaggttgcctgtttactctaatgatagtttcttttgctgtgcagaagctctttagtttaattagatctaatttgtcaagtttggcttttgttgccattgcttttggtgttttagtcatgaaacctttgcccatgcctatgtcctgaatggtattgcctaggtttttttgtagggtttttatggttttaggtcttacatttaagtctttaatccatcttgagttaatttttgtataaggtgtaaggaagggatccagtttcacttttctgcatatggctagtcagttttcccagcactatttattaaatagggaatcctttctccattgcttttgtcaggtttgtcaaagatcagatggttgtagatgtgtggtgttatttctgaagcccctgctctgttccattggtctatgtatctgttttggtaccagtaccatgctgttttggttcccgtagccttgtagtatagtttgaagtcaggtagcatgatgcctccagctttgttctttttgcttaggattgttgtggctatacgggctcttttttggttccatatgaactttaaagtagttttttctaattctgtgaagaaagtcaatggtagcttgatgaggatagcattgaatctataaattactttggacagtatggccatttcacaatattgattcttcctatccatgagcatggaatgtttttccatttgtttgtgtcctctcttatttccttgagcagtggtttgtaggtctccttgaagacatccttcacatccattgaatgttgtattcctaggtattttattctctttgtagcaattgtgaatgggagtttgctcgtgatttggctctctattattggtgtataagaatgcttgtgatttttgcacattgattttgtatcctgagactttgctgaagttgcctatcagcttaaggagtttttgggctgagatgatggggttctctaaatatacaatcgtgtcatctgcaaacagagataatttgacttcctctcttcctatttgaataccctttatttctttcccttgcccgattgccctggccagaacttccaatactgtgttgaatagcagtggtgagaggccatccttgcattgtgtcggttttcaaagggaatgtttccagcttttgcccattcagtatgatattggctgtgggtttgtcacaaatagctcttatttttttgagacatgttccatcaatacctagtttattgagtgtttttagcatgaaggggtgttgaattttatcgaaggccttttctgcatctattgagataatcatgtggttttttgttattggttctgtttatgtgatggattacatttattgatttgtgtatgttgaaccagccttacatcccagggatgaagctgacttgatcttggtggataagcttttgaatgtgctgctggattaggtttgccagtattttattgaggatttttgcatcgatgtttatcaggtatattggcctgaaattttcttttttgttgtgtctctgccaggttttggtatcatgatgatgctggcctcataaaatgagttagggaggagtccctctttttctattgtttggaatagtttcagaaggaatggtaccagctcctctttgtacctctggtagaattcggctgtgaatccatctggtcctgggcttttcttggttggtaggctattattgcctcaatttcagaacttgtcattggactgttcagggatttgacttcttcctggtttagtcttgggagggtgtatgtgtcgaggaatttatccatttcttctagattttctagtttatttgcgtagaggtgtttgcagtattctctgatggtagtttgtatttctgtgggatcagtggtgatctgccctttatcattttttattgtgtctatttgattcttctctcttttcttctttattagtctggctagtggtctatctattttgttaatcttttcgaaaaaccagctcctgaattcgttgatttttttggaagggtttttcgtgtctctatttccttcagttctgctctgatcttagctatttcttgtcttctgctagcttttgaatttgtttgccctcgcttctctagttcttttaattgtgatgttagggtgtcgattttagatctttcctgctttctcctgtgggcatttagtgctataaatttccctctacacactgctttaaatgtgtcccagagattctggtatgttgtgcctttgttctcattggtttcacagaatttatttcttgctgccttgatttcgttatttagccagtagtcattcaggagcaggttatttagtttccatgtagttgtgcggttttgagttttcttttctcttttcttttctcttttcttttcctttcctttccctttccctttcctttcctttcctttcctttcttttcttttctttccaccctgccctcctttcttcttcttctttttttttttttttttccgagtctcactctgttgcccaggctggagtgcagtggcgcgatctcggcttactgcaagctctgcctcctgggttcacgccattctcctgcctctgcctcccaagtagctgggactacaggtgcctgccaccacgcctggctaatttctttttgtatttttagtagagacagggtttcactgtgttagtcaggatggtctcgatctcctgaccttgtgatccacccgcctcggcctcccaaaatgctggggttacagatgtgagccaccgcacccggctgagtgagtttcttaatcctgagttctaatttgattgcactgtagtctgagggactgtttgttatgattttcattcttctgcattttctgaggagtgttttacttccaattatgtggtcaattttagaataagtgctatgtagtactgaggagaatgtatattctgttgatttggggtgtagagttctgtagatgtctattaggtctgcttggtccagacctgagttcaattcctgaatatccttgagctgagttcaagtcctgaatatccttgttaattttctgtctcgttgatttgtctaatattgacaatggggctttaaagtctcccactattaccgtgtgggagtctaagtctctttgtaggtcgctaagaacttgctttatgaatctgggtgctcttgtattgggtgcatatatatttaggatagttagctcttcttgttgcattgatccgtttaccattatgtaatgctcttctttgtcttttttgatctttgttggtttaaagtctgttttatcagagactaggatttcaacccctgtttttttttgttgttttgttgttgttgttattttttgctttccatttgcttggtagatctccctccatccctttattttgagcctatgtgtgtctttgcacatgagatgcgtctcctgaatacagcacaccaatgggtcttgactctttatccagtttgccagtctgtgcattttaattggggcatttagctcatttacatttaaggttactattgttaggtgtgaatttgatcctgtcattatgatgctagctggttattttgcccattagttgatgtagtttcttcatagtgttgatggtctttacattttattattattattattatttttgcagtgactggtactggtttttccttgccatatttagtgcttcccttcaggaggtcttgtaaggcaggcctggtggtgacaaaatccctcagcatttacctgtctgtaaaggattttatttctccttcacttatgatgcttagtttggcgggatatgaaattctgggttgaaaattcttttctttaagaatgttgaatgttggcccccactctcttctggcttgtagggtttctgccaagagatctgctgttagtctgatgggcttccctttatgggtaacctgacctttgtctctggctgcccttaatattttttccttcatttcaaccttggtgaatctgacgattatgtgttttggggttgctcttcttgaggagtatctttgtggtgttctctgtatttcttgaatttgaatgttggtcagtcttgctaggttggggaagttctcctggataatatcctgcagagtgttttccaacttggttccattctccctgtcactttcaggtacaccaatcaaacgtacgtttagtcttttcacatagtcccatatttcttgtcttcacactttatttcatgaagttgatcttcagtctctgatatcctttcttccacttggtcgattcagctattgatacttatgtatgcttctcgaatttctcatgctgtgtttttcagctccagcaggtcatttatgttcatctctaaactggttattctagttagcaattcctctaaccttttatcaatgttcttagcttccttgcattgggttagaacatgttcctttagctcggagaagtttgttattacccaccttctgaagcctacttctgtcaatttgtcaaacttattctccatccagttttgttgctggtgagagttgtgatcctttggaggagaagaggcattctggttttggaattttcagcctttttgcactggtttttcctcatctttgtggatttatctacctttggtctttgctgttggtgaacttcagatggagtttttgcgtggtcgttctttttgttgatgttgatgcttttgctttctgtttgttagttttccttctaacagtcaggcccctctgctgcaggtctgctggagtttactgggggtccactccagaccctgtttgcctgggtatcaccaatgaaggctgcagaacagcaaagtttgctgccttctcctacctctgaagttttgtcccagaggggcacccgccagatgccagccagggctctcctgtgtgaggtgtctgtcgacccctgctggtaggtgtctccccaccaggaggcacgggggtcagggacccacttgtggaggcattctgtcccttagcagggctcgagggctgtcctgggagatctgctgctctattcagagctggcaggcaggaacgtttaagtctgctgaagctgtgcccacagctgccccttcccccaggtgctctgtcccagggagatgggagttttatctataagcccctgactggggctgctgcctttctttcagagatgccctgcccagagaggaggaatctagagaggcagtctgggcttcacccagttggaaattcccagcggctttgtttacactgtgaggggaaaactgcctactcaagcctcagtaatggtggatgcccctcctctcacaaagcttgaatatcctaggtcgacttcaggctgctctgctggcagtcagaatttcaggccagtcgatcttagcttgctggactccttgggggtgggatccactgagctagaccacttgccttcctggcttcagccccctttccagaggagtgaacggttctgtcttgctggcattccaggcgccactggagtatgaaaagaaaactcctgcaactatctcggtgtctgcccaaatggccgctcagttttgtgcttgaaaccagggccctggtggtataggcacccaagggaatctcctggtctgtgggtttcgaagactgtgggaaaagcctagtatctgggctggaacagtcctcatggcttcccttggttaggggagggagttccccaacccgttgtgcttcccgaatgaggcgacacccccaccctgctgctgctcaccctctgtgggctgcacccactgtctaaccagtctcaatgagatgaactgggtaccttagtcggaaatgcagaaatcacctgccttctgcgttggtcttgctgggagctgcagactggagctgttctatttggccatcttgcccgggaatccctcatgtacttgttattacatgaccataagttttttatttctctatgacagtgggtctcaactaggagtgattttacctctcagggaacatgggaaatgtctgaagacatttttgattgtaatgactaggaaagaaatgctactggtgtctagtaaataaaacatagaggtgctgtggaatatcctagaatgcacaagacagtcctccacaacaaagaattgtttcaaaatgtcagtgctgaggttgagaaactgcactaggattaagacccaggagtgtgattattgagttgtacgtaagtatatgtttaattttataggaaactgccagagtgttttccagagtggttataacattttgcatttccaataacaatgtgtgagagatcaagttcctccacatcctcatcagcatttatactgtcagtattttttatatttttatttttttgagatggagtctcactctgtcacccaggctggagtgcagtagcatgatctcagctcagtagcaggatctcagctcactgcaacctctgcctcccgggttcaagcgattctcctgcctcagcctcccgagtagctgggactacaggtgcgtaccaccacgcctagctaatttttatatttttagtagagatggggtttcaccatattggtgaggctggtcttgaactcctgaccttgtgatctgcccaccttggcctcccaaagtgctgggattacaggcgtaagctaccacgcctgtccactgtcagattttttttttttttaatttagccttcctgattggtatataggggttatctcattattgctttaatttgcatttctctactactgacaatgaacatttttaatatgcccatttactatctatatgttttctattaaaattgttttgctcattttctaattgcattttttttactgttgaatttagagaatctttatatattctggatacaaattctttattagatttcagacttgcaaatttttacattgtacaaaaccaagttttcttattctatttattgttactattgtaatttgttttgatgctcaaaatacagatttggtggccggtggcagccccttcaagctggctctatatcctttttgtatgtccccgtcatcttttgatcatgtctttgctttctggcacaagatatttcaggctcatcttatacttttctttctccagctctggaatcaactacttctccaagaagcctgttcttccagtggaatgtgctatttagaggttaggatttaaacactaggcatatgtgttgctcccagccctacacttatttacattaatatttatttctctatctgtatatattaaaaaccatatgttcatctcattttttacttttttctttgtttttgtaactttcatatctaatagtgagtaacctcacttccagtgtgctttatataacgaattctctcatttcttgccaacctctccccagcaaggatgaccctaacgctccacttggattcaaacactttattgtctgtctccttgggtggatgctcttttcaccctgcttgggctttggcattccatgctagaccactcctcaacatgtatagcacccctccctacttggtctctgacttccctgtgtcagaatgctcatcaccctcaacatatggacactctccccaccccacgtaggttctgactccccatgctgaactaccccctcacatggatttcttcctcatgctgcataggctcatgacacctcacattggtctccctctacttggatgccctcatcttgtttaggatttgactcaagatgtcaggctacgccatttagacagcctcctcactcaggttctgacattcaaggtcagactgactcctgtcaccctgcttgagtagtgactcaccacactgcccttaccctgtatgacacccttctcatcctgcaggaaatctgacttcccagcctaggctatctctctgtgtaggtattttccttctctactgcagctctgccactccatgtaaggccaccccagtgtggagacacctacctcattctgcttgggctctaactccacatgtctggtggacctccctcttcatggaagccctccatatcctgatttggtgcttttattgcacactaagccacacgtctgcagagactgtcttcttgccctgcttgaattctaatactctgtgctaggacacttctttacatgggcaccttccttaccctaatgagattctgataccttgctctggcccgttgtcactccatttgctacagattcccgccttgttctgcctacctaatggttttaagattgtattgtttgggatgggaaagataaaagaaagggagaatagaaacacaggagaggggaaagagaataggaagcttattttttgttactttgtgattaatatatcttttctctccttttactttcaacctatctgtgacctcacagtaaagtgcatcacttgtcaatgtcatatggttgaatgttattcatttttaatcttgtctgttaatctttatcttataactgagatatttagttcatttacatttaatataattattgagctagttgattttgctatcctctattattttagattaattaattatttttattccatgctattttctctattggcttcttttacttttttttcttttagtggttattctagagattataatatacttccttgactttatagtttaccttaaattagtacttttttcgctttatgagcagcaaagtatcttaggacagttgaactctatttactcactcctcctatttgtgcttttgttgtcatatatttctgttctacatgttctgaatcccacaggacattattattgttgctttgaacaaacaacattcttttccatatatatgtatataagaaatataaagcaacgtaaaatatgtatatatacacaagagtgtatgtatgtatatgtacatgtatatatttacatacacacatcctttaagtgttctgcattctttctagcagttctgtactatgttggatcattttccttcagcctaaaaaatttcctttagtatttcctgaagtcttctggggattatcttagtttttatttgtttggtttaagaaatgtatttcagttggttatagaattgtaggtttttatttcagcactttaaagagctactatctttgttgaaaggccaagtgtcgttcttatttttgcacctttgattttcagcagtttggctttgatgccccaagagttggtttttcttagtattactttgtgttcactgagcttcttaactcagtagattaagtcttctacctgttttggaaaattcttacccattaactcataaatattgtttctgcactcttccctcttctcctaggagtaagattacacatgtattggattatatgactgtgccccgtgagtctcttatgctgtcatccgttcgttctttttatgtttggcagttttctgtagactttttgaatttacaaattatttttacacagtgtctatttgcttctactacagttgaatcagattttagataatgtatttttattctgaaatattcatttctttttttaatagattgtagttttctgttgagattttccatattttatctatttccctttatcttttgctctcaatatattaataaccattttgaagtctttttgtgctaactagtagctaaatcccctgtaaatcagtttttcttgtctattttttcctctcaatttttgatcattttttcctgcttcatatgttacataatgttttgtgtgttggatattgtaaataagaggataatagagattgagggtatttgcatctagagggactagaaaaacaagagcaagccaaccccaaagctaacagaagaaaataaataacgaaaattagagctgaactgtatgaaattgagatgcgaaaatccatacaaaagattaactaaaccaaaagttgattcttccaaagaataaacaagattgacagaccactaactaaattgttaaagaaaaaagaagacaaaataagtacaatcagaaatgacaaaggtgacattatcactgactccacagaaatacacacacacacacacacacacacacacacacacacaaactcagagactattatgaacacctattcacacacaaactaggaaacctagaagaaatggataaattcctggaaatatacaatctcccaagattgagccaggaagaaatggaaatcatgaacagaccaataatgagttctgaaattgagtcagtaataaaaaacttcttcacgacaaaagaaaccgtcagcatagtaaatgaacaacgtacagaatgggacaaaatatttgcaaactgtgcatccaacaaaggtctaatatccagaatctgtaaggaacttaagcagttcaacaagcaaagaacaaccctatttaaaaaatgggcaaaggacatgaacagacgcttctcaaaagaagacatacttgcagccaacaaatatatgaaaaaatgttccacattactaatcattcaagaagtgcaaatgaaaaccacaatgagataccatctcatgttagtcagaatgtctattaataaaaagtaaaaaaaataacaggtgttggtgaggttgcagaagaaagggaaggcttgtacactgttggtgggaacataacatagttcagccactggggaaaactgtggagattccttaaagagcttaaaacagaactaccattcaactcagcagtcccattactgggtatatacccaaaacaaaataaatcattctactgaaaaaacacatataatcaatatcatattattgctattcacaatagcaaagacatggaatacaaaaaacaatttttgctttaagcctgacagatctttggtttttcaacaactaaatattgtaagaactcagttgaggctttcaggtgtttgaactcagctctttagactctttgccctcacaactttagaatatggtaaatgttgtaaggggaacaacagtcatgcatttcttgcagttaaactttctcaagggaaattcatttcattagtactcttgcaaataattttactgtttttctgactcagcccctttattggggttggcccttctgacttttgactgagagtctagtgagtctttaattccttacctttaaaagttctctccctcaagcattagttattaagccccctgccttaagcaggtacaacatttggcaaatgttttaaggaggagagctgatgtgtgtttgtcccaggcctctccatctagtgggacttggtttcttatagtgccatgagtatgaatgagatttcagtctattactctgactcagcccccagcctcccataccaccaaaaaaagggaaattgaccttttttttcttttctcataattgtccttttcaattagtgaatggtagacatacggtagagactcaaaagttctacttttgtgatatattctagatattactctaatacaatatgacattattctcttttcttgaaactttattttcaagtgattttttgaaagttttagtctttttttttttttttttcttatagagacaaggtgttgctctgttacccaggctctggagtacagtggtgcagtcacggctcactgctgcctcgaactcttggtctcaagcagtcctcctgcctcagcctcctcagttgctgggactataggcgcatgccactgtgcctattttttttatgttttgtagagacgatcttgctgcattgcccagggtgacctctaactccttggctcaagtgatcctcctgcctcagcctcccaaagaactgggatcacagatgtgaggcactgtgccaggccttattttcaagtaattttagagttacaaaaaagaaacacgtatagtagagttccttataccactcttctagcttctcctgttgttaacatctttttttttcattttatttttatttttatttttttgaagacagagttttgctcttgttgcccaagttggagtgcaatggcgcaatctcggttcattgcaacccctgccccctgggttcaagtgattctcctgcctcagcctcctgagtagctgggattacaggcatgcaccaccacgcctggctaatttttgtattattagtagagatggggtttcaccatgttggccaggctggtctcgaacttttgacctcaggtgatccacccacctcagcctcccaaaatactgggattacaggcgtgagccaccacgcctgacctattttttatttttaaacttttaggttcagggggtacatgttccaatttgttctataggtaaacttgtgtcatgggggtttgttttacagattatgtcatcacccaggtactaagcgtggtacccagtagttttttttttttttctgtttgtctcccctgtccctccaccctcaagtaggccccagtgtctgttgttcccctctttgtgtccatgagttctcatcatttagctcccacttataaatgtgaggatgcagtatttggttttctgttcctgcattagtttgctaaggataatgacctccagctccatccatgttctgcaaaagacatgatcttgttcttttatatggctgcatagtattctatggtgtaagtgtaccacattttctttatccagtctgtcatttatggggcatttaggttgattcatgtctttgttattgtgaatagtactataatgaacatttgtgtgcacgtgtctttatggtagaatgacatatatttctttgggtatgtacacagcaatggattgctgagtcaaatggtgcatctggttttagctctatgaggaattgccacactgctttctacaatggttgaactaatttacactcccacaaacagtgtataaccactcccttttctctgcaaccttgacagcatctgttatattttgacttttttataacagccattctgattgatgtgaaatggtatctcattgtggttttgatttgcatttatgtaatcagtgatattgagcttttttcatatgcgtggtggctgcatatatatcttcttttaaaaagtgtctgtcatgtcctttgcccactaagttccttgtaaatgctggatactagacctttatcagatgcatagtttgcaaatattttcttccattctataggttgtctgtttgctctgttgataatttttcttttgctgtgcagaagctcttatgtttaattagatcccacttgtcagtttttgctttcgttgcaattgcttttggtgtcttcgtcgtgaaattgcctgtttctgtgtctggaatggtattgtctaggttgcatatgtggtatccacatcatcactggtgatgttaactgatcacttggataaggcagtgcttgctaggtgtctccaagatggaaataagttactatttcttccttcttatactctgttttttgaaatccagtcacttagttcagtgcatacacaaaggaggaggggaaggttaagcttaaccttctttggtgggaggtattcacatctgttatctggacttcttcttaaagcaaaatttgcttcttctttccaattatttatgtgttcaattatttacttgctccactctgttttaatattaattccctatgatctcaagatataactgcaaccttgaaaactcctagttctcccagaactccttgacagaatgctctgtttcttgtttatctttgtacactgtgtgtatttagcacagtcccctaatttatggtggacatctagtaatttaaaaaaatgtattttcaattcagctgaaaaatagcatttcctcaactaaattatataatttaacattctaaattaaaagtaggttttaagataaaagtaaacatgtgtgataacattgtatcaaacaaaataaagggtactgctgaaattttaccttaataacgtttgacattgatgtgtccacaatatattcctatagctacttaaatattccttgaaaccacttttggaaagagatttcagtctctaatggccaaggatataatctgctgtattctttctcttttttggtcagattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggtaagagaatgtgattgcattttagattgttagaccagctcttttgtgtagttatcttagaaatttgtggttgtgtctttctagtcagaaaacctaattttaatttaagaattagggtccatatgattatatctgtcttttatttgcatagctgtcaacagaatatgatttattatattttatcttaatttcaagcacagttaacatgtagaactcatgctgtttgtgttaaaacttagttttgtctcatcatatttgcaataaaaatgcaagtagttcataacaacttgaaagtaattgaggtctgcttttaaaatggcggataaattatcttgtattacagtaacagtaatgttattactatatagtgcgtatatagggagagtatgtatatactaaatactataacaaatagatgcataaacatgtgatagtgcaaacacaatagcagtttatctcttacttataaagcaatcaccagagacccaggttgtcttcttgctctgttttctttaaaatatataacccaaggttatgttggatttaccttcatggtcaacaggaaggaacaaaaagcattgaggagcacatataggagatgtttacaggtcaggtctggaagtaacccaaatcactttccactggccaggaatgtagtttagctgtgttttccaaaatgaagaagaaatggattttggtgaataggtagcagtctctaccataaggtgaacatttagagtgttttatatgctatagtttcagtgatattttgatagtacttttaccatgtaacatttagaattagaccaaattgtaaattattttctttttttgagtaagtagcaggaaaattaacaattaagtttccattcttccccaaatgaagatggagactttactaatttttaaaatatttactattttggacaagtctactcaaagtacatcttaagtttctctacttatacaaaaaacttgtccacctacacacgtagatggaatatacctaaatgtaaagaaaattgtttagttcagcatttaaattgcattgaatttaagtaagtgcatttatatactaagatggttataattcttgaacatttttcttgtgaaattaaagcataccaaaaatatatatatagtttaataaattatcacgaagaacacctttatgtgttggttacctgttgttacagtggtacagtataacaaacaacctaaaaaatctctatggtttataacagcagacatttgtttttcttactcacaggcttatgggtcaattggactttggctgggctggctgtaagctgcagaaatggtttgggtctgttccagatacttctttctgagactcaggctaatgggtcaatagctatcctagagtgtggtgttctcatggtggtggcagaaacacaagagaggaaacagctataaaagcagtgcgcggtggctcacgcctgtaatcccagcactttgggaggccaaggtgggcagatcacgaggtcaggagatcgagaccgtcctggctaacacaatgaaaccccgtctctactaaaaatacaaaaaaaaaaaaaaaaaaaaatagccggacactgtggcgggtgcctgtagtcccagctacttgggaggctgaggcaggaggatggcatgaacccaggaggcggagcttgcagtgagccgagatcgtgccactgcactccagcctgggcgacacagcgagactccgtttccaaaaacaaaaaaaaagcatattttaaacttctactgtcatcaaacggatcaatttatagaggccatgatttatggttcatataaactttttatcaaagaatcgatattatttggtttagtaataagtgttattttcaacactgtgggtcaaaagtaaaattttatgaggtgtttttttttgtttgtttgttttttgtacaaaacattttaaggtacaaaaaatcgtatgttaactacatgactgcttacccattagtctgaattaacaagttcctctacccctctccagtgcttttttcctttcccggaagcagccattatttgctatgtattcacttcttcccctagacaggcagtccagtgtaaccttaagactactgcatccaaacaaagttcttgagaacttcaaaaaattctttatttgtctcaggtccatcgccatgtgatagtcatttctgctctgggtccattgtaattttgtccaatcgttgctgttaattttctccaacctgtgaactgcatggcatattcagccattgctatcaagcttaatatataccgatggagaaagaaaattaataaatcagtattctaacaataactacgggaacgaccaaatagaattggaggctacagcttttttctttttctttttccttttttcctgatagagtggtacaaatattcctaagttgtctcagactaaggttgaggtcctttttttttttttttttttttgagatggagtctcactctatctccaggttggagtgcagtggtgcaatcttggctcactgcaacctgcatcttccgggttcaaggattctcctgcctcagcctcccaagtagctgggactacaggcgcgcaccaccacgcccaactaatttttgtatttttagtagagatggagtttcaccatgttggccaggatgatctcgatctcttgaccttgtgatccgcccaccttggcctcccaaagtgttgggattacaggcgtgagccactgcgcctggccaaggtcattttttattaatttcttgactggactttctttagaggtcactttgccatgcccagtgatagaaattaatgcctctaggtgttaatcatactccttttaaaaagtaaccttatttcttgtggataattcaggtctatcatagatttagtcagcactctgtaagctgctctatgttttgctttagtgatataaaaaatgttaagtagctaggtggctcctgtccctggtagaattgtccctttcttatttctaagatcttccatctaacaacactcatagtcacaaaggttgaaagcaaaaacttcttaaaaagcttgtttgttcccaaatgcatgcattctatctggtactcggtataggcaagtaccatctatggttcagagcatatcccaaatcccataagaaagcattgtagactcagaaagtggtgttccccagcttatgccataacacttttcagtaaatagcttgctcactttatttatttatttattttttaggtttagcatagttatggtccataaggcatggataaggacagtaaatccctttaggcatcaaccttttgtctcatttccttcatttggaagtgagtttcttccttagaagcaggctactaacaatgtggaattcattgccaaaatgtcatcagaatgatagagttgccaaagatggtgacacagttctaagtaatataaagattattgtttctggccaggcgtggtggctcacacctataatcccagcactttgggaggccgaggagggtggatcacctgaggtcaggagtttgagaccagcctggccaacatagtgaaacctcatctgtactaaaaatacaaaaattagccgggcatgatggcacatgcctgtaatcccagctactcgggaggctgaggcaggagaattgcttgaacccggaaggtggaggttgcagtaagcagagatcgtgccagtgcactccagcctgggcgacagagtgagactccttcccccttccccaccaaaaaaaaaaaaagattattgtttccagaggagagctcattctactccaggactatcagaatcagtctagaggattttgggttttattaactagagatgagcaactaggagtccatctagaaatggttacaggatataagagaaaaccgtggtctataagaataaagataaacggaaggagctggaggcattcggccatgagaaatggtagctacattgaaaattcataatcatatgagcaatacaaccctatgaaatgctcagaaataacctaaacaaaaattttaaatgacctaatgcaggaaacactaatcctttttgtaaagatagaaaataataatttactaaattaaaaggtatgattctagaatggaaggctgaatattgtaaaggtatcatttattcccacataaatttatactctaaagtaattctgcacaaagttctaatggaactgttcttttgaactgtgtaatttatctttatgaatttatttttatttttaatttgtctgggtatatagtagacatagatatttatgaggtacatgagctattttgatataggcatacagtgtataataatcccatcaaggtaaatgggatatccatcacctcaagcatttatccattctttgtgttaacaatccagttacattattttggttattttattttttaagtatttattttttttgagatggagtcttgctctgtcacccaggctggagtacagtggcatgatctcagctcactgcaacctctgcctccttggttcaagcaattctgcctcagcctcctgagtagctgggattacaggcacccgccaccacgcctggctaatttttgtatttttagtagagaaagggtttcaccatgttggccaggctggtctcgaactcctgatctcaagtgatctgcctgcattggcctcccaaagtgctggattacagatgtgagccaccatgcctagctgtcttttggttattttaaaatgtacagtgaattattgactgtagaccctgttgtgctatcaaatactatatcttactgattatatctgactatatttttatacccattaacaatcctcacttcccccacactgctcactacccttcccagtctctggtagccatctttctctctcatgtgtgtccatgaattcagttgttttaatttttagatcccacaaataagtgagaacatgtgaagtttctgttcctatgcctggcttatttcactttatataataacctccagtttcatccatgttgctgcaaatgacaggatctcattattttttttggctaaatagtattccattgtgcatgtactgcctttgtgtatatgtactacattgtgtatatgtaatagattaatttatccattaatctattgatggacacttaggttgcttctaaattttggctatggcgaacagtgttgcaataaacatggggtgcagatttatcgctgacatactgacttactttattttggttatatacctagcagtgggattgctggatcatatgttagctctaattgtagttttttgaggaatctacaaactaactgttctctatagtgttgtactaatttacattcccagcaacagtgtacaagagttcccttttctccacattcttgccaacatttgttgttgtatatcttttgaataaaaccattttaactggggtgagatggtatctcattgtagttttgctttgcatttctctgatgatcactgatgttgagcaccttttcataagcctgtttgccatttatatgtcttcttttgagaaatgtttgttcagatcttttgcccgtttttaaattggattattagattttttttttcctatagagttgtttcagttctttatacattatggctactaatcccttgtcagatggatagtttgcaaatgtttcctcctattcggtggtttgtctcttcagtgttgtttcctttgctgtgtgaaatctttttaacttgatgtgatcacatttgtccatttttgctttggttgcctgtatatgtgggatattactcaagaaatctttgccaatatttaatgtcctagagagttttctcagtgttttcttcctgtagtttcatagcttgaggtcttagatttaagtctttaatccattttgatttgatttctgtatatgatgaaagatagaggtttagctttattcttctgcatgtagataaccagctttcccagcaccatttgttgaagagaccgtctttttcccagtgtatgttcttggcacctttgttgaaaatgagttcactgtaggtgtgtggatttgtttctgggttctctggttctgtttcattggtttatgtgcctgtttttaagccagtaccatgatgttttggttattatagtattgtagtataatttgaagttaggtattgtgattcctccagtttcgttctttatgcttaagatagctttgtctattctgggtcttttgtggttccatataaattttaggattttttctatttctgtgaagaatgtcattagtattttgatagggattgccttgaatacagattcagtggaataccccactgctttaggtagtatggacattttaacaatattgattcttctaattcatgaacatggaatatttttccatttttttgttgtcctcttcaattatcttcatcagtgttttatagtttcctttatagagatctttcacttctttggttaattgctaggtatttgattttatgtgtggctattgtaaatgggattatttttaaatttccttttcacattgttcactgttgacatatagaaatgtgaactgatttttgtatgttcatttttgtattctgcaactttactgaatttattgattgtggaggctctaggtttttacaaatataagattgtatcatttgcaaacaaggataatttgacttcttcctttccaatctggatctcctttctatctttctcttgtctgattgctcgagctaggacttccagtgctatgttgaataacggttttgaaagtaggcattcttgtcatgttccacatcttagaggaaaggctttcagtttcttccccattcagtatgatactagctgtgggtctgtcatatatggcttttattatgttgaggtatgtgttctctatacctagttttttcagggtttttatcacgaagagatgttgaattttaagaaatgttttttcatcgtcaattgaaatgatcatgtggtttttgtcctccattttgttgatgaggcatcacattgattgattagcatatgttaaaccatccttgcatccctgggatgaatacttcttggtcatgatgaatgatctttttaatgtgttgttgaatttggtttgctagtattttgttgaggatttttgcatcaatattcatgagggagattggcctgtagttttcttttcttttttctcttttttttttttggatgtgtctttggtttactggtcttgtagaaggagtttggatgtattctctcctcttccatttcttggaatagtttgagtaggattagtattagttcttctttaactatttggtacaattcggcagttaagccattgagtcctcagcttttctttgctgggagactttttattacaacttttaccttgttgcttgttattggtctctttcaattttggatttcttcctggttgataggttgtatgtttctaggaatttgtccatttttttctagctttttcaatttattggtgtaaagttgctcatagtagtgtctcatcatcctttaaatttctgtgctataggttgtaatgtctcccttcttaatctctgattttatttacatgagtcttctatttttcttagtctggctaaaggtttgtcgattttgtttatcttttcaacaaacaaactttttgtttcattttgcgatgtttttctcatatcaattttatgtatttttgctctgatctttatttctttttttctgctaattatggatttcatttgctcttttctagttcattagcatacgttgttaggttgtttatttgaagtttttctatgtttttttaatgtaggtgcttatacctataaactttcctcttagtactggttttgctgtatcccgtaggttttggtatgttgtgtttccattatcatttgtctcaagaaatttgtaaatttctttcttgatttcttccttgacccactggtcattcagaaacattatttcatttccatgcatttgtatagtttccaaagttcctttcattattgatttctagttttatttcattgtgatcagagaaatgacttgatataattacaattatttttgaatttttgaacacttgttttgtggcctaaaatatgacctgtccttgagaatgatccatgtgctgagaacaatgtgtattctgcagccgttggatgaaatgttctgtaaatatctattaggtccattcaatgtatcttcgttgatttttctgtctggatgatctgtccaatactgaaagcggggtgttgaagtttacagctgttattgtattaggttctatctctctctttagctgtaagaatacttgctttatatatctgggtactccaccgttgggtccatatatatttacagttgttatatcctcttgctgaattgacctctttatcattatataatgacctttgtctgtttttataatttttgtcttaaagtctattttgtctgatatgagtatagctgttcttcctctcttttggtttctatttgcgtgggatatctttttccatcctgttatttttagtctattcatggtctttataggttaattgtgtttcttgtaggaaatagatggttgggtcttgtttttttttgcattcattcaaccactgtatgtctttggataggaggatttagtctactgctttttattttttattttagatttgcccttttgaggctattttctagatcctgtaggcatgctttattcttttttattcctttttttcttttgtcttctctgactgtattttcaaatagcctgtcttcaaactcactgtgtttaatcaattttgctgttaagagagtctgatgcattctttagtgtgtcaggtgtatttttctactccagtatttctgcttctttttaattatttcagtctttttgttaaatttgtcttataggattctgagttctttctctgtgtcatcttgaatttctttgagtttcctcaaagcagttttttttttttttttttttttgagatggactcttgctctgtcgctgaggatggagtacagtggtgcagtctcagctcactgcagcctctgccgcctgggttcaagcaattctcctgcctcaccctcccgagtagctggaactacaggggtgcgccaccacacccagctaatttttgtatttttagtagagacggggtttcaccatgttggccaagctggtcttgaactcccgacctcaggtgatctgcccacctcggcctcccaaagtgttggaattacaggcgtgagccactgcacccagccaaaacagatatttttgaattctttgtctgaaaggttccacatctctgtttctccaggattggtttttagtgtcatatttagttcatttggtgaggtcatgttttcatagatggtctagaagcttgtggatatttgttggtgtctgagcattgaagaattaggtatttattgtagtcttcacagtctgactttgtttatacccatccttcttgggagtgctttcaaggaattcaaagggagttgggtgttatgatctgagtttttggtcactgtagccatatctccattagggggcacttcaagcctagtaacactgtggctcttgcagacttgtagaggtaccaccgtggaggttgtattagtccattttcaaactcctagaagtatgctacctgagactggttaatttataaagaaagggagttcaattgactcagttctgcatggctggggaggcctcaggaaacttacaatcatggcagaaggtgaagggaaagcaaggcacgtcttacatgggggcaggagagagtgagatctcagggataactgccacgttaaaaccatcaagatctcatgagaactccctcactatcacaacaacagcatgagagaaactgcccccatgatccaatcacctcccaccaggtccctccctcaacatgtggggattacaatttgagatgagatttggctagggacacagagccaaaccatattattccactcctggcccctcccaaatttcatgtccttttcacatttaaaaaccaatcatgccttcccaatagtcccccagaatcaactcattctagcattaacccaaaagtccaagtccaaagtctcatgtgagacaaggcaggtaggtcccttctgcctgtgagcctgtaaaataaaaaacaagttagttagttccaagatacagtgggggtacaggcattggataaatgttcccattccaaacgggagaagctggctaaaacaaagggattacaggccccatgcaagttgaaaacctggctgggcagtcattaaatcttaaagctccaaaatttcctttgactccatgtcatacatccagggcatgctgatgcaaggggttggctcccacagccttgggcagctccacccctgaggttttgcagggcacagctcccacagctactgtcatgagctggtgtttagtacctgtggcttttccaggtgcacagtgcaagctgttggtggatctaccattctgaggtctagaggatggtggccctcttctcacagctccactaggcagtgcccaagtagggactattagtgggggctccaactcacattaccagtctgcatttccctagtagaagttctccatgagtgctctgcccctgcagcagacttcttcctggacatctaggcattcatatatcctctgaaatctaggtggaggctcccaaagttcaactcttgtcttctgtgcatctgtaggcccaacaccacgtgaaactgtcaaagcttggggcttgcaccctctgaagcaatgtcctgagctgtccttttagccacaggtggagctggagcagctgggacacagggcaccaagtcccaaggctgtacagagcagctgggccctaggcggggcccacaaaaccatttttccctcctaggcctccaggcctgtgatggaagggactcccgttaagatctctgacatgccctggagacattttccccattgtcttggctattaacatttggctcctcgttacttatgcaaatttctgcagccagcttgaattccttgaatgggtttttcttttctactgcatagtcaggctgcaaatttttcaaatttttatgccctgcttcccttttaaacataagttccaatttcaaaccctctctttgtgaatgtacataactgaatgctttcagaataagccaggtaacctcttgaatgctttgctgtttagaaatttctcctgccagataccctaaatcatctctttcaagttcagatctccagggcaggggaaaattgctgccagtctctttgctaatgcatagcaaaagtgacctttatgccagttcccaacaagtttctcatctccatctgagactacctcaacctggacttcattgtccatatcactgtcagcatttttggtcaaaacctttcagtaagcctctagaatgttccagactttcccacatcttcctgtcttcctctaagccctccagcctgttccaatctctgcctgttacccagttcccaagttgcttccacatgttcaggttatctttatagcagtgccccacttctggcaccaattctttgtattcattttcacactgctttaaagatactacctgagactggtaatttataagtaaaagaggtttaattgactaacagttccacatggttgggggaggcctcaggaaacttacaatcatggcggaaggtgaagggggaagcaagacacatcttacgtggcagcaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccatatcagaagtttctgataagatccagaagaattctctggattaccaggtagagactcttgttcttttcctttactttctcccaaagaaatggagtctgtctctgtgctgagctgcttggagctgctgtgacacaagcacccctgtggccaccaccagtgggactgttctaggttagacctgaagccagcacacactggttctcgcctgaggtctacaggaaccacttgctggatactgcctatgtttgttcaaggccctggggctctacaatcagcaggtggcaaagccagggagtcttgtgtgctttccttcagggtggcgatttccccctggccctaggcaggtccagaattgctgtctgggagccatgacctgaagtcagaaaccttagtgctttattctgctgtggctgaactggcatccatgccacaagacaaaaagttcttattctttcctcttttccacaaacagaggagtcactccccatggccaccactgccccaggcttgtggtgactgctggctgcctaccactgatattcattcaaggcccaagggctctttcgtcaccttgggtgaatgcttctaggcctggaactctcacttcagggcaatggcctcccttctggcccagggcaggtccagaaatgccatccataagccaacacctggaatcaggaactcctggagcttactttgtactctacccctctgtggctgagctggcacttaagctgcaaaacaaagtcctatttaatcttccctctccttttctcaagcaaagggagtctctcctcatagccaccatagctgggaaatgtgctgggtcacacctgaagccagcacatctctgagtctcacccaggtgagtactgcctggctaccactgctcactattcaggacccaagtactctttagtcagcaggtgatgaatcctgccaggactgggtccttccctgcaaggcagcaagttcctttctggcccagggtatgtctagaaatgtccaggaactaggtcatggaatggaggcctcaggactctgcctggcatctctatcattctgtggctgagctagtatccaggttgcaagagaaaggtctgtttaatcttccgtcttccgaagtgaaaggaaggaccctctcctggagcaagctgtgctgtctaggtttgggtatggagtggtgcaagtgcttcccttggccattttggctggtgtcttactaggttgcatacgcccaagtcagctggctctgattccagcacatcaccaagactttcctgggaattgtgtttcttattgctttaggctatggtatatgctattttatcacagaaaccctaaattacaggtaagtagtctagagcagatagctgagttgcatatctggtggctgtggcatccttccatctctggaagtgtgacttccatttctgggtctagagtaactgctacagctatcatgatctgcagtatctaggaagtggggggctttaatgggatacctttactggaatgcctggaagtttcacacattcttgcactcttcccatgggctgaacaaagttacccatatgttcacacatggctgtaagggagattggaagtgtatatagatgtataggtgtaaggaggtagggaagttggacacgaggtcatatttgacagtttctaccaatcatgaaagaaaaactagtatatagaaaaaaaatgtccataatagtaagatgagggcatatttttaaaatgagattccatttacctctattagcaattaatcatttcttaatgactatacacgtgctgttggaggaagagtaaattgtcgcagacatattaataagcaatttagcagtcagtacttttttgaaaacttcatgaatggtgtaatttttcactttgtaaaaagaatttaccttggatgggtgatgggggagaataagtataaacaggaaaatctttattcacagaattctttataattgaacattttaacacaacctgcattttcaacattaggctaagagttgactatatttaatctggtataaccataaaaatgtgaagaataggaagtaaaatgaatatttttattataaataatagaaaagctgaatttcaaattatgcatactatatgcagacaactttgtaaacaaataaaaaacaggaaaagatgggtaagttatacattaaaatgttaacaataattatccttgagtggtaggaccttgtaatttttacgtttatatattttcttaatattgaaaattcatactcttgcagtggaaactatgttttgaagccctgtcacatagatgagaattagacttattttctatgactctggaagcagaataagaccagtataagggcttaattatgaccaggttagggttcgatgtaagataacatgttttttagttagagtcatctatatatggaatggattgctaaaaagtcatctcaatgaaacatatccctaccatcctacttaaactgtttcccctgcatttaaaccccaatttctcctgtattcttaattaccttcagcatttctatattttccctgtatcacttataatgtattaaaatgctagataatttactcatttagtatgttaattatttactgtatattttcctcctctagaattctcattcttcttgaaggcagagatacatttctctttgtttactcataaattccaaaagtcatgaacactgcctgaaacatagaaggcattccatatttgttcaatgaattaacaaatgtttttcatattaattgttctgatttttacctccttaggccagcctttattattgccatataagccttctggtagtaccaagatgtattatgttccacaattaagacaaattcctccatctccggattccaaatcagataccaccgttgaaagctcccattcaggtattatgcagaaattattcgaagttttattgtttgatattttatttgtgtattggctagttgattctggagtgacaaaagtccagtgctctttaatttttcagtgaaatatggaacttttcataccttgatctctggttcagataggtgagttatttgatcagatatatacacataagcatttataaatatttgatgaaggaaattgtatggatcattatttgggttagtgggctccatctagggcaaagtttctaagctttcttggttcacagtacccttagttgtttcactgatttattttctccgctttatatataataagcaattatttttttcaaatagcaactaaggaattagaacataaatactaattgttttcctctgacaactaatttaacaaatttgttatttatttttggttttggtttttgaaaaaaaaatttgttcataaataacaatgatgacttactaatgacatatgtgtagctgttggacactgtgcaacttcccaaaccatgagatgagattggaccctcttattttctgccttttattacagcagctgccaaaaatccagcttttgccaaggcacaacagcattgaaaagaacatagcactatctgatgttgacactttgaccttgagctagtagtttatcactgtcctttccctagaattttaaactatcctgcagcatccctgtgaatccactacagaggaggtgcagagttaggaaatgaataataccccatggaggcactagataaatatttcctatggagattttaagttaagggtgcagagttagtgtggtgtagggttttgattggtgggacagtattttgagttgtcgacgggatatgacttgattcactttagacaaattgttttttccatgattgtctataaatgtcattatatatatagaaattacaaagaaaggagaagttgcccctggtcttaggcagacatttttgttactttgatatgaaagagaaccaaactagcttctgatagtaactgcactaaagcctctgatacaacctcgcctgatttcccacaatgatggcattgaaaaaaaagaaccacaaaaatactcaccacaagttaagattgttaagtttatagccataaatgaagaaatgtttactccttgcaaggctatggttttaaaaacactgttaatggctaccagaaagaaaacaagctcacttaattgattgtaggtaggaaaatcttctgtcccacttactcatagttcagaagacagaatgtctgtaaacagtagaaacctggtcagatgtgccagtactttctgaggcctccagtgtcctgctatcgatatacgtcactaacacttccatctggttggagagattaacttagagaaagactgaacagtgtaggtgatgggagaagaaaatgactcaggactggcacactgtatcctgataaatatagtttctgtaataaagtactgtatgcatcagtacgacaaaaagagatctagttgccatacacacttgagattgttttttcatgttttcatctattctgagagtgaggaagttgggaatagaaaataatcctttcttagaccagtagacctacactggatgaaagcctagaaattgttctaattcctagccgttatctatgaatatgttgtacatctatagctatgagaggagccaattagagtttggggccaagagcaagacatacatcattgttagcaaatatttgggccaaataactgttcttcagttgagaatcagtaaataatagaactgatgcaaacaacgacggcaaaaaactggggcaaaggaaacagccatccaaagaaagagataaatgtctgcaaataaaccagtcttaatagcaacccagggagtatttattcaagaaaaatggccaaatcccactaagcacagtaagcgttagcattttaacttgccctagtcccattcccagtacctcagctcagtgatagccttcagaaatatagctttcttttccaagaccagaggatgcaaaatggagctgggcctcttttaaaagttccttcccaaagaattgttaatatttgacctatctagtggttccgtgaagattccacacaaaaggcttatctttacttgacctgactgggagccatccagtgctaaaggcctctggtgaaggggagggaaagatgtttatcaaaaacatttacagacaagtattttaatatcataatggctgaggtgtggactagcagttgaggtaaacagtaaactaactggaaagcttaaaagtaacacccgaggataagatgttgatagattctttgaaaggcgctgacatattcctaagactctgggagaccccatgtatgcgtaggcctgtgtatgctcaggaaagacccaaggcgctaggtcttatctctggctgaccttgaggatctgtacaagaagaaaagggaaggctaaggtaaagttgacagctgcctaggtcagtgttgaaggtacatcccaacatatgtgtggagccatttgatgaaggccgggagatttattggttctaggcatttaaggaaatccctgttcaggcattagctgaccattaagctaattgagtagtaacttcagtggccatatataaaaagaatatagactttacagaattaattcagagaagttattaaaacaacataaagcaacaacaccaaaccctgagatggaagtagaatctggtttccagagttggcgcattgtattacttaaatgtccaggccgggtgcggtggctcatgcctgtaatgccagcactttgggaggccaagatgggaggattgcctgagccctggagtttgagatcagcctgggcaatgtagtaagaccctgtctctacaaaaaattaaaaatcagccaagcatgatggcctacgcttgtagtcccagctactcggaaggctgaggcatgagtatcacttgaaccctcgagtttaaggctgcagtgaactatgattgcgccactgcagtccactctgggcaacagagtgagaccatgtctcaaagaacaaaaaaacaaaaaaacaaaggcaacaaaagaaaaatatatatgggagactttatcaaaattcaaaacttttgtacacaaaacccagtcaaaagaatgaaaaggtgactcacagcataggagaaaatatttgcaaatcatttatctgttgagagattaatacctaaaatatgtaaggaacccttacaactcaacaacaataacccaaacaatctgattcataaatgggcacagaatctgatggacatttctccaaggaagacgtgcaaatagccaataaacacctgaaaatcttctctatatcattaatcatgagggaaataccaaacaaaaccatagtaagataccacttcacacccattacaatcactgttattttaaaaaataagcggagagagccaagatggccgaataggaagagctccagtctgcagctcccagtgtgagcgatgcagaaaacgaatgatttctgcatttccaactgaggtactgggttcatctcactagggattgtaggacagtgggtgcaggacagtgggtgcagcacaccgagcgtgagccgaagcagggcaaggcatcgcctcacccgggaagcgcaaggggtcatggaattccctttgctagccaaggaaaggagtgacagaaggcacctggaaaatcgggtcactcccaccctaatactgcgcttttccaacgggcttaaaaaatggcacaccaggagattatatcccgcacctggctcggaggatcctacgcccacggagcctcgctcattgctagcacagcagtctgagatcaaactgcaaggcggcagcgaggctgggggatgggcgccctccattgccgaggcttgagtaggtaaacaaagcggccgggaagctcgaactgggtggagcccaccatacctcaaggatgcctgcctgcctctgtagactccacctctgggggcagggcatagccaaacaaaaggcagcagaaacctctgcagacttaaatgtccctgtctgacagctttgaagagagtagtggttctcccagcacacagctggagatctgagaacggacagattacctcctcaagtgggaccctgacccctgagtagcctaactgggaggcaccccccaggaggggcagactgacacttcacacggccgggtacttctctgagacaaaactttcagaggaacgatcaggcggcaacatttgctgttcaccaatattcgctgttctgcagcctctgctgctgatacccaggcaaatagggtctggagtggacctccagcaaactccaacagacctgcagctgagggtcctgactgttactaacaaacagaaaggacatccacaccaaaaccccatctgtacgtcaccatcatcaaagaccaaaggtagataaaaccacagagatggggaaaaaacagagcagaaaaactgaaaattctaaaaatcggagcgcctctcctcctccaaaggaacgtagctcctcaccagcaatggaacaaagctggatggagaatgactttgacgagttgagagaagaaggcttcagatgatcaaactactccgagctaaaggaggaagttcgaacccatggcaaagaagttaaaaaccttgaaaaaagattagacgaatggctaactagaataaccaatgcagagaagtccttaaaggacctgataaagctgaaaaccatggcaagagaactacgtggcgaatgtacaagcctcagtagccgatttgatcaactggcagaaagggtatcagtgatggaagatcagatgaatgaaatcaagcgagaagagaagtttagagaaaaaagaataaaaagaaacaaagcctccaagaaatatgagactatatgaaacaaccaaatctacgtctgattggtgtacttgaaagtgacggggagaatggaaccaagttggaaaatactctgcaggatattatccaggagaacttccccaatctagcaaggcaggccaacattcacattcaggaaatacagagaatgccacaaagatgctcctcgagaagagcaactccaagacacataattgtcagattcaccaaagttgaaatgaaggagaaaatgttaagggcagccagagagaaaggtcgggttacccacaaagggaagcccatcagactaacaactgatctctcagcagaaactccaatccagaagagagtgggggccagtattcaacattcttaaagaaaagaattttcaacccagaatttcatatccagccaaactaagcttcataagtgaaggagaaataaaatcctttacagacaagcaaatgctgagagattttgtcaccactaggcctgccctaaaagagctcctgaaggaagcacgaaacatggaaaggaacaactggtaccagccactgcaaaaacatgccaaattgtaaagaccattgaggctaggaagaaacttcatcaatcaactaacgagcaaaataaccagctaacatcacgatgacaggatcaaattcacacataacaatattaatcttaaatgtaaatggactaaatgccccaattaaaagacacagactggcaaattggataaagagtcaagacccatccgtgtgctgtattcaggaaacccatctcatgtgcagagtcacacataggctcaaaataaagggatagaggaagatctaccaagcaaatggaaaacaaaaaaaggcaggggttgcaatcctagtttctgataaaacagactttaaaccaacaaagatcaaaagaggcagagaaggccattacataatggtaaagggatcaattcaacaagaagagctaactatcctaaatatgtgtgcacccaatacaggagcacccagattgataaagcaagtccttagagacctacaaagagacttagactcccacacaataatgtgaggactttaactccccactgtcaacattagacagatcaatgagacagaaagttaacaaggctatccaggaattgaactcagctctgcatgaagcagacctaacagacatctacagaactctccaccccaaatcaacagaatatacagtcttctcagtaccataccacacctattccaaaagtgaccacatagttggaagtaaagcactcctcagcaaatgtaaaagaacagaaattataacaaactgtctctcagaccacagtgcaatcaaactagaactcaggattaagaaactcactcagaaccgctcgactacatggaaactgaacaacctgcccctgaatgactactgggtacataacgaaatgaaggcagaaataaagatgttctttgaaaccagtgagaacaaagatacaacataccacaatctctggaacacattcaaagcagtgtgtagagggaaatttatagcactaaatgcccacaagagaaagcaggaaagatcgaaaattgacagcctaacatcacaattaaaagaactagagaagcaagagcaaacacattcaaaagctagcagaaggcaagaaataactaagagcagaactgaaggaaatagagtcacaaaatacccttcaaaaaatcattgaatccaggagctggttttttgaaaagatcaacaaaattgatagactgctggccagactaataaagaagaaaagagagaagaatcaaatagacgcaataaaaaatgataaaggggatatcaccaccgatcccacagaaatacaaactaccatcagagaatactacaaacacctctatgcgaataaactagaaaatctagaagaaatggataaattcctcaacacatataccttcccaagactaaaccaggaagaagttgaatctctgaatagaccagtaacaggctctgaaattgaggcaataatcgatagcttaccaaccaaaaaaagtccaggaccagatggattcacagccgaattgtaccagaggtacaaggaggagctggtaccattccttctgaaactattccaatcaatagaaaaagagggaatcctccctaactcattttatgaggccagcatcatcctgataccaaagcctggcagagacacaaccaaaaaacagaattttagaccaatatccctgataaacattgatgcaaaaatcctcaataaaatactggaaaaccgaatccagcagcacatcaaaaagcttactcaccatgatgaagtgggcttcatccctgggatgcaaggctggttcaacattcgtaaatcactaaatgtaatccagcatataaacggaaccaaagacaaaaaccacatgattatctcaatagatgcagaaaaggcctttgacaaaattcaacaacccttcatgctaaaaactctcaataaatgaggtattgatgggacatatctcaaaataataagagctatctatgacaaacccacagccaatatcattactgaatgggaaaaaactggaagcattgaaaactggcacaagacagggatgccctctctcaccactcctattcaacacagtgttggaagttctggccagggcaatcaggcaggggaaggaaataaagggtattcaattaggaaaagaggaactcaaattgtccctgtttgcagatgacatgattgtatatctagaaaaccccattgtctcagcccaaaatctccttaagctgataagcaacttcagcaaagtcacaggatacaaaatcagtgtagaaaaatcacaagcattcctatacaccaatagcagacaaaccgagagccaaatcatgagtgaactcccattcacaattgcttcaaagagaataaaatacctaggaatccaacttacaagggatgtgaaggacctcttcaaggagaactacaaaccactactcaatgaaataaaagaggatacaaacaaatggaagaacattccatgctcatgggtaggaagaatcaatattgtgaaaatggccatactgcccaaggtaatttatagattcagtgccatccccatcaagctaccaatgactttcttcacagaattggaaaaaacgacttttaaagttcatatggaacaaaaaaagagcctgcatcgccacgtcaatcctaagacaaaaggacaaagctggaggcatgacgctacctgacttcaaactatactacaaggctacagtaaccaaaacagcatggtactggtaccaaaacagagatatagaccaacggaacagaacagagccctcagaaataatgccgcatatctacagctatctgatctttgacaaacctgagaaaaacaagcaatggggaaaggattccctatttaataaatggtgctgggaaagctgcctagccatatgtagaaagctgaaagtggatcccttccttataccttatacaaaaattaattcaagatggattaaagacttacatgttagacctaaaaccataaaaaccctagaagaaaacctaggcaataccattcaggacacaggcatggtcaaggacttcatgtctaaaacaccaaaagcaatggcaacaaaagccaaaattgacaaatgggatctaattaaactaaagagcttctgcacagtaaaagaaactaccatcagaatgaacaggcaacctacagaatgggagaaaaattttgctatctacccatctgataaagggctaatatccagaatctacaatgaactccaacaaatatacaagaaagaaacaaacaaccccatcaacaagtgggcgaaggatatgaacagacacttctcaaaagaagacatttatgcagccaacagacatgaaaaaatgctcatcatcactggccgtcagagaaatgcaaatcaaaaccacaatgagataccatcttacaccagttagaatggcgatcattaaaaagtcaggaaacaataggtgctggagaggaggtggagaaataagaacacttttacactgttggtgggactgtaaactagttcaaccattgttgaagtcagtgtggcgattcctcagggatctagaactagaaataccatttgacccagccattccattaactgggtatatacccaaaggattataaatcatgctgctataaagacacatgcacaggtatgtttattgcggcactattcacaataacaaagatttggaaccaacccaaatgtccaagaatgatagactggattaattaaatgtggcacatatacaccatggaatactatgcagccataaaaaatgatgagttcatgtcctttgtagggacatggatgaagctggaaaccatcattctcagcaaactattgcaaagacaaaaaaccaaacactgcatgttgtcactcataggtgggaattgaacaatgagaacacatggacacaggaagggaacatcacacactggggcctgttgtggggtgggggaagcggggagggatagcattaggagatatacctaatgttaaatgacgagttaatgggtgcagcacaccaacatggcacatgtatacatatgtaacaaacctgcacgttgtcacatgtaccctaaaacttaaagtatagtaaaaaaataaataaataaaaaagcaaagaatggaaaattatcagtgttgtcagggacatggagaaattggaaccattgcttattgctggtgggaatgtaaaatggtatagccattacggaaaacattgtggctattcctcaaaaaattaaacatagaattatagtatgatccagtaattccacttttaaatatataccccaacaaagtgaaagtaggatcttcaagagctatttgtacacccatgttcataacagcattattcacagtggccaagaggtggaaacaacccaatgtctattgatctatgaatggataacaaaatgtgacatatatgtgtaatggagtattattcagccttaaagaggaatgaaattctggtacatgctacaacatggatgaactctgaagacattaggccaactgaaataagccagtctgcttatatgaggtacctagaaaagtcagattcatggagacacaaagtagaattgtgtttactaggggctggggctagggggagtgggaagttactatttaatgggtacagagtttaagtctgggaagatgagtaggttctggagatagatggtagtgatggttacataacagtgtgaatatacttaatgccactgaagtgtacacttaaaaatgattaattttttgtggtttttttttttttttttgaaacagagtcttgctttgttacccaggctggagtacagtggcacaatctcagctcactgcagcctccgcctcccagattcaagcagttctcctgccttagcctcctgagtagctgggattataggcacccaccaccacgcccagctaatttttgtatttttagcagagatggggtttcaccatgttggccaggctggtctcaaactcctgacctcaagtgatcttcctgcctcagcctcccaaagtgctgggactataggcgtgagccaccgcacgtggtcatggttacattttatgtatattttaccacagttaaaaaaacttaagaagttaccaaaaatcttaattgaattttaaaagtagatgtctatgttccaaatcagggttgagtatacgaaattagcaaagtaacagaacgagaaatacaggaaactttaagatagcataaacagttaaatcagatgagtggaattcggtgagatgtctttagctgtgataaataattttagcatatgttgatattgtctcatgcatgtatttaacttaagcaagttcaaataaatatacttaacaaaagaggagagaaagaattttaaaagtgcaggtgttttgtgcatgcactctaccctttatgaacatatgactacggaagaatatgtaatgaaagatgggaaacttcattctcaaaattaattgtagtcctcgtttgccttttgtagtgtaggcatcttatcttgcttatttgggtatgattctagagtttgaagaaatgtctttttggtacaatatcagatacttcatcaggtgctcagattcaggtgcagtgctatgttacaagcttggaggaaaaagtggaccctcatgggtttcttgagcagacacgatgtcaatttcaacatatgccttcctaaggtaccttcaagggtgattttgaccctctatagcaaggttttcacctcacatgctgactttaaaccctgaattccatttaaaatgtatctctactttagtgaaaaaatagtaatgagactgtatatggtatgatccctgtaaatgttcacttagtaggatatataaccaaggtttagttgggttttcttttattgtttccttcatactttcctgaattttctacaatgatcaggttgttttgtttgtttgtttgtttttaatgatgggaagctgtcagctcacgttcatttgtttattcaaacaataggtattaaagatgttactgtgttccacgcagatacactgtggtaggtgttacaatttcagtattgctcaaaataaactataatggagtttatgttcacgttggttgacagatattaaacaaataaaccataaataagtacgtaattacaagtgataaatgctaagaaaataagaagagttccaagataaacaagtagacccagttttgttttacgaacttatgaagatcttttccaggaagaaacttttgagctgaactctagaggatgggaatgaattaggtaggcagagagtggagtgtgagaatgttccggcgagagggaagaagatggggaaagcccctgaagcagaaaagagcttgatgcatttgacaaatggaaagaaggcagcgtgggttgaaattccaacaaatttaaagatctgattggtttttgtagtgattcatgaatcaggcaacatcccattctataatatggaaagggtgcactgggcatgggagagagttggttctggtaaggtagccagaccaggaacaaggaaacacaatacagacagtccccaatttacagtggttccgttgaactattttttgactttatgatggtatggaaatgatacacatttagtagaaaccgtacttcagtacagtatttaataaactatatgaactatttgatactgtattataaaatagacttcatgttagatgattctgcccacctgtaggctattgtaaatgttctgattatgtttaaagtaggctgggctaggttatgatgcttggtaggttaggggcattaaatacatttttgactaacagtattttcaacctatgatggacttaccaggacataactacattgtaagtggtggatcatctgtaataccaaaaaaagcatattgattaacatcaggttacttacctggtaaagattaaagcagagataagttcctttttacgccagctcagggtgactggcccctttttcagttagttgctgtgaatctcttgtttttagaaaaaactggtccattttggaactttccttctttcttaaagtttcagttggattgtatggcatttagtacaagtgactacattttggtttggtctcttggggcttagtgcaggagctcagtctaaaacaatggactcccataaattttatttaacagggtagagcatagtgatgggtagatatggttaaagataggtgggttcaagatcatgcaggatcttatcaactgtattaaagtgttcggattttattctagtactactgcaattatggtttgatttatacttgtaaagtttattcttgccactatatggagaaatggtttatagatgggaaggcggagagccatggcggggcgggttagagtgcaagtagagacaccagttagttagaaggctgttgctttagacagtaccagagatggtagcatgagtatcacagtgttatctatagagatagggagaaatggacagtcagcatccttttagaaatagtttctcctagatttggtgataggagtatggagagtgagggagaagagcgtgaaaaaaatgtctggcgtgagcaactaggtgaatagaggtgccatttactgaggtggagattgaggaaaaagcagatttggggaagatgatcaaaatgtctgctttggacatgttaaaaatgagattcctattatacatccacatagagatgttgggtctacaattgaatgtaggcagagttaatttacacatgttaaggtaatagtgccacatataaggtggcattattcacattataaatatatacttttatgaaaacatacagatgggcatgaatattccagatctttagttagagttctggagcaataatgttaactcttgtgctgccccaaacataaatctatactcgcacatactatagctatgcacaggtacaggaaaataagtatatgtacattcactgacacgcacacatgtgtggctgcactctctcagctgcctctcacctcctctgaggttgattctcttgcttattcacccactgctctcagggatgtaattgttcctcacctgactctgaacttgaaagggtcatctctcttggagaacgaggggtggtggtgcagactgtgcgtgcacatgctgctgctggtgtgtactccctgggagaatttgtgaaaagaatgaccaccatttacagttgtttgtgttgtactacaatatatagtaacttaaacattttgatttgaagaagacacatcttttctaatttccataaaagtgctgtaagagctagccgtgtccctgaatgctggagtcggatgctcagaagaaaggtactcttgggcaatggtacattatttgttggtcatcagcatataccttggtggtcgataagtttacctaggaagagaagagaggccagttccgactccttaaggaactccaccattgagagatttggtagaagaaaatataaaaaataagtttccggagaggtaagaggcaaataagagaaagtgatgttacagaagttgagaagaacccaatataatctatttggcccagaaggcttggtgttttccttgcagtctgtcctgcaaaactcttcagggcttactgtgcactgtactaatgatacaggtacttacccagctcttattgccatatacatactaggagctcaggaaatagaggatcttagaaaaatcatctcataggagattagtataagcctttatatgtccagaaatgttcttttgcctgttagatgtggcatggattatagattaatttattttatcaaggaatgtgggaatattgaaatatattttaaaagaaaattaaatactttcaaatcttttacttatcatctgtcattttccattcagtgttttgtcttttgtattgtcagattaatcttctggaaacatagctaaatatattattattttgttgaaaaatcttccgttatgttgcattttatatacaataaagtttatactcttcagcttgggatcccatgcactggtgaattttgtcccaaacaactattttttaatatcttctaccactgtccttaatgtattctgcaatccaacctgaccataaagtgtccactatttttaaatacttcttttctttgcttatgctataacttctgcctaaaatgcctttcttccttcctctctatatcaaaaaactactttttttccaagatacaatccattttctccttcctccaaaaccatcatgagctggaaatattctctctcctgaactgattctccattttacatcttcttttatatcatttgcatctctgccttgtattattagaatttattttacatggcttacaacttcagtttgactgacgtttccttctgattatcctacccattgtagtgtagtgtttttttgtttgttcgtttgtttgtttgtttgttttttaagaccaagtctcactctgccactcaagctgcagtgcggtggcaacatctctgctcactgcaacctctgcctcccaggttcaagcgattctcctgcctcagcctcccaagtagctgggattacacgcacctgccaccacgcctggctaatttttgtatttttagtagaaatggggtttcaccatcttggccaggctggtcttgaactcctgacctcaggcaatccgcctgcctccaccttccaaagtgctgggattacaggcatgagccatcgtgcctggcctgtagtgcttttttcatagaattggtctaagaggcaaatttttaaaaagtctttctcaatctcatgtcgctatttgtgttttgtattacttccccgtttttctgtaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcaggtaactggattggctttgtatactttgtagctttttctccccttttcatcctaaatgagattactatccaatctttatcctttttttctgttttgttatacaagcttttctccttgctgttatattgagcatatacaagaaggcaaaatttcataaaatcctttaataataaaggaagcataagcttcagagatttttgaaaattataaacttcattttcacaacggataataaaatatgatacaacttttgaaatgaaataatacccaatcaagtatgttttagatactaagatccacagaaaatcttgattaaatgccacattagtttatctctgtcagatattacaaagtaatgtcttataggctggattctgtagggagatatgtagctgacatgattttttttttttaatttttttaaagacagggtctcactctgtcacccaggctggagtgcagtgatgcaattatagctcactgcagtgttgaactcctggactccagtgatcctcccacctcagccttctgactagctggggccagaggcacacaccactatgcctggctaataatttttttatagtgatggggggttttttgtagtgatgggggtctcgctatgttgcctgggctggtcttgaattcctggcctcaagctgtctaccagcctcagactctcaaagtgctgagattacaggcatgaaccaccgcatccagcccccatgttgttttaaaatttttaaaattttccaccaacattcaaaactaagatttttgattttccttgaaaaatcagaaaatctgactgccctttggctcgcattcattcatggtggtaatcagctgcagctgagccatggctgtccccctgcaggcaggacatccattctcttgtttgcttccatctccacagctctgagacccagtctgcttcattcatccaccttatctgtctgctgatcactgtgggtatttgagtttcaatcttttttttttttttttttttttttttttgagttggagttgcgatcttgttgcccagggtggagtgcgatggcgcgatcttggcacactgcaaccttcacctcccgggttcaagcgattctcctgcctcagcctcgagtagctgggtttacaggcacccgcctccacacccagctaattttttgtatttttagtagaggtggggtttcaccatgttggccaggctggtcttgaactccagacctcagatgatctgcctgcctcggcctcccaaagtgctgggattacaggcatgagccaccgtgtctggcccccactgttttataaaagctttttttcttctgcacccctgccattatacttttgtagctgatagatgataatatttattaaatgaaaactccagtagccactgaaaattctgtgtgtataattgcctgtgtttgttacatttatacttttttattcctgtgtataactattagctaaataggtgctactgatcccagggcagtttttaaatgtagggtggctctatgttctagttttggcatagtgttaatgactttgtgtgatagcatcagtgcctttgtgagaaaaataaatgagatctgcatggttttttttattttattttattattgttatactttaagttttagggtacatgtgcacaatgtgcaggttagttacatatgtatacatgtgccatgctggtgtgctgcacccattaactcgtcatttagcattaggtatatctcctaaagctatccctccatttttttagataatttcgttctacttcaaaacacagtgaagtctttttataaatcccttttgaaataagagaagcatatctaccagctaacattgagactgccaagtaaataaaaagaaataattttacaaaatatagttcataaatgaaaactcttctgcaccagggaatccgttacgtgttttccactatccatatgctagtggcagtttggttgaaacagataagcctaagatcccagtgtcagatacttcaggtgagtgtagatgtggaaaaattggcaggaaagaagtgaactctgtcagaagtctgcacaaagaactcaccagctttacctcactcccaggcttcatttggtaaggatgatacatttgaaataaagtcaggctcagttatctgaggacctctacaatctcccatctgttggtctacttacagactttgcatcctaaggaaaagccctcctcctggcttagtccttagtagccatttcaccttgagagaagcctagcctcagaacctcttgccttagagaattaaagaagaatagaggagagaatgcctgcctgggaaactgaacaatgacctatgtaatagctaaatgagctcataaaatatcatatcataagtaaaattctcagtggaaggggtggaatataaaagtgagaaaatctcttcaaaaatagaacataaagagaagggaaaagattttttaaaattcaagattgtccccaaagtttcaacattcaaagcaggtattctgtaaagacaatagagaaggcaaaaaagaaagaaccaaaggactagtataggaataaatttcagaactgaaagatgtgagttttcatactaaaagggactaccatgtacataaaaatacacaccgaggcacatgaccttgacattttaaaactgatttgaaaagagattctaacagcttccaaaaagaaaacatacattccatataaagaaatggaaatgagactggcatcagacttctcaaaagtgataaacagagttagaaaccaaaggagtaataccttagaattctgagagaaaattatttcactaaaacaagggagtttatttaagttacaaaagaaggaaagaaagaaaacatggtgggattgaggaaatggagggggccaacacaggaaatgggaaacgaattctcactgtggcggtggtacacaaggcctagaacccattcagtttgaagcctgcaaggaaaaagtcgaatttgtaggataccttatgtgattgactatacttagaggaggttttcagttctatttgcagctatgaggatgaagtagggattggcacatagaaactcagaaaatgcaaaaacaaagcggttattaactcttcaggaaagcagaagtttgtaatagaaaataaatgtaattacagtatactagctggcttagctgtgaataataattatataaacaatcatatgtaaatactaaatataaacttaattgaatattgatttaatcactcagaccattatttatgtgacatataaacactgaatgttaatatagggctaaaacttttcagaagataggatgaaaggatatatatgggtaggagggttttataatgagataaatccatagatcttagtatatagtataagaataaatcccagaactgaaagatgtgagattgtaattgatcttagaaggaaatcaatagataatttctggaacataaaatgatatggtagtataaagcatgttattaggaaataaggatattgatcctagaataaatggctaaagaagttgaaaatggtagcctttagaaattggggatctgtagtggataggagagggaactgctgacttttcttgtaagcctcgtgaaactatttgacttttaaaacatatacattgttatttttattaaatcagaatttatattgtccttcacctcaaaaaagtaagaagaaaaaaatacatttggcaaatactgactaaagaaaagctagtgttgatatggacaaaatataattccaggacaaaaaaaaaaaaattaaaggtagatacaagagtttatctcatagtaataaaagggtcaaatataccaggaaagataaaattgtgagcttatatgtatattctcaaatatattcaggaaaaattacaggaatgtgtaggtaaattcaacagtacatttcagaaatgtgaaagaccaggaaatagagaaagtagggctgagcgtggtggctcatacctgaaatcccagcagtttggggggccaaggcgggtggatcacgaggtcaggagatcgagaccatcctggctaacacggtgaaaccccgtctctactaaaaatacaaaaaaaaaaaaaattagccgggcgtggtggcgggcgcctgtagtcccagctactcaggaggctgatgtaggagaatggcatgaacctgggaggcggagcttgcagtgagccaagatcacgccactgcactccagcctgtcgtatttaaaatcaggtgttaccctcagcatgggggagatggaaggaagaatgaggggagcgtgtaagtttctagccagattttatttcctaacctgggtaaggttatatacacttgctttttgtaattcactgaactctttatgtgcacgttttcccccatattttccactgtacaattaaaaagatattttaaaaagcaatatggtacttagaaatgaatctaaaagggtctgtaagataaacaatacggtacttaggaatgaatcttaaagggcatgtaaaactattttaagagaaaattataaaactacattgaaatatattaagacctaaatagttggaaaattacacaattgtaataataaagatgtcactaaattaatttctaaattaaatgcattgctactcagaattccagtaggatttttcgtggaacttgacaggctgattctaaaatatttatggaaaatcaaaaaacgtatatttaaagaataagataagggatcttgccataccagacatcaagacttattacatgtgtagcttatttaagacatcatttacaaaggaataaacagaaagaaaaatgaaacagaatggtgacccagaaacatatccatgaatgtggaaacctaacatacacagagatggcataacaatctgtggagaaaggatgaagaggaactattcaatagagtttgaaccaatgaatatatatctggaaaaaataaaatcagataaatcactgccacacactaaacagaaatgtatagtataccaggcatattaaaagtaaatgggataactaagtttttagaatttagatggtctgtccttatgaccatgtgataataaaagatttcttaatcaggacacgcaaagcacctaccctaaagggaaaatataataaatatgccattattaaactgaaaaactttttgcctaaacgatatcaaacaattaaaagacatgaaacagcctgggagaagatatttataatgcacaccacctgcaaagacatttcacaggaatgttcattgcagtgcttttcaaaataggaaatagccttaagttgatcaacagaggtgtattcgtatatattaatacagtagaataatacataacgttcagaatcaaagacatatattaattgactaactctcaaaatcataatattgagtgaaaaagtcatggtgcgtaaaggtacagacagtattgtacccttcgtataaggtttaaagaaacttgcaaaacaatgctgtacactgttggttaatatatgcaatgtggtaaagaattacaaaacatccttgatattgataaactgtaaatttggtgtaaaggctgctactgagaagtgagaatggcatcattgggaacactttacacaagaaacattatatttgtaatattttatttcttaagctctatggtaaatacttgggtgttcattttgttgcctatatttttggtatgcctgaaatattttattaacattaaaacattttttaatgatctaaaaatttcagaagacatttagagaaaagagattaggaggattgaagtaataagaagtaagaaaaatgtgtgaatttaaaagaggtagcaagagttaactggttctttgcatttttagcaatctctattgcctttctgatttctttgttgaaaaatatacttacagataaaaaaatcaaaaatgatcaaaaaagtagaaaagagaaatagtattagacaagtttaaaaggctataactgcatgaaatttttaaaaaattgtatgagaatgctgtatttaaaatctagatgataaaagtgcttttcttggattatatgaaatataaaaattgactccataagtggtaaaaactttgaataggccaaagaacttgaaagcattgttcacatcttttttcctttgaaaaaacatacctgatctttcctttttttttttgtttttttttttactgttgcatcaaaccatcaaggaacagattttttttagaatgtttttattttattttatttttttgagacagagtctcactgtcgccccggctggagtgcagtggcacagtctcagctcactgcagcctccacctcctgggttcaagtgattctcctgcatcagcctcctgagtagctgggactacaggcgtgcaccacgacgcctgctagtttttgtatttatagtagagttggggtttcaccgtgttggccaggctggtctcgaactcctgaccccaagtgatccacccgcctcagcctcccaaagtgctgggattacaggtgtgagccaccccgcccggctttagaatgttattttatttaaactgttgttgtacacagtaaagtatgaaaaatttttcaattcatgtcacagtttttacacaggtggagcctaagaggtacttttttcctaatatgtaaatgggtttggggttttgtttgtaattgtgggggaggattacttgtctgttgtgtttattatctttccttttctgaaatcaaatgatgtcgttattccagatgcctcagttcaagtgctaatcactggggatgagaacctctcagacaaaaaacagcaagagattcacagtacaagggcagtgactgaggctgcccaggctaaagaaaaagaatctttgcagaaagatactgcaggtagctaaactggattgtctgcgtattattttcttctggtcttctaaaatgagactattcccttaagaacagaaacagaaatatattctctattttcttcttgctgtcttcagctctcttctatctcatgtatatatgaaatagttaaggtatgtttagctatattttttatatactttggcaggtaaaattaacatatttaaagttctttgtgatatttctggagggttttgaatatagtaaacaaattaatctaatttccagaaattcatttaatggactttttacctccgctgataaaatctctcaattctgtgagacacggaccctctaataccatttttgtacataatcctttatttaggaattcagcttgtttacttcctacctatcagttactttacttcaaagggattatgctgatttaaataaccctaatagtgtatttacgttaggattagttttgactcagagaggaaaacaaaagcaaaataacataggcttgaagaagacagaaaactctttctcttttttgtaaaactccagaggtaagcatccagagttgacctggtactccagagtatcggaacaaagctgttgctctcttgttactctaacatttttggccttcattcttaagctgtagccatcagcccatattgcaaccagcaggaagaaaggaaaggaaaaagcacattccttcctttaaggatacttctgagaagctatatataccattccttttgcattctattggccagacttagacacatggtcacatgtaccagggaagctgggaaattgagttgttattctaataacaatgtgcccagctaaagttagggttctgtttagaggaaaaggaaagtggatattagaggacagatagtattgatagtttctgccacaattgtaaactaaaacattttagaacatgattagctgcttctcttctttaggtattgcttgtttaaaaaggttagattgtattctgggcaacacttctgaattttaccccattttactattactaaatgaatgttccaaaaacagttttgatcatgttaatctcctaatcaaaaactttagtgtttcattgcctgtaaggataaaatctaaactcttttagcactgtcttctagaactgtagagtccactctcaaacaactttctaacactagttctcacctcttttccttataaattctataatcaaatgctatatacttgctctgtttcttagatgctaagttactttcctgacaccattcttgtgttatgtagtcaccttttttttccatcttaatgtgtatcccatcttagctctcttctaatgccaaaatcagttgtctagagttctatggtactcccacctgcaattagtttttctttctttgaataccgctacctctttttctgactgtttcttacagtatatctgtttacgtatgtgattttttgccccaattttcaattattttctaaacgcatttctgagtcatcttttttcttcaatatcagtaacaaagcctttcacataatacgtacttgagagacatttaaaaatcttttatgtcaagttcctgtctgtatagtgtgttaatttccctttcgtagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaaggtaatgggattgggttgtgtatgagtgtgtgtgtctttgtgtgtatgtgagggtcagtgttagtgtttccatttcattctgatgagaatatagcctcatgattaaacaaaaattccttttctttttttaaaactttcttgtgtaaagtactttgatgctactattaggttactatatatatatatagatttccaaaaagtaattgttactttttggaaaagatattagcaacttagaaacaggattataaataaatacctaaggctgatagttttagaagtgaagtatcttgtctcagtccccagagacaaccttaaaggccttccagaagactatagcaaagatagtgagaccatcaatacaaacttttaaaaaattacaataaaatcacatttatttttgtttgtccatgggtctctttttctgacataaaagcgtatagaacacaagacattactacctagccatcaagctttacctcttagaggaagatggaacagcctacataaggagagaaaagagtcaaggagctaaactacccatactggattttggaaatagtctgggttcaactgcttacatcaagaatatacaaaataaatgattttttgacaatagccaagactacacaatggggaaaggatagtctcttcaacaaatggtgttgggaaaactagatatccacatttaaaagaataaaggtggaccttttctttacaccacatacaaaagttaactcaaaaagggttagtgacatacatgtaagaccttaaaaccataaaactcccagaagaaaacataaggggaacacttcaggacattgaacttggcagtgatttctcagatgtgacaccaaaaacacagacaacaaaagcaaaaatagaccaatgaaactacatcaaacttgaaaacttctgcatgacaaagtagacaagagtgtgaataggcattctacagaatgagagaagatatttgcaaatcatggatctgataagggattagtattcagaatatataaagaacttatgcaactcaatagcaagaaaaacccaaacaacttatttttaaaaacacgtaacttattttaaaatgagcaaaggacttgaatagacaatagaagatatacaaatgccatatcaagcatataaaaagatgcccaatctctctaatcataagagagatgcaaatcaaaaccacaatgagatatcactcacacctgttaggatgaccactatcaaaagaaaaaatagcaaatgttcgtgaggatgcaaggaaattgaaacccttgttcaccattggtgggaatgtaaaatgatgtagctattatggaaaatattatggaggttcctcagaataataaaaaagaattagtatatgatcccgcaatcccactgccactgctgggcatataacctaaagaattcaaaacaggacttcaaaaagctacctgtatactcatgtttattgcagcgttatttataatcaagaggtggaagcaacccacatgtccatcaacagatgaatgtattaagaaaatgggaattatttgtcaataaagaaagcatgttacatacatatttgtattgtgcagccttaagaaagaaggaaatcctatcacatactacaaggtaggtgaacctcaagaacattatactaagtaaaataaatcagtcacaaaaagataaataccatatggtttctcgcaaatgttgagggatttaggaggatgagagagaccttgggtttaaacaggagagtcttttattgagtgcactcaggcccagcagactcacgtccaaaggctgggcccagaacaaagacagcacttgacttttatacacacttcacaaaaggggatgggctagcttgaagcaagcttacagtggcgtgaaagcgggaatacagaagcaggacaaagacagttaatcaaattgtaacaggttcataactcaggattgcacataaccgttgctatgcaacccagatgtccattatctaggtttgtctaggcacgggcttatcccataaccttcactatggtgcccaggcagctgtagttcaggcctactcaggcttctcatgaccttcattgtacttcttagataaaacagaatacttgaagtcactagttacagagaacaggaatctataaactcattccataaaacaaaggaaaatttgttttttcttctccctgtgttgaaggagtgctgggagagtctccagagcacattacataatattatcaagacttttcctgggtctgggctgtgcctgttgctgcctctgggacaagtcagcctaatgcaggaaaacttatttctctttctttttaattttatttttctttaatttcccacctcagtatgaaatatctaaagtagctgaaatcatagaaacagaaagtagaatagtgattgcccaggcttgtgagagggtggacagagaattagtgtttagtaggtgtagggtttcagtgttacaagatgaaagagttagagattgttgcacaacaatgtgaatatacttaacactactgaactgtacacttaaaaatggctaaggtggttaatttaatgtcatactatttgtcacacacaaaaataatacataagatgaagaaatataacattgcaactttgcaggggttagtgtgggagacatagcttgcaaaagaaagatggaaatataatctgtaaaagcatactctagaagataagaaaaatttttctaaatgttttacactctgaataattttagaagacatgaagtatatgaaataaaaattgatagaataatgaaatgaaaagggagatttaggggatagaacaaaatgaaatgaaaaaaaagtaccaattagaagaaagagatgaaagcaattaaaaaaaaatgatggaatttgaaggctgacagtgaaaatccaacacaatgatatctgttgttgcctctaaagaagataatagaaaaataaagatataaggaagaatggaacttacaattgtatgtatgtatgtatgtatgtatgtatgtatgtatttttagacatggagtctcattctgttgcccaggctggagtgcagtggtgtgatcatagctaactgtagcctcaaactcctgggctcaagtgatcttcccacctcagcctgtagagtagctgggactgtaggcacatgctaccacacctggcttgaacctgtaatttaaaaggacgtaccaagtcctaggaaaattttgtatatagtgttcaatactgagatgtatgtttgcgatagtactgaactttaaagaaaaagaatgaatcatgcaggcctccatacagaaaaaaacaagtagaaaatgctaaaagacagggggacaggcagaggacagggaggttaaaggaggtataaatgagcaaacttcacctttaaagttgtaaaatcaaaaaatacatgtgtaagtaattatagggttgaaaattataggccagacgcggtggctcatgcctgtaattccagcactttgggaggctgaggtgggtggatcacctgaggtcaggagtttgagaccagcctgaccaacatggaggatccccatatctattaaaaatacaaaattagccgggcatggtggtgcatgcctgtaatcccagctactcagaaggctgaggcaggagaagcgcttgattccgggagacagaggttgcagtgagctgagatcatgccattgcactccaacctgggcaacaagagtgaaactccatctcaaaaaaaaagaaaattataaaatttacccctaaaagagttaaaattaaactataaaacatccaaaatatttagaaaaacaggttagcttggaggtaaagggagggaaaaagaaaacagtaaatttgtaacaaaaacaaaaaattgccataaaatgaaagacagcaaagcatgcaagtctatatataagtaaactaaattcacctatattaaaaaaaaaaaaacttcttggattatattaaaaaacaaacccagttccatgctatataacaaacatatcaaaagtaaaattactgagaaaggtggaaagcaaaaagaaaacttagagatgtatcaaaaagaaatttggggacattaatatagatgaggttaaattcaccaaaagttttgcaggaattgaagaggtatatttttatactgatttgcaatccacaatgaggatattttgcataaatctttaaacatcaaataacttagcataaaaaattcataaaacgaaaaccaggagctcaatcaataaggaaatttatgttgccttaaaaaagaatgaaggagggcagggtgcggtggctcacgcctgtaattccaacactttgggaggctgaggcgggcggattaagaggtcaggagatcaagaccattctggctaacatggtggaaccccgtctctactaaaaatacaaaaaaattagccgggcgtggtggcaggcgcctgtagtcccagctactcaggaggctgaggcaggagaatggcatgaacctgggcggcagagcttgcagtgagccgagatcacgccactgcactccagcctgggtgacagagcgagactccatctcaaaaaaaaaaaaaaaaaataaaaataaaaaatgaaggtatggaattatatgaaaacaactcttaggatggattgtgaggcaaaaggtgcttaacagggggattggacggtggaatttgcttgtagggagaaaaaaaataaaacagacaaccctaggaaatcttcaaagagaaatggacaaatacaaaataatactggggagcttgaacacacataattagcttatgacagatcgtggagatgaaaattttttttgtaagtgaagtttaaaaacacctgggaataatacaagtaatgaggttgatgtggggtgtgtgtggctgtgtgtgtgtgtctgtgtgtgtgcatgcatgcataagcctatatgggttaaacttaaaaaaaaaaccctttccaaaagaccatagaaaattttttcatacagctttattcagatataatttacccatttaaaatatgtaaggctgggcacagtggctcatgtctataatcccagcactttgggaagctagggtgggtggatcacttgagatcaggagttcaagaccagcatggtcaacatggcgaaaccccgtctctactgaaaatacaaaatatagccgggcatggcggtgcatgccgataatcccagctattcaggaggctgaggcaggagaatcacttgaacctgggaggcagaggcgacagtgagccaagatcgcgccactgcacttcagtccaaacgacagagcaagactccgtctcaaaaaaaaaaaaaaaaaaaaaatcaaacatgtaattcaatgatttttactgtattcacagataagtgcaatcaaccatcaccataatcaattttagaatattttcttcacttcaaaaaagaaaccctgagacttaagcaaatactgatccactttttgtctcagtagatttccctattctggactttcatacaaatgggaccattaagttggggacataacatgaaacttagggcccgcccataatgaaaaatgttaaaggaaattcccatgtaaagtaggcctccagtgggctacactcttactataagaataaaagataaacacgtccatgtagaaggggacagtaagaaaactgcctgttttaaccttgataatgagtttggggaaagaagacaaaatttatcctcagaatttataaccacaaactagtgttcacacagatttacagtcattaattttgtactggtataatttattagtgcagtaaactacaggtgtgttctgaaaaatctcaagccgagaatttaacaatggcagtaggttggtattgcagactcacatgcctttcggatgcaaatgcacatctctctgaagaaacttcaacccagacctaaaataccctaaattccctaaaataccaagctcatagtcaaggcactattagtagaaacagtatcaacaacaagaaacagaaatgagacccacaattacaaatgtccaggattccttggcaaaatgcctgattctcagactgggacaggagatatattagatgagcctgaacccttttgtggtgccagaaagtaaagaaaaaaaaatgcacagggatggggaatatgtcaatggaacacagggaccaagtaaaaaacttcccagtggctaaagctgggacagtttctgtagtatagcaatagtattagatcataaccaaagtataaaataaatacctatgagtctgtactgataaaagtaaatgatttaataaataaatggggggaaatgacaaatctgtgcagaattctaaataatgtatgtagatattccaccatcagggaggtggaacataactcccactcttaactaatgggttgcacatagtaacttaacttccttccaaagagtgtatttttataggaagggggaaaaagaataactatatagtgaagaattctggcaaacactggctcagccaggtcatcaagatcatcatcaatagtggtaagtcatgttgatagtatgtacccttaatatgtaatgagaaatatattttaactttgaaatcttcttcccaaaaacccataaccccagtctaatgagaaaaacatgagacaaactcaaatgaaggacatttatacttgaccagtacttctcaaaactgtcagagtcatgaaaaacaagggatgcctaagaaattctcacagacctaagagaagcctaaggagacatgataattaaatgtaatgtggtgtcttggatagaatcctggaacagaaaaagaacagtatgtacaaaacaaggcaacacaaagtatggcctttggttaataataatgtaactttattgattgattcatggtaatatattgtattaatgtaaggtgttaataggggaaactgggtatggggtataggtaatcatctgtactgttgtcaccgtttttctgtaaatccaaattattctaaaattaaaagtttattttaaaaaattaatgcattctgacattaaaacaggtggatagataaatgataaataagaaatttcatcttcttaaagaaaacactttacagcttctctttggcataaccaatttgctggcgttactgctcttgcactttggggccattactaactacagttagggttacttgaacacaggcactgcagtatcatgacagtcaccctgataacccagacagctatgaagtgcctaaggggcaggtagtgtaaatgtacggacatgctggataaagggaggattcacatcctagggtgggatggagcaggatgacaagagatttcatcatactactcacaacgacgtgcaatttaaaaatcatgaattgtttctggaattttccattaaatatttttggaccatggttgactatgggtaaatgaaaccttagaaagcaaaaccacagataagggggactactgtattcacacctaatgtgtggggtttcccctcacgttaagcagttctgacactgacaacctgtacttagcacagtccccacaggttatgggttcagtcccacaagactgcccaccacttcagataccaattgcatggcttggcctcctatacttctgaccaactagctccaaattggggtggtggggagaatcccatgaccccctcctcaggtttggtaatttgctcgaatggctcagaaaacttagggaacattttcttacatttcctgattttttatgaaggatatttcaaaggatacgcacgaacaaccaaatgaagagatacatgggcaaggtatagggaaggtgcacagagcttccatgtcctctctgggcctgccatcctcccagcttctcctgtgttcaccagatgtgaagctcttcaaactctgtctgttagggtttttatggaggtgccattacataggcaatattgattaaatcattggccattggtgattggctcaacctgcagtccctgtcccctccccagagatcaggggttggggctggaagttccagccctctaaacatatggttgttcccttggtaaacaggccccccatcctaaggggctttccaaaattcacctcattaatgtaaactcaagtgcaatcagaagtgacttgttttgaataacagaccctccttgaacctttatcactcgctcttgaactgtttcaagaaccaagtacaaaaaccaaatgtcataataaaagatgcccctattgctgttatcccgttttcctaaatggaaattacaagagttttagtagttctggccaggagctagggttaaggcaaaatatgtatttattatatcacagtattacaatttacagggtatttaaatgaattatacagtgataatagtaaaaggatgctactgggacaagagactgatacatcagtgaaaatacttaaatacagtgggcacttactctatgataaaggtgccatttcagatccatttgtaaaaagatggattactcaacaaataatgccaagatgctttgctagccatttagagtatcgtgagaattttaagttgtagccctactttactcctgtcaccaaaatgcaagtataaaagatccaagtataaaaaagagatcataaaagttctggttttctgacttttctaataaatttgagcagaagaaggctttcaaggtctgacaaaatcttggagtcataaagccaaagatttgataaatgtatatattaaaattaaagtgtcttcatggtagaaaatatcataatgcaaaatcaatttataaatgaataatgggaaaacaattttaaaaaattgagaaactgagaaaaggggctaattttcttactatgcaaagagctttttacaaatcaatgacagcctaaaaggaaaacaaaggacctgaacaaaaagcttatagtaaaagaaatgcaaatggccattaaagatatgaagaaatacttaactgtcttaataaagaatgtactaagccacaaattttgttttacctgtcacaatagcacagatgaaaagatttgattatccttagtattgttgagtacatggggaaacattcatgtactcttataagactattattagaagtgcaaatttgttgcaacatttttgaaagtgtggaacaattggatgatatctaactaatgttgaaataaatattcccttttcacccagacttccatttaagggaataacagatacacagataaagttgtacctagaaaaataaaatgaagctacacataaacgcacaaacaaatgttcactgcagcatgctttggaagaataaactattggaaacaacctaaatatttagttaaattttggtaaagtaaatcagtttaatataaaatgtttgtagatgcacaaaatcttgctttgaacaagtagttttactctacttggcaggaatttttctataagaaaacttgtttaatattggttatcaccagaaagtggaactaggaggttcagagataaccgggagaactttactgttcatattaaatttgtctgcattatttgaatattttgcatgtttaatttttaaaagtctgcagttctaggtatgaaagaaatatttaaaaataaatgaaaagcagtaaatgatattttcatgtacttttatatattcggggagaattttgcaaatgttatgagtaaaattaattccattatcagaagtaaataactacttcaacttatttgacctttactcttaacaaagtgccatgagatgatggtgattatcaaatcctgttgttttataaagccctttatacttaaggaattcaggttggttggtggtggtttgggttctttttttttttttttttttttttttttttttttttttgagatgaagtctcgctctgtcgcccaggctggagtgcagtggcacggtcttgactcactgcaacctccaccttttggatttaagcagttctccttcctcagccaccacagtagctgggattgcacgtgtgcaccaccgcacctggctaatttttgtatttttagtagagatggggtttcaccatgttggccaggctggtcttgaactcctgacctcaagtaagccacccccattggccttccaaagtgctgggattacaggcctgagccaccgtgcccagccttcagcttgcttattttctactatcctttctgtattttacttcattcccaggctgggaggactatgttcattgaaaatactgatattagggaataaacattttagagcaatgttatctatttccttattgttttacttactgctttaatgaattctagataggccttcaaatttttgctttattctgttgccaaggtatccttcctgaaatacagccataattatgttactcgcctgttcaaaatggtatactggctcttcatttcttttaagaataaaatttaaagtccttggcctagtgttccaggccctgtagaatttggccccaaataacctttgctaccttactttcctctgctttataaatgaaataagccatacatactgaatatttgcactctcccttattgcctcagttctttcctacttttatgcttttgctcatgctatttgatgaagcaggggaaaggccagcacaactatagtatagttatcaggaagagtggtacaaaatgaggaagaaaagttatgtatacttgtacttcttgttaaggagtttgggctttgttcttagtgtaagagaaggtcattgaaaattgctaaatagaaaatgacaagtccagcttacattttaaaaagactactttgaccactatttgacaaatagattggaaaggtacaagaagggacaggagacctattagagacttgcagtattgtgacaggaaatagaaatagatgtgtgattgtttggtgaaggattaatgacaggaacaggaagaggagggagttggaactatcaagaataactcccagattttggcttgggcagtaggatgatgtgccattcacagagatgtggaagactagggaaggtacagttgtcaaggaggctagaatagagctcagttagatggctgtgacatccaagtggatatatcatgtatatagttggaactcaagaaaaatcgtagcttgaaatgcaaatttgaaaataagtaacagcatggaaatggtactaaaagccacagggagagatgagattacctagaaagagaatatagactgagaacatttcctggaaattggccatacattgaggtcattgatcatattagcaagagcacttttagtccagaagtatggctgtactctgcagtaatttgaagagggaattggggtagggagagaggtaaaggagaggaaaataggttcctctttagaagcttggctatgaagaggagcagagaagtgggccagtacctggaggaagatgtgaggattttctaaacatacatactaaatgatgttttcaagccaatggaaatgaccctgaaagatagaagagagatatgatagggaaaggaagcaaggtctggaagggaagatgagttgggttccagagcagcattggaggaacttgcctttaaaagaatgggagaggtggtgttgtctctgtatccagaaaggttatgggagcaggtggattggcataggtggcagctgcctcaggacatccacagaaagtgatccctcagcccagaatgttcttcttcctgtttgtttgtttagctctcatttttacttcacatctcatcctcctcagagaattcttctctagctaccatttcccagtaaaatttctcttatatcagcttgtttttgttctttgtagcccctaatttagaattatatatttgtttgcatttgttcagtgcagaagctgcaatctcaagaacctgtagaatctaaatgaaatctcccaatttttaaatgttgctagataattctaaaattgtatagtctacatactttaggtataaatgcaggccctgtgtgtcccactctactctggggaagtccgtagggattcctagagtatttcatgaaaactctgcttgccagtaatctatagtgtgggtgaaaaggatcccatcattgcatgtgtgtatctttgtttctgcccatgatgtagaactctaaaacagtgttttgatgtcatatcagagattagaattagggtttatgattgtgtcttagctcattcctgctgctgtaacaaaattctgcagatctaagatcaaggcaccagcagattgggtgtctggtgagagcccagtctctgcttccaaaatggtgtcttgttgctttgtcctcacgtggtggaaggcagggaaaggccaaacaggagccttcaggccaaagggcactaatcccattcatgaaggtggagccttcatgacctaatcacctcctacctaatactattatattggggattatgtttcaacatgaatcttagagggacgcaaacattcaaaccatagaaaattgtaagatattacatctaaaaatgtcaaaaaatgaagatagaaagtggtaaattttatgtgttttttaccacaataaaaaaaaatttggaaaaaaagtcaagatggtccacagaaaaggaatttcaaagggctctaaaacatgtaaaaagggttttttaaaaaatttatccatttaattactgactatgagaatgaagtgtcaggtttcttagctgaatatggggttaccaatatctgtcaggtttaatagcaggattaattaaaaaaaaaacagatgcagagcatatgtcataacaccctacacagaacaggtggtaaatacatatagcagttgcttttatgatctggagaactgaagtgccttcctccaggtcacgtagccggtcagtggcagagcccaggccaaaattcatgtctcttaaacttttactgtaccagcgaggctactaagaacaaggcatcagtcttttgtgcaggcagtgaattttctgataccttatataaactattctttcctttagtctttgttctgtatctaaagaattgtgaatagtatttctaaacagaatgctaattttttaagttctttcaaaatctttttttctccttttcagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtacatggctacagattccatctggcaatgtgactgccctcttcatggactttttagttaagctttgcacacaggtgaaaaaaacaagccatttgccctttcctctctataccatttcttaccaactggaaaagagtgagaaagtgtagtacagtgctattgtgagttgtcattattttcatcaacattcatttacgaattaccttttgaatgaagggctttgctgctagatccttcacagtctgcaaagtttacccctgaaatgggggagctttgaggttagaatgatctctatcctgaacaatattgctgggtttatgtttatttgggttttttttttttaattcattcctctctgtctttcaggaaatatatttgaggttcttttaaacacacacacacagacaaacacataaataatacagggttttttttttgtaattgaagaatggagttgatttgaaaaattgaagctggggtgagctacaatatgattttttaaaaatgagtaaataaggaattgtgaataatggaaagacaagtcaaagccaggaggaagataaataagccttgtggatgtggtcgctagaaaagagctacaaatttggctttatgttttctagcacttagtgttgctagaattttgtgatcaataacattcactttttaatataaaaagagaacaaaatttttagaaacattacagatttctgataagagacctaaaataaatttctctcatctgtcttcttaaagaaggcaccacagtgcaacaaagagtatcctcctataaggccattatcacattccttagtttagggtgttaataagggagatctcaaggggtcaataaatgtaggccattgctttaacccaagaggaaaatttcaagtatcactagacatgctctccaaagaaggatgcttgcaaaatggttcagtggagtatggaacgaaaaatatttgaatttatattcattttccccaactttttaaaatttatatttttgtgtatattttatgagtacagtagtgacataacatataaataaatatctattttgacaacttgtgctaaaaaaatttttgtcagattacatgatcaaaagaaattggagaccactggtctagagaaagggaggcatgagatgttcagacaatttattataaatattatttctcctcattgagcttttggcagtgtttacatatataaataatagagtatgctttttttctaaagtaagtgaagaattgggaatggtacagagtaaggcttttgttccataggggagatagataaatggatccaggagagggtttgtgtgtgtgtagtaaaatacacatgacataaagtttacagttttgatcattttcaagtatacaattctgtggcattgagtatattcacagtgttttacaaccatcaccactatctatttccagaaatttttaattaacccagtggaaaccctgtacccattaagcagtgactctctgttccctcttctcaccagcccccggcaaccagtaatctattttctgtctctgaggattttcctattctggttgtttcatataaatggaatcatttaatatatgaccttggtatcaggcttctctctcttagacacagtgttttgaatattcatccatgacataacatgtatcaatacttcgttgctttttatagctgagtattattccgttgcatgtatataccacattttgtttatccattcatttattgatttgggttgtttccactttttggttattgtgaatagaattgatatagaacgtttgtgtacacctgtctgcaattcttttgggtatatatctaggaatggaaatgctgggccatatggtaattctgtggattagcttattgaggaactgccagactattccatagtacctgcactattttgcattcccatcagcagtgtataagggttcctccaaccctcctccttttttccacagcgactgctttagtttatattcgcaccagcagttcacaagggtttcaattttattgcatccttgccaacacttattttccattttttaatatataaactaaccatcctgttgggtgtgagttagtatcattgtggttttgatttgcatttccctagtgattattcatgttgcacatctttttatgtgcttatttaaccatttgtatatcttcttttgaaaaatgtcttttcaagtcatttggccattttaaatctggctgtttgattttttggtttttgagttgttgggattttctatatattctggatattgatctcttgttagatacatgatctgcaaatattttctcccattttgtaggttgcctctttcacagtcactctgctgaccgtgtcttctgacatatagaagttttaaattttgatgtagtccaatttagctattttttttttgttttttgtgcttttggtgtcatatcttagaaatatttgccaaatccagtgtcgtgaaagttttcttcttaagagtttaataattttagcttttacttttaggtctttgatccattttgagttaatttttgtgtatggtgtaagataagggtccaccttcattcttctgcatgtgaatatcccgttttctcaacatcgtttgttgaaaagactttttttccccattgaatgttcttggcactcttgccaaaaatcgtttagccatatacgtgagggtttttatctgggctctctattctgttagtctatatatctctctttatgccactactgcactgttttgatttactgtgtatttaaaatgagttttgaaagcaggtagtgtgaaacctgtaacttagttcttttttcaaaattattttggctgtttggtttcccttgagatttcatgaattttagtaaatattttattgtttttaatactaccatatgtgcaatttctttcttaatttcatttttggattattcattgctaatgtataggtacataaataatttttacatactgatcttgtatcttgcagctttgctgaatttattaactctttttttgtgtggatttttaaggatctctaggatttcatgttgaggaagttcccttctttttctattttgatgagtgtttttgtcatcaaagcattttggtgtttgccaaattcttcagcatctattgagattactagttttttctttttctttttctttttttttttttgagacagagtttcactcttgttgcccaggctggagtgcaatgacgtgatctcagctcactgcaacctctgcctcctgggttcaaccaattctcctgcttcagcctcccgagtagctgggattacaggtgcctgacaccatgcccagctatttttttggatttttagtagagacagggtttcaccatgttggccaggctggtcttgaacccctgacctcaggtgatccacccccctcagtctccccaaagtgctgggattacaggcatgagccatcgtgcctggcctgtttttttcttttattctgttaatatggtgtatatttattgataatcatattttgaaccaactttacattcctgagataaataccacttgatcataaaattctgttcatatgctgctggattcagtttattagaatttgaagaggactttttacatctatattcacaaggaatatttgtctatagtttctttgtgatatctttactgcctttatatcagggtactactggccttatagaatgagaaagttttcccacctcttggtttttgataatgagtttgagaaggattaatgttaatgattgacgttaattctttaaatgttggtagaattcaccagtaaagccatctggccctgtgtttttctttggggaaattttttttcattactgattcaatgtcttttaagtctatttagattttgtttcttcttgagtcagtttctgtagtttgtgtttctagaaatttgtttatctttttttttaaagtctgtttcatttatctccattgaatctacattattctgcttgctttggatttagtatgtttttttttcttctcatttcttatgattcaaagttaggttattcatttgggattattctttaatgtaggcatttgtagctataaatgtctctttaagccttgcttttgtagataagttctgccttcattgcttgccataagttttggtatgtttgtcttctttttcattcaaaatgtttgctgatttcttctttgaccattgactgtttaggacagtgttgtttaatttctacttgtgaattccccacctttctttgttattgatttctggttttactccattgtgatcagagaatatattttgtattatttcaatccttcatttatgaccttgcatatgatctgtccttgagaattttatgtgcatttaagacgaatgtgtattctgttgctgtttggagtgttctctattgtgttaggtctagctggtttataatgttgttcaagtcctctatttccttatcagtcttttgtccagtttttctatggctatcagaagtggattattgaagtctccagctattactgtggaactatctatttctccattgaaatctgtcagttttttgcttcatatattttagggctctgttgtcagttgtgtgtatgttcataattgttatatcctcttcatggattgatccttttatcagtacaaaatcctctttttgtctcttgtaacaatttttaatgtaaagtctgttttgtctgatattagggtaactaccccagctctcttttgggtaactatttgcatggaataccttttttatccttttaatttctaactctttgtgtctttggatgtaaagtaagtctcttttagacataacatagatggtcattttttataagctattctgccctctctgccttttaattggcgagtataatccatttacatttaatttcataagaaaggacttactttccccgtgctgtttgctttctttatgtcatatcttttttgtttttcatttctactgccttctttgtatctaattgattttttgtagtgtaccagttttattcccttttcattttttttttaacatttcatagttattttcttacgggttacattgaggattacaattaatatcttaaacatgtaacagcctgatatgaaataaaaccaacttagcttcaataatatacaaacactgttgttaatacatctctattcttccccttaactttaataatacacaaaaactgtgggtagacatctccatcccttcctctttaattgttatagtcacagattacatcttcattttgtccccactaaaatagatttataattattttatgcattcgttttttaaatcagataagggaaaagggaagagttacaaaccagaagtataatagggactttatttttacctatgtaattgtcttacccttatttcttatgccttatttctatgtatatgccttaagccttatttctatgtatacttcaaggtattgtcaaatgtcctttcatttcaccttggagtactctctttatcattccttatagggaaggtctacttgtaacaaatttacttttgtttatctgggaatgtctttaatttctcctttattctttttttatttatttttttttttgagacggagtcgtcctgggctgtagtgcaatggcacaatctaagctcactgcaacctccacctcccgggttccagcagttctcctgcctcgacctcccaagtagctgagattacaggtgcctgccaccatgcctgggtaatttttgtgtttttagtagagatggggtttcaccatgttggccaggctggtcttaaactcacgacctcaggtgatccacctgccttgacctcccaaagtgctgggattacaggcatgagccactgtacctggccttcttttttttttctttttaagatggagtctcactctgtcgcccaggctggagtacagtggcgtgatcttggctcactgcaacctccacctcccgggttcaagtgattcttctgcctcagcctcctgagtagctgggattacaggtgcacaccaccacacccagctaatttttgtattttagtagagacgtggtttcaccgtgttggccaggctggtcttgaactcctgacctcaggtgagccacccacctcggcctcccaaagtctcctttattcttaaagttttgctggaggtagatttcttgtcttacactttttatctttcatcatttcaaatatgtcatttcactgcctattgtcttccatggtttctggtgagaaattagcaattaattttaccgaggatcccttctgtgctcgcccttattcttactgctttcaagattctctgtctttggctttgacattttcattataacatgtctcagtgtggctctctttcagtttatcctactaagagttcattgagctacttcgatgtttagattaatgttttccccttatcaagttggaggagtttccaaccattatttctccaaatattccttctgcccctttctttctctcttcttttgggattcctaatatgcatctgttggtaagtttgatggtatcctacaagtctcttaagctctgttcatttttcttcattctgttttctttcattttctatttttttagagtagggtttcacactatcccagactggagtacagtgatgtaatcatagctcactgcggcgtcgaactctgggctcaagaaatctttctgcctcagctttccgagtagctgggactacaaggcatgcaccaccacactcatctcattctgttttctttctgtccctcagagtacgtaatttcatttcacctatcttcacctatcttcaagttcactgatctttcatctgtgtgatcaaatctggtattggactgctctagtgaatttttcattttagctcttgtacttttcagcttcatattttctatttgattcctctttgtcttcattgatattctctttgttgagacattgttctcatttcctttagttctttatccatggtttcctttagctctttgagcacatttaaaacagttgatttaaagcttttgcctagtaagtctactgtgtgttcttcctaagggacaatttctatttatttctctcctctaacccatgaatgggccatactttcttgtttcttttcatgcctcataatgttatgttaaaattttgacattttgaatattatgatgtgataactctggacatcagattttcctccccttctctagggtttgtagttactgcttgttgtaagttaaagttgttggtttatttagtgacttttctaaattatgtttgtaacgactgtactctttgttgttgtgtgatatttctgttcctttagcttagtagctggctacttgtttgatagagattttcttaaatgcctggggccgaaaaaagcaaaagaaaaaagaaaattccccaagtctttgcagattttctgcattcggacactccttcaatgcttagccaggccattcacaactctctgccttagccttgcttcctacttgtactgagcctaaaggtcaaccagtggtgaaagtgtctggtcttctcaggtcttttctgaacatgcatcttgctctgtgcatgcactttctagtttccctggtatacatgggaaattttccaagcccttatgccccaaagattctcagtttttctttcctgcttttagtatgtctattgtttcccttgaactgttaatttttgctccaggcagtagtgccttgttcatttggttttcagtattttcaaggaacattcttcccctataaaactactttttcactctaagagagttatgttaggtgaaactaaggcaggtcccttgtgtcagtccacggctaatactcagacatgtcaaaacaaacacaattccttgggaacaaggtactactccgtgctgtctttgggagcaggtacctacatcaggaccaagggctgccgtctttaagaccaccatgctgggtaaggggatagcagaaggctaagttaaaatgctacaaagttcttctaccttgtgctgatggcctttctcctggtttagcaaacacttggttactataaacctttgactatcttccaaagttcagataaggttggctttgacagttttccgtattttttggtgtttctagagaaggcactttctcccttggaggtctctactctaccatttttgcttgtcgttcccaggtggagttgtgtgtccctctgaccatcaaaataactagagtgacatcaattattttttcttttttttttttttgagacgtagtctctattgcccagcctggagtgcagtggcacaatctcagctcactgcaacctctgcctcctgggttcaagcgattcttctgcctcagcctaccgagtagctgggactacaggtgtgcaccaccatgcttggctaatttttgtattttagtagagacagggtttcaccacgttggtcaggatggtcttgatctcctgacctcgtgatctgtccgccttggcctcccaaaatgctgggattacaggcgtgagccactgtgcccagcctgtgttacatttttaatatctttgcctttgattttacttcatccagtacagttttttttaaatttgcatttgcactattgctctttgcccatccttttagccttttgagtcactttactcaagtgttagtaacatctgaatttaacttttttcccacccaatctgaaggtctctcttttgaaacaaatttattccatttaagtttactgttgtaaatgtttggtttaaattttattattttggctttttttcattctgatgtatttattaaataaaggtgtgttcaactaaatttcatttcaaagtaaggagaggggtgaatttcttgtgcgtggtaaaaaacacataccaaaaaattcccttcttaactgttcttaagtgtacaagtcaataatgttaaatgtattcacactatgttgaaaccaatctccagaactttttcatattgcaaacctgaaactctatacccattgaacaacaactgcccttgtccccgtcccccagctcctggtaaccactattctgcttcctgtttatgaatgattaccttagatacctcatatgagtgtaatcatgcagatttgtctttttgtgactgacttgtttcacttagcataagatcttaaagattcatccatataatccatgtagcatgttataggatttcctccctttttaattctgtatgatattctactgtttacatataccacattttgtttttctgttattcattgatggacatttgggttgtttccaccttttagctatggtaaatagtgctgctgtgaacatgggtatgtaactgtctttttgagaccttgctttcaattctttgggatacatacccagaagaaggattgccagatcatatatagtagttctatttttaactttttgaggagcctcaacactgttttccctagtggttgtgccattttgcaatgccaccaacaatgtacaagggttctaatttctttacatccttaccaacacttgttttttttttttatagtagccatcctcatgggtgtgaggtaatactgttttgatttgcattgctcttatgcttagtgatactgagcatttttttatatgctttttggccatttgtatgtcatctttagagaaatgtctattcaagtccacttttacttttttttttttttagaggtggggtctcactgttttgtccatcctggtctcgagctcctgggctcaagcagtctttccccattgacctccgaaagtgctgggattataggcatgagccaccatacctggcctgcccatcttttagttaggtatttgatttttgttgttgttgttgcgactgctttatattttctgtatgttaaccccttctcagatacatgatttgtaaatattttctcccattcaataggttgtctttcactctgttgattgtgtcccctgatgtacaagtttttaagtttagtgtggtcctgtttgtctatttttgctttcgttgcctgtgattttggtgtaatattcaaaaaattattgccacattgaatgtcatgaagctttttctgtaagagttatatgggtttaggtcttacatttaggtctttaacccattttgagttaatttttgtacatggtataagataagggtccaatttcattcttttgcatgtggatatccagttatccaagcatcatttgaaagctatccttttcccactgagtggtcttggcaccctcgtcaaaaatcatttgaacatatatgcgagagtttatttctgggcatgttttcttatttcattggtctgcttgtttgtctttatactaatatcacactattttgattactgttcctctggtaatatgttttcaaatcaggaagtgtgaatactccaacattgttcttgtctttcaaagttgttttggctattcaggatttcttatcatttttaatgatttcttgctatttccaatcttttttgttgattgctatgtaatgcatgtttcttcgagttggttttttgataacttagcaactatgtaatctaattaactaatatgcttcaaccactttctcaatctgtcagtgtcagatatgaaactatctattggctctattatatgaaaaattaagaaactgattttacttcttcccacctatcccccacataattttccccaactaaccaatagtggttatattttgtgaattttgtctcagctcatttatagtagtagtattactatattgactagcttctgtttcaagaattagaacattttacttacattttataagatcatgagttattttacattagttgtatttaaatatagggtcagtatttaccaggagtcttttcacatacctatttatgagtttgttaatttcaatctgttgtttgactagactgttaaatgttcaggagtgatcatcttttatgttcttgcaaatttgagactattacctttatgtaccagaacaacaactgagttggatataaaagttttgattaacagttcttaattcaaaactgttaattttgctcctcttttctggattaccagtatttaatgtttcatatgcttgcttgctttgtttctttctttattatttccatagtttggagggaacaggtggtttttggttacatggataagttgtttactggtgatttctgagattttggtgcacccatcacctgagcagtatacactgcacctaatgtgtagtcttttattcctcaccccgctcccacccttcccccctaagttcccaaatccattatatcatccttattcctttgtatcctcataacttagctccccgttataaatgagaacatacaatatttgattttccattcctgagttacctcacttagaagaatggtctccaactccacattgctgcaaatgccattattttattcctttttatggctgagtagtattccatggtgtatatgtaccacattttctttatctacacattggttgataggcatttaggctgcttccatgtttttgcaattgcgaatcatgctgctataaacatgcatgtgcaagtatctttttcatataatgacatattttcctctgggaagatacccagtagtgggactgctggatcaaatggtagttctacttttagttctttaagggatctccatactgttttgcataatggttatactagtttacattcccaccagcagtgtaaaaatattcccttttcaccacgtccacaccaacatctatttttattttttatttttttatttatggccattcttgcaggagtaatgtggtatctcattgtggttttaatttgcatttcccttacaattaatgatgatgagctttttttttttttttttttgagacagagtctcactctgttgcccaggctagagtgcagtggcatggtcttggctcactgcaacctctgcttcccaggttcaagagattcttctgcctcagcctcccaagtagctgggattacaggcaggtgccaccacgtctggctaatttttttgtatttttagtagagatggggtttcactgtctgagccaggatggtcttgatctcctgacctcgtgatctgcctacctcagcctcccaaagtgctgggattacaggcataagccaccacgcctggccgatgatgatcatttttgcatacacttcttggcctttttttttttttttccccgagacggagtctcgctcttgttgccctggctggagtacaatggcacaatctccactcactgcaaccactgcatcccgggttcaagcagttcttctgcctcagcctctggagtagccgggattacaggtgcctaccaccacgcctggccaattttttgtatttttagtatttaattttttgtatttgtattttgtattttagtagtggtttcaccatgttggccaggctgatcttgaactcctgacctcaagtgatccacctgcctcggcctcccaagatgctgggattacagacatgaaccatcgcacctagcccatttgtatatcttcttttgagaattgtctattcttgtcctttgcccactttttgttgggattatttgttcttttcttgatttgtttgagttccttgtagattctgcatattagtccgttgtcggatgcatggtttgcaaatagtttctcccattttgtgggttgtttgctgattatttcttttgatgtgcagggcccatctatttatttttgttttttgttgcatttacttttgggttcttggtcgtgagctctttgcctaagtcaatgtctacaagagtttttccagtgttatcttacagaattgttatggtttcaggtcttagatttaagtctttaatccatcttgagttaatttttttgtaagggtgagagatgaggatccagtttcattctcctatatgtggcttgctaattatcccaggaccatttgttgaatagggtgtcctttccttactttatatttttgtttgctttgtcaaagatcagttggctgtaagtatttggctttatttctgggttctgtgttctgttccattggtcttggtgcctatttttataccagtaccatgctgttttgttaactatacccttgtagtatagtttgaagtcaggtaataaggaggcctccaggtttgttctttttgcttagtcatgcttcggctgtgtgtgctgttttttggttccatatgaattttaggattgttttttctagttctgcaaagaatgatgatggtattttgatggaaattgcattgaatatgtagattgcttttggcaatatggtcattttcacaatattaattctagccatccatgagcatgggataggtttccatttgtttgtgtcatcaatgatttctttcagcagtgtgtttctcattttccttgtagagatctttcacctccttggttaggtatattcctaaggttttgtgtttttttttgtttgtttgtttatttgtttgttttgcagttgttgtaaaagggattgagttcttgatttgtttctcagcttggtctttgttggtgcatagcagtgctactgatttgtgtacattgattttgtatcctgtaactttactgaattcatgtgtcagatctaggaactttttgaatgagtctttaggattttctaggtatacagtcatatcatcggtgaacagtgacagtttgacttcctatttacctgcttgggtgctctttatttttttctcttgtctgattgctttagctaggacttcgagtacagtgttgaatagcagggatgaaagtgggcattcttgtcttgttccagttctcaggggaaatccttttaaccttttccccattcagtataattttggtgtgggtttgccatagatggcttttattaccttaaggtatgtcctttctatgccgattttgctgagggttttaattataaagtgatgctgaattttgccagatgctttttctgcatcttttgagatgatcatgtgatttttattttaaattctgtttatgtggtgtatcacatttattgacttgtgcatgttaagccatccctgcatccctggtatgaaacccacttgaccatggtggattatctttttgatatgctgttggatttggttagctggtattttgttgaggacttttgcatctgtgttcatcagggatattggtcttttggttctttgaaaagataaacaaaattggtagaccattagtgagattaaccaagaaaagaagagagaagatccaagtaaactcaattagaaacaaaatgggagatattacaaccaataccacagaaatacaaaagatcattcaaagctattatgaaaacctttacatgtacaaactagaaaatctagaggagatgattaaattcctggaaatatacaacccttctatattaaatcaggaagaaataggaactccgaacagaccaataacaagtagtgagattgaaacagtaatttaaaaaactgctaacaaaaaaaagtccaggaccagatggattcacagctgaattctatcagacattcaaagaagaattggtacaaatcctactgaaacaattccaaaagataaagagggaatcctccttaaatcattatgtgaaaccagtatcaccctaataccaaaaccaggaagggacataacaaagaaactgttgactcgctctttctgtgtttctctctgccccgtgctgtctcccctgcagtctctgcagtccaggccctcttctctctctatgatctctttgcactctgtctgtttctctgttctgtctgcctctgctcacccacacgtgcacttgtgccccacatgccccaccctcgttctctctggttcccactgtgtctgttgtgtgtctctattcttcttctgattactctttcctcccccacccttatctctttaatgttattgctatgtttgtctctgtgctttctctgtgtgttttcactctttttctttcctgtctcccttctgcagttctgtttcttggtgtctggttgtcttctggtgggggagaagggatagtttactattgtcagtacaaaaagtgaagaaaaaaggtcattcagtagttttcctttatgaagaaaaagctgaagatggtgaatgatttctctgtattttagatctctccttatttatattagctcatgtttccagcaggtgggcaaataaacaacacaagcaaactaccaaacagagagacctccatgagaaaagaaaatgagagctttatgtccaactaaatgtttattaatgtttcatatatttttgtaaaatggagttcatatcagactttacatgcctatatacgaagagaaattacactcaaaagcagcatcctgaaatccaaagcgtaaatttttttatacgtttacagagaaagagttaagatataaaactatgtatacatattataatccaaatatacatacctatgtgtatatatatatacgtatacatatcagtatcaccggaacaaaatatatgtcatacatagaacaaaaaactgaaattattataaaaatatgaattatgattttttcttttatatttttgtctattttttacaagaattatgttctaatgagaaaccataaaagttgtttttgtttaacaataatagaataaggtaagccagattgataaacacaaaatgttagttataagcttagaaggtgaattcccaaatttctcattgacttctattttgggtgtaaaagaccattttgagcttcccaaactagtcataatgaacccttctagaagtatagtgaaataataggattagagaactagtatacatggtttctgtgtcatgataaagtacagttttcttttaacttccagtgccaagggttgagttaaatgtactcctcagttcatgacccctctttttaaaattttatcaccatatgccatcctcatttctgtctccccataggaaaccagtcttatgtaaatatctttcaggttacatgagttcttacaaaatacatattttttaagtatgcatgaactttcatcatatataaaaggtgtaccattatttttgttatgttggctaagttttgtattttcaaagtctgcctacattgctgtaagtatatatctacattgctgtaagtatatctaatcacataatgctccatggagtgcatctacccacttacgcatgaacacccaggagcacccaggttcctgtcagttccccagcaccacagaacatggcagtgctgtctttgtccatgtccccttatgcgtctgtctgaaactgtctttagcatatatacccagaagtggaattcttggcttacaggctcgtatacttaatttcctacattagtaccaaattgctttccagttcatattcctacctgcagtgcatgaaaatttccatttctacttctctgccaattatttctaatttttatcagaacactagtaaaacaagtttctataccatgggaagataggtgttttttttttttctttttaatgagatgatacttgtcttgaacatctagagtatctctttaatttccgtgggaagagagtttttcatataatttacagtgctttcaaccagaatacattcgtttgttcattcatccaaacataattatagaattgacaaaagcacagagtgacatactttaataagcttttctcagatttatatatatgagtgagaaaatatatggaaaatttttataacaatatttaaaaacttgatttaaatatctggtaaaacttcattgtcaaaacacagcatccacatttgttccaaatacccatggaatatttacaaaattaattgtacgttagacaaaatattgatgaattctcaaagcagaagttttataagtaagcccatattctgtaactgtaatgcagtaaaattgaacttaacaactataatttttaattttgctaatgctttaaattgcatttctattaggtttcagatttgccatttacatttcttactttgagaattacctttgtgtatcctttgcctgtttttctctgaaggtttttttcctattcatttttgtaaacatatttggagaccactgtagttgctgtttttttaaattctgttttattacttttttttttttttttttttttgagatgtctcgctctgtcacccaggctggagtgcagtggaaagatctcggctcactgcaacctccaccttgcgggttcaagcgattttcctgcctcagcctcctgagtagttgggattacaggtgcgcaccaccacgcctgactaatttttttgtatttttagtagagacggggtttcaccatgttggtcaggctggtctgaaactcctgaccttgtgatctgcccacagcctcccaaagtgctggaattacaggcgtgagccaccgcgcccggccccttttttttcttttttagagatgtggtcttgctatgttgcccaggctgatctcaaactcctggcctcaaccaatcttcccacctaagccttctgagtagctgggactacaggcatgtgccactgtgcctggcttcctattgatttttaagcttaattacattgtgttaatattggaataaataatattgttatgtatttctttatttctgtgttcatgctaaaaaagatcttccaacctcaagatttgtttttaaaaaattatcctgctttacttttgatactttttgagggatatggaagctttaagctttaatttaagcttaagcttttaatctacatggaatttatttttgtgtgtataggtataaatttatttccaaatggtagctagttgccaataaagatttttaaataaagtaatgtcaataaattaatttattagaaaaatctaatgttcttttgttaagctagactccaatcagttagaattggtaaataattggcatggttcttttgaaatttccgttcaaaacaactgaaataacatatggacaccttataaaaattgacagacctgaagaggaaattaattctgactgaaacatgaaggagttttatttattaaacttgaagttggatcagatcatccaagtgaaaatatctaacaagctagatggatctgaccccatgaggatatcatgagtgagatgaagattttagagtcatccatgtaaaggtggtggtaattcttatagttattaaagccaagaggaaacatatttgggagaatgcaaagaataaataaatgtatagggctacttccaggctgtagtttttcaaagctgatagaaaaacctttgggaaacatgctgtctcgctctatcaccctctacaaaattgtatgatcatttgtcaaccttctggttttcctgtgagttaattgagtgttttagctcttgattcattttctttctgtccaacccaaagccctaccattatctgggaaattttattatcccattagagttttttttaccttagttgtaatgatcattgactgtaataatttccactgcattttagccatacattctcttaactattgtttgaattttggattcactcaaaattatttgttctctgcaatctttacttcttcacataccaaaataaatttttcaagaacctgttatgcaggcacagtacattgttaattttctgaggaagattttccatagttttctgatcaaccacactggcagaaatagataactagttctaatttccaaaaggtaagtaatagatagttaccacctgagtttctgcttctgcaaccttttttcactaggaattaaatgtatgtcacagcattattttttggacagacacttggtcattgtgtcaccccttggtgatgagtaaattttattgaaaatatacttgctgtttgattgacacagttctataaacttttcacaagaaaagacagtcttttggtgccatagactatatttctcattttgactctgactgttttatcaatgtgtgtctctggtcctaagcctgagtgattataaatgaattagcgtaaacccatgcctctaaaggaaaagcatctcccagcaggcacctggctagctgaaggccagcagtaccaatcctcctgcctgaagaatagcagtgtagggtcatatcagaaaacatggcccttttcctatgttggatatgtttttctaagatcagtttccacctaacaagtaattttttaattgaaaagcttttatttctaggtctgtctcatgtctttaataaatacgggaatgagtctcatttagttcttaagctaaagagtactacaaaaaccctgaaacatctctgagatggtacatttactttccattgttactcttgtataagacagcaacaggtgagtttgctctcatagtggaaattaaaacagaagcagccagccagcatatatttccttccaagattgtgtacaagagaaagcctaacccatggtggctgataatgccatttaatatatagtcacctaaatctttatgtgtcagctccattgcagaggactcagtgggctactccacacccaagcctgagggatgaggagatcattagaggagatgcgtgggactctcccacggactaaggaaagtgaactgttttggtttactgaccgcatatataaatggattcaggaaaaaaaaaaaaaaaaagttccatcccatgatgggtcctcagcacaaattgtgggacatgagtgcagatgtgtgcattgtgattattgtgaatccgtggatggattcaacatcacatggcacggttctgacagtttgtgcttggcccagctttagagtagtgctccatcactcctatagcatccagtgcccacctttttttaggattgtttgttgtttattacatgaaggcaacactgtttatcactttccaaggttgatctttttctgatttcggtaacataggagatgcagaactatagagtataaccttttttctccaaacaagacttcatagtccacatttttttcagttggcatacaataaataagtgcattttatgcctttcttgacatattttccatgccgtaaactttacctgtttaaagtgtacagtttaatgggtcttgatttagtcacagaattgtgcaaccatcaccgtattctgattttagaatattttaaacaccctccaaaaaaatcctgtaaacattaacaatcaatcttcatttccccagcctcccacctctgccacagcctgcaggcaaccactaatgactttctgtttctatggatttgcctattctggacctttcatataaatggaatcacagtctttcgtgactgacttcattcacttaacatagtattttcaaggttcgtacacctcatagcatgtgctcattccttttaatggccaaaggacattccattctatgaatataccacattgtatctattcatcagttcatggacatttgtgttgtttctgttttttgtctattatgaacaaaactgctatgaatattcatgtagaagtttttttgagggcatatgttttcatttctcttgggtatatacctaggagtggaattaatcatatgacaactctatgtttaaccatttgaggaactgccagacttttccaaaatgactgcaccattttacattcccaccagcagtatgtgagggttccaatttttccacatcctagtgaacagttgtttttgtctctgtctttgattgtcatcttcctactgggctggataattatattgggttgagagagaatttattcttagacttttctatttttaaatgtttacctttttataggcaagcattactaaatgaaaaagaatttgaaatgaaaacggaaacattccaaggctcctcatataatccagtgtaattgtgtgttttttcacaccctgtggtgcacaccatgactacttgtgtcctttggaagtgcaggatgttcacagaacctcagacttggaagggaccactggagtcctgtgaatcctacccactcccatcaacacttctgctgcatctgcaccaaatgacaggccaccctctaatagctccacctctcacgtgctacttatggggcagccagttccatttgcctaaggcttcagttatcaaaggctttaacttaaatccaatatctccttgcattggaatacctggctctgctcccagagctgctctctgaaggcacaggaaacagacctagccctctgcctctcggacccccacctcctttcctgatgtgttttttctcaggtcttcactccatgaaccgttccacatgggctgtggtatctactctcctttctgagtttggcagctttcctgggtataagtttgttggtatcttgtttttaaatatgtccctctcagctaagcttgttgtgcttcaggtagtgagagcgtattgaccaacacaacttaccaccttccattcagtgactggaccatgtctgtggcctaacgtatgttattccttttgaactccttaaatcttttctgccacacccttccccacaagtttttgtttattctcatttcttgaactggtaatacagtacaaccacatgatacaaaatatttgatcaagagtgtccttcctactcctgttccccagcacccagccctccttcgcagaggtatacaataaaatttcatccattttaagtgtacagttaacttttagtaaatttacagagttttgcaatcatcaccaaaatccagttttagaacatttctgtcgttaccaaaaggtgcccttgtacctctttgcagtcaatccttgttcccagccccaggcaacctctcatctgccttctgtctcttctggagattttatgtatatagcatcagatgtggtcttttgcatctgcctttttttgttaacatcatgatttcaaggttcatccgtgctgtagtatgcatcagtggttcctttttgttgctgaatagtgttccattttatggatataccacattttgcttatctttcagttgatggacatttggattgtttgatttttttggatgtgaatgctgctattaatacttctgtaaaagttttgtgtgggcatacattttcatttcttctgggtttttactcaggagtgaaattggtaggtcatatgataggtttatgtttaactttatcagaaattgcctaagtgttttccagagtggctgtatcattttacattctcgcctgcaatgtgtgagggtttcggtttctccacttccttgtcaacacttgctattgtccacctttttatttatagccattctagtgggtgtgaagtggtatcttattgtgagtttaatttgaatttccctaatgactgatgatgttgaacattttgtgtgcttattggccactcttacatcttctttgatgaagtgtctttttaaatctttttgcccattttaaaattaggttatcttcctactgagttgaaagagctctctatatactctggttacaagtcctttatcagatgtattttttgtaagtaacttctcccaggctgtggcttttgaattgcaaatggttttaatacagtaatgatgaagtcccatttaaactgtttgtcttttatggattgtggattgtacttggggtgttatattcaagaactgtttgcctaaccaaagtcatagagatattctcctatgtttttcattaaaagtttattgttttaattattatgtttaggtctgaaatccatttttagtgcattttttgtgtacggtgtgttgtctaacttcatctctttgcatagggatatttaattgtcccagcatcatttgttcaaaagagtattattttctccaattagttgctttggcccttttgttgaacactaattgatcacatatgtaaggcttcatttggaattttcattctgttccattgatatgtctgtatctttttttttttttttttcttaagacggagtctcactctgtcatcaaggcgggagtgcagtggcacaatctcggcacactgcaacctttgcctcctgggttcaagcgattcttctgcttcagccttccgagtagctggaactacaggtgcgtgccaccacacccagctaatttttgtatttttagtagagaccgggtttcaccatattggccaggctggtctcgaactcctgagtttgtcatctgcctgccttggcctcccaaagtgctgggattacatgcatgagtcactgtgcctggccaatctagatctgtccttatatcaatgccacaatgccttgattgctgtaactttataagatttgaaatcaggaaatataagccctctacctctttttttttttttttttttcttttttttttttcagtaactttggcccttgtggtccttgccatttctatataaagttgagatcattttgtagatttcttgaaaaatgcttgctggaattttgatagagattgtgtagaatcaacagattaatttggggattattgccatcctaacaattttgagacttccaatccatgtatggtgagtgtctcaccatttatattgacttctgatgtctcccagcaatgttttctagtttttaatgtgcaaaccttgcacttcttttgttaactttattcctaaatattttattctttttgatgctattgtgagtgagatagttttcttaattttattttcaggttgtcacttgctagaatgtagatatacaattgatttttttatcttattgatcttatattctgcaacctgggtaaccttggttattagttctagttctttgaggattccttagtattttctacaaagaaaatcatgtcatttgtaaataaaaccagttttacctcttcctttcaatctggattcttttctttcagagacattttataaataaaaaagcaaacacctacatatacttttttagtacctaacatgctttcttccccttttttatagctgcagagaaggtataatgtatttcatatcagtcacttcttttttatgttcccttttttaaggagaaaataaaaatatattttttaacatcattttagtctctagttttatatcagtgttttatattttaccatctaaatcatctgttatttctaaaatgcagatttcgtttccttttctagatggggaaactgacacaaagaggttatggcttgcctaaatagagaccgctaataaagggaagacctgaaactggcctagctgtttggaatcctgacacagagcttttttttttttttccctgcatcaaagttgctgccattcctcctgcctaatgagcaggactttacaattgcccctactaaacatgctctgatttagcccatcattcctgttattatttgggatcctgacagaggccctctctctgatgagtattgtatgtaaattctcctgctttccatatctaagacatttatgtctaaaatcttaagaaggaatagccagcaccaaacccagtgattgcacacagtaattgcttagtaaatatttgttgtcaaatgcaagatgtaccactcagtaaagacatctgttttgaaattatatttggataaggttggttcaatcagttatgattctatcaacttgtattatcatccaacccatataactccatcttgccctcaaagatgctattaaatgttttggcattttgttcaaatctaggtatggtatgctatgtattcttttggttagccagtaaagtgaccttatgtactagagaaaacaaggctaacctggcagggcatgctctgcctgcctgactgagcctggcttaaatctgctcatcttttttttcaccagttccttgcaaattatctgattcgtgatgcatcctaaattttacatgtcatcagtgttcagcccactagtttgcaatgcctacctttccgaaaatcaaagtatttcctttcttcaagtgtctaacatagatcttcctccccaaaattctgttacaagtttctttgtgactctggaatatggtttatctagttcaagggatcagatatgctcagtttcctatccttaccctggctttaatttacctccaccagacctgcctaagtagaaaattccctaacatttgttcaaaatatagattaccagacccctcccctagagattccaattcattattctgggttagcctccctctgtccttattaacgatggagatattaacaatgaacaagtttaagaagcactattttacactatagtatttgttcagctatatcttgttaatcattttgtcatccaccgacattccaccatcagctgcaatccctgaaattgccttcattgctctacttgctctgaacgtaatttaaaaggcctttgggactctctaatactttttgcaatgctctactcatcaggacgtctcacgagccttgtaggtctttggtgtttgtcttagtatacgtgtttgagtcagctcttaattggagagcgctctcttcagttcatcactctttttagctatctccaggcctctttatctcacatgaaaattatgtgcaggtgtcacttcagaatttcattctgaagatgcatcagactaatgtttggctagcattctcttcagagtttttccaagcccagtgaaaatagccaggcttttttttgtcttaccaccttataacagcttaagtcctatccacctacaacattctccctatcacagatacaaggcagcaagttcacagtatctcaagcttcctccaaatgcatctcaacagtttgaattggattagaaagaggacttgttggcttgcttatcctgtggataactgtgacattgactgcaggtaataataacaagatctcttttatttttctaggtagcaaaccatgtgatttcttctgactctatttcctcttctgccagtagtttcctgagctcaaactctactttttgcaacaagcagaatgtacacatgttaaacaagggcatacaagcaggtaattacttgaatctaaactttttcattgaaatacattgaaatggctcttaaacatgtaagatactcaacctcaatcataataaaggacatgaagataaaactatatccaactgccaattttcatcttgtcagattggcataaattcaagtttgatggcaagtttgtgggcaagagtgtagggaagcgggttcccttgtatatttcagtgggagtagaagttgattcactgtgaaaggcaatttgaaagttcctatcaaaattactttcactcagcatttttacttttgaaatgtctgctatagatatactatgaatatgtggaatttaacctatagatatacttgcatatgtgcaaaatagtgtacaaaattaaccactaaaacattgtttatagcaggagattaaagtgaatttaggtgttcctcagtagctgaatgattacataaagtattgtatgtctagatagtgaatgaaattctacatagaatgaggaagctctctctgtactaacatggaaagatttccaaggcatgtaattgattttaagaaaaggtacagaacagtgtatagcatactacaatatgaattttttttaataaaagaaagaaaggagggaagagaattgcttaaatgtgcaaaacgaattctctggaaccatatggggttgtgaacagaataaatggagaccagaagtgggaaggaggatttttagctattgcctttctataccttttggtttcataaaataaaaataaataaactttcatcttgatttgtttcttcccctcaaatcctgtcttctgtcagcctcttccttacctgcgtgactaccaaaaggactcttaagtatttattgtctttctaacttgggatcagagttgaaatcctttaccctttgaacccatattcattcttctttccctctcatacctaaaatgagttacaaataaaaccctttcttttttctttgccctctttttccctcctactctcccctgtccttctttctcttcctctctcttcgcatccctccatcccacacaaagggattgtatttttgaaacattaaaaagggttcacgtactcacttgaataaatctgtcaactcagcctcaaggttactcccagagacacctatgatccttcccctcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggtcagtttctcattccagatcttgtagtagagaaactagtgaatttcaagtcccctgcgatgctgactctgtgtttccaagtgactctatgtggtccccacctacccccagccacaaccttgtcaggttttcagagtccagcatggcagttacacagtcatccctgcagcaaaaccagactcaagggcaccctgtggcctctgacagctgagacccctgagaacctgtattatatgcatatcctggataagagctgggtggggctgtaaaaaagtgaaaaatctgtgttccttctaaaaaccgtttcctgtaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaagccatttgtgagagcaacccttcaggtgcagtgacgttgacttaactttaatgctacgtgtagggagaagaagggcaaggcgcagagaagctggctctgtgacttggtgagctgaggtgtaggcctgagacgctcttttccagcacctccgcagttcacctgttttcacgcacgagggttgggtttctcatcatctgtcaaaggctgccttactcctaaccatagatggtgcatcaccgtcgggatctggggacaaggccgcaggagggaggatttgcatctctgcttattgggcctgtgggtccctgtgtgtggagggcccggaggcctgacgcttgtgcggcctcatgtgtgttcctccatgtccgtagctcctgtttctgctccatgtcggatttaaaggaaaccaggtctcttctgatgtgtcccttgggggataaaggaaatgttattaatgatgtatttgtctgaatagatctttaaaatagcactgtgggaagagctgtattgcactgacatttcaaagagttgtaatcgccatagtcttagttcctggcctatgctgaaggcatgtctttgatccctgcggtttccaagctgcagctctcccccatagagagatgtcagaggattcttcaacgctagatactttctcggcatttgaatcagacttccccaaacctcttgggcaggtggtgtgtctccaggcatatggagagtagattgcatcattaatctgaggctgggcattttctcttttttttttcttttaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagaggtacgccctgcccgttcactttcctgtgagtggaatagagaaggcaaggtctgctgctctgctgcagagccctgctaaaggccagcccaggccagttacctgggcagacagtgaccttttgcttgccaagactcaaaccttcttagctagcagaatctccccaacttagccgtcagcacattcatgatccaagtaagcccagttactctaagccctgtcactgcatcgtaaaccagctctgtgtctgtgagcaagttagttccaaaagtatattgatttttcctgaaaagatggggctgattccaggcttgcctacctcttaggatggtaataataataataataaacacatagtccttacatcttgcccaggcactgttcacattagcgcttacagcactctcagtaggtactattaatatatctactttatagtgagaaaactgaatcaaagggagattaagtacctctcccaagatgacatacctagtaagtaaaagctaagatttgaacccaggtgtgctcctctggagtctgcattcttaacaattatgataagcagatcttgataaaataatgaaagctgtgaaaactacaaagcactacctaattcttttatccaactttagaaaccggccagatttttaattcaaagcctagtctttgctacagagtgttaggtccttagggccttaggctgctgtccctgttaccctagtcttacactggcttgccttggtcattgctccccactcagtcttgccagctcagggtaggggcaccaagtcctagcagctccctctcccagctcttgcaccacaccctctgggttaagtcactgtccactgaaaaccctttcttctcttgcctagtcttcctggctatccagaagaacaagcctatcagcaagaaggaaatgattcagaggtccaaacggtaagaccaagaaaacaagagtacgtatacaagtgtaaaccaggccaccaagtggtcgggagctctggcttgcacccagaataaatgtattatactcaagtttaaacattatgagaaagttgtgagagtcatttctcacttatggcactgaaaaaaaaaaaagcacatcatggtatgaatgactcatatgcaaaagatgaaaaacttctcactaatttgcatgtcttaggctcctctttattagaaacctaaatgtaaataaagaatattttaggccaggtacggtggctcatgcctgtaatcccagcacttagggaggccgaggtgtgcagatcacatgaggttaggagttcgagaccagcctggccaacatggtgaaactccatctctactcaaaatacaaaaattagctgggtgtggaggcacacgcctgtaatcccagctactcagtaggctgagccgggaggatctcttgaacctgggaggcagaggttgcagtgagcttagatggtgccactgtactccagtctgggcgacagaacgagactccatctcaaaaaaattaaaaaaaaagattattttgaaataaaattaaatatgtatttagaccacatcttttattctagcaatcccatttctaggaattgatcccatagggtgagaaagaacagtgttctccagaacacagtaagttaaacttttttaaaagattaaaatttcgaagcatgtgaacactgtttccatttgtggtctttaaaaataagtatttgtgcctatgtagatgtgtgtacttttatatgcatagaatatttctggaagacagaaaaaactggtaatactgattgcctttggaaaggataacagtagattttttgactttttataatttttgaattttgtgccatgatgaacgaacattagctacttgttaattaattcatttgagtgttgaatgtggtggtacatttctgtaatcctacctactcaggagtcttaggtgagagaatctcttaagcccaggaatttgagactgcagtgagctgtgatcacaccattacgctccggcctgggtaacagactgaaactctgtattcaaaaaataataaatacaatttttaaaaattaattcatttcagatattcatatattgatcatgagaatgccagagaataaggttgacttttttaggcattcattggacacttgctttaataagaatagtttcttagttggcataatgcttctgaagtaatggtactttaaaataatttatctcatgaactttaagcattcctcttgaaatcttgtttttactctatctagtcagcccttataggcaatccaaagggatgctttggatgctttagtccagtggttctcagagagtggtctgtggagtcctggaagttgctgagaccctttcaggcaatttgcaagctcaaaactaatttcagaatgacaccaggatgttctgtgccttttttgctgtgttggctatttgcactgatgatgcaagagaaatggggaggagtaaaatcactggtgtcttaccactattcaagacagtggcaccaaactgtagtagtctagtaggcattgtatcctgcacagcctcccgccaggagtgtgatggaagaacaaggaagcagtgtaaatggaggtacacgggaagcacttcctttgcaccgtgaaagatgatgactgttttcaaggaaaagcacttatgccatggtttgtgtcgtgagctgaaccagctgcctttgtcatggaacatgacttttaattgaaagagtaactgacagaaaaccaattattctgacttgtgtttgtagcagacattttcttgaaaatgaagaagtgggtctgtgacttcaggaaaatgtctgacagtatctgttgccaaagaaaatgtgagttttcaagccaacaatagaaatctagaaaacttgtattcacctccatgggcttgatgacctcttagtacttagacctttctgacgagataagcggtggcattaacaaatgtgacgtttttcatgttatctaaatacatttgtcaacatttggaagatctgcacaactccctggaccaggattttccaaatgattgttgctttttgttacaaaatcagggaatagatagaagattcattcaaataatgaaagatagactgatggatttttatgtaacagaataggaaaagtttatgacatgttttcagattccaccttgcaactaatttttaagaagctaccacttgtcagccaggcacagtggctcacgcctataatcccaacactttgggagtccaaggtgggcagatcacttgaggtcaggagttcaagcctggccaacatggtgaaagacttctctactaaaactacaaaaattagctgggcatggtggtgggtacctgtaatcccagctactctggaggctgaggcaggagaattgcctgagcctgggaggcagaggttgcagtgagccaagatcgcgccactgcacaccagcctgggcaacaagtgcgaaactctgtctcaaaaaaaaaaaaagaaagaaaagaaactatcacttatcaagtttgggtgtagtatcaaagaagatcaagagttacctgaaaagagtattgcagtaacttctctcgtttccaagtacgtggaaaatctatatgtaagctggattttttaatgtatactttaaccagagcaggttgggacagcagacttaatacagaagcagatacaagtccagctgtcttccattaaaccagacattaaagagttttctaaaaaatgtaaacagtgccactcttctcactaacatttttttgttttcaaaaagtctttatttcccattaaaaatacaggtttcttatgttagcctgtcacaggcttattgttatttcaagtgaataaaaaaataaagttttgcttaatttttaattttaatttttgatacagtatcaatagataaaacctacattgggatcttcagcatttgggagtgtgaagggggccctaagtctaaaatatttttgaaccactgcttcattctaactcagtcacaaaatggaattaggggaaatcatacagggtttgttgtggggcagctactaatactctcacctcagcaagagcagtccctgctgtaagggactaggaagcttgcctacaggaagacagccaggacatctcctaaaatgtatcaatgctttcgacgagaaatatatgagtggatttagtgcccatcttctggagagactttttaaactgtttttaaactggtacattttcattaggttgcttctgttcatgtttatttcttgtgtggcctcttttcaagggagtgatctgtttccatctgagaatcttcaatatcatctagtaactcttaatatttaggaaactacaacccagagaggggaagtaacccagcaagttagggtcacagctggagttagagcctggtgtttggccttcaattgtgtcctattaaggatttgtgtctctggagcctgtgttactcatcttttgttatcacctatctctaccaaagatatttaaaggttcccgtgagaaggaaagatttcaagaggaaagaacagagctcttttatttggaagcacttgttccagagtggccttcaggagacatcttcaccttctctaatgtgtttcccgcagagccctccatgaatctagtgattttttttccagattatagaaaactttaggaaatatagagaaaagtagaaaaaagaaaatgaatatcacttatcatccttccatctaatggaggatgggaatttttggtgggaggcgtgggaattttgcagagacctgcataacacacacttttttccctcaaattgttaatcatactgcatatacaggtttgtgtcttgctttattttattcaacattatgttgtgaacctttcctatgacactaaaaattctgaaacttttgtttggtatacatgaaacatacttgtaacatatacattccattatacttcataatctatttaactgttgttttgttggaaacgtatttacaatgagagtgcatttatcaaatgcacatttgtgtttctcccaacttaaaatcattgccacccaacccctgctagaacagatcccatgtttttcacatggccacaagatcctctctgcagcccacctcaccctcacccccatctgtttcccacctattcctttacgctcctttttgggaagcctcgagtccatttttaccaacactcattttccccaccttgagtgtcttctgtccttctccccattccctttctgctcttatccatcattattatttttttattattattattatttttgagatggagtctcactttatcacccagctgtagtgcagcagtggcttgatcttggctcagtgcaacctctgccacccaggttcaagcgattctcctgcctcagcctcctgagtagctgagattacaggcatctgccaccatgcccacctaattttttttttttttttttggtgtgtgtggttttagtagagacgggctttcaccatcttggccaggctgctcttgaactcctgacctcgtgatccacccacctcagcctcccaaagtgctgggtttacaggcttcagccactgcacccagcgctcctatctattcttaagacccaacttacctataatttcctctctggagcctttccgaacctccttccaccagaccaagtttcttctcctctagaacattttataggtgtgaccattttagtacttttccataatttcacttgtgtttccaaacacaatagtaacgctgttcattatcttatattgaaacagtccatttttgcatgtagagcagaaagtagaagttcagctctccttcatttatctcactcctttcccccctttatcccacttctttccacatgtaagcactattaggattttattgtgtttgtatttatctccccttccagattgtgagccccgggctagggttttctgtgctggagtatctaacggggcccagggcctttctgagagggatgagctcctggagagtgggaggtatagggagggatgatgagaggagatctcatgactctgcaccctggtaacctccccgatttctgtcctttcactggtgccatttctaaggatttatgagcagcttccagaagtacagaaaaagagagaagaagagaagagaaaatcagaatataagtcataccggctgcgagcccagctatataaaaaggtcagtgggtcctctgtctagagtgggatggatcaggtttattggcggaaagagaaatggagaaaacacgttgcctgttgagtgtgaagtcagaatgaaccgcatttgaggaatgaacttagaatgcactggaccagtgttgaaatttggaagaaggcatctgtaattagacttcaaatcaggtttaactccccatccataatggtgtaaggccctttccatgcattcgtttgcagtgaaaccaaatttcacacacaggagttcattgacatatcatggtagaaataccagaattatcaggtttccattccagagtcccaggtggtgatttcatgcccctcattggtgagtcagatacctttagaactgttaaactggaaaatgtgtaactgcggcataagagttgtccacttggatggtcagaggcctccaacttgtcaccatgccctgcccattgtcccagtagagtcagcgttgctgcaagtccaagaacctcacggggcagggttggtgttaccagttaattctctgagaaaccagaccggctcctatgcctgaagggccatatacttcactgtagttgtttccttctcaccctgtcagtcaccagactgatgtgggatgggagctgcttctggagcaggccccagaacccaggcgggtgcctcaggtggaggccccaggcaccacaccacctgtctggtgtgtcagcatcgcagggccaggcctctccttatgctactgtatgtgggaactgatggattatctgtgtctctatagaaataatagatattgattacagatcctctttcctgaacctttcgtgaagtattttttatatgacgaccatagtttctgaagcagagtaaaatgaacaagatttgaataggaccacactgattctccttggtgacatggatgcagggaggagaggcatctgcctctgatggcagtaatatctaacttctttcctgcctttcttttcttctacagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactcatagtaaacaattctttcccatctggagagatgcaaggagctatgcattgtctccaccgaggtgtctaaatgcatcagttgagggaaatgggctcttagaaggaaatgtagcctgtatctttagaaacacaatgtgctgtagtgggagcactgttgtgggctttgaggagacggtgtctggttagatgcccaccgggtgcacccagagactgcagcaggagaggtgtcttgggtccagagcctcctttcagccccagtccagctcccccagggactctctgtgtaggctggggagaaaggccactagccttggctgatggatcttcctccacccacactcggttttgggattaaagcctcagaccatttatcattacacgtgaaaccaacacttacaacataaaggacaacttgtgaaaaagatgagtcaatgaatgagataaagcatttaacccagtaactggatcagaatgtaacaggattttttttttttttttcatgtggcctggaattatagctaaggcccaaagtaatggaggaaggttttcaacagcctcactctaagttcagcaaaccccagtacaaagattggcaagggccagtcatccaccgagaaggcttcctgggaggctggatccaagagcaggccctgccctcaagcacggttcagagctttcagatcctgccccctgggctccctgccatgaagaggacactgggaaaagaacccatggtgcatgaggtcaactcatagttcttccctttcttgctgggcaaggtaatgaagcacttttggccaatttacctgtaaaatgagagggttaatacctctaagcccctctttacataaactctaaaacaatgtgactatttccacctcttgtgagacattattattcagaatagaaacaaattgttgtctcaaacctgggtctgcaaagaacccagggcaagatggagtctgatgaggaatgatgagcatgattctctctaggcccaaggctgtggcatccagacaccttccaagggcagttagatttggtcctgggaggcccaggtggcaggtgccagccagctcctcccattcccagccagggcgcacctcctcaggagaacttgttagcatcttcactgggttcctttaaaccagaaatctatggacttgctttcacattataacagtattcccccaggccaccagccatgggcatgttcccaaggcaatgtcaacgcacagaaggtggcaggaaggggacatattgtggagagtctcacaactgcagtctacctgcttgtcctatgccaggagacctttggctgagtgcaggctgaagaatccaggcatcaacctcacaatcccagggactccctcagtgtccgttctgccccagagctcaggatggcttcccacactgcacagttctgtgggggctgagagcacctgctacaaaccacagagtcactacctcgtgcagccactcctgcagccatcagacctccctgtgtgtgggaggaccttgagcctcttattttgttttggtttggtttttgttcttgcacaggtgcgggaagcccaagcggagcctgcatcattgcccctggttcttaactgtggtgggattcacttttgaattgcttcatcctaggcctagatcatacctaacctgggaagctccgccctcttccctcctggaggtgagactccggcctattcagtcagtcctcttccctgagggcagcttctgtttcagcccctcccagcaaagaccaccagtgcaagtattttcaggggagagaatatatgaagaaagcagtcttttaactgtaaatcacaatgtgttttgtatgttcccaatgagtgtttggaatgatcaaatgaatgattgtttggaacattgtctggatgttatcaaaacaaaaacaaaccaggatttatacccctggcaagtaacaaatgactttccatgagaatgcaggttttgaccaaaggagttttattacttctcacaagtaaggagggcactgggagtgttctccaaagcaatgtttcctgagagaaaatgacaggaggactttatgtggtgttggagaggggagagggtgcatcatcgcatgtagaggagggttcccagtggcacagatgcagtgagtcatggtgccagcacataggttgcatgttatggtaatgaatctacaggtctcctgaggtgcaggctttagcttggtcatgaggaaagttcactggggttcatctgtaagttgtcagggtctttcaggagctggttccaaccaactaggtgaccacatttcacacagggtttgggataaaactggcttcaaggcaagaggctgtaaaacaggctgactgcttgaattgacaaaattcctatactccctggattccctccctgttggcctacaaatttccttccctggagatatgtcactcctcattcttgagaggtccttcttctgtaacttcatgctgattagggatgccgtgtccagagatattaggggagtgaaaatctctagacactaaatctaaatgtgttttgaggtctcccaagataggctgcaaaggctggtattgttggaagctgcagttgtaatttttctaatctggaagatacaaattttaccaagagatttaagatccagggaccaaacaacagtagtacaaacaataaagttagtagttctactaggggcagaatattaccaagtaattggtattgcccatttgatagcttcccaaatagtcagaactatggccctgtggattaaaagccgtgtaaccaagaggcttgggcatagaccttcttaatgtcaacttctatttcccctgaggtgtttactcagggacagcaagaggaattagtaactgcacacactcctccctgttccactaaaagattgtctaatactgtaccattacctagcaccacagtaaccaaggagtcaactgaggatgctaaagactcaagttttctagtcaagttttttacggtggtttcatgataagcaaatccccaaagagcagccatcctggatgctgctcccatctcccccaaaattaaactccttgctctttttttttttttgagttggagtctcgctctgtcaccctgtctggattgcagtggcgggatctcagctcactgcaagctctgcctcccgggatcacgccattctcctgcttcagccttctgagtagctgggaccacaggcgtccaccaccatgcccggctaattttttgtattgttagtagagacggggtttcaccatgatcgagccaggatggtctcgatctcctgacctcgggatccgcccactttggcctcccaaagtgctgggattacaggcgtgagccactgcgcccagcgccaactcatttctctttttgacctgacttgtagtagacccgcctcaacagcctcaatatcagaggctctcgcaggccaattgtacattgtccttccatccaaacgtcctccgtgcagggatgagcgatgtcaagtggggtaaagggaaggaacctcaaggcaaacaggcgtggggtagatatttgtgggggacccacagatgaacacattccccctgaggggcacatactcatttggggataaagatatttagctgtacacagtggctgatacctgtaatcccagcacttggggaggccgaggcaggcagatcacttgaggtcaggagttcgagaccaacctggccaacatggtgaaaccccgtctctactaaaaataaaaaaattagccaggcgtggtggtgtgcacctggaatcccagctactcaggaggctgagacaggagaatcgcttgaacccaggaggcggaggttgcagtgagctgagattgcgcctctacactctagcctgggtgacagagcaagactccgtctcaaaaaaaaaaaaaaaaaagacatttaatagtggtgctatttggctccaggtgccattagttttacataaagggagaccggcccaccccgcaggtggtccctgtccctgcagtcagctgagacattattcttataaggtgttggcctgtttacctgggtgtaccagaaactggggcttggtattcctcaccatgaactgcatttactgctctgtcctcaatattttttagtgatgttcatgtcaggacaccagtaagtaatattggggtggcaggtggtaggtagtgttcaaggagaccggttacctcccttttgtgtctggtcctgtgtcagtgtagtaagtctgccctggaggaattgcacagcttctgcatacttgctgtatagctgagccatttagcaaggttgacacctaggtggcatttgctatagagatgctagtcaaggtgatgcaagggatttccccactctccaggaagagcgtaaccacagggaaggggagcttgctccagttctgtgggtgaaagtgaaatgtgaagattgccacaagttctgtcacttgggcagaccaagttcatgggtgcctatagcatatccagcattggaacaggctatttcccttcactgtgatgtggggaaaactgactattgtattgtcttcccggagaccactggccatggtaataaaagggactaaccagtagagagagaccaagttcattgtatatactacatggtgatttagcaccagttaagagtttttacagaatgtaaaagagcatagagattcctctaagaatgaagaaattcctgatacatcgagagcattgcaagggcacattttacttatctatgtcctttctctggaagaggagcttaagatcagaggccagttcataggaataagttggatctaatgaagcctggtctgagggcgctggtgcaggcttcattcaggaatgacagatccagggtgtgagtccctgcaatttaagagaagaatgagtggttatcaccacagggtagggcccagtccagacaggatttagctggtcttgaggtgatttagatttccaagtcttaaggtgacctcagtctcaaggttgatataggtgaagcttaacatcagtgggaactggaagacaggttcacatattagattgagagcttgtgttagttttcctaaatacacaatatgttttacatccctctcagtctcaccatcagggcatgtcaaaggttccattgtgccagggtaagctcttccatatagtaattcaaaagggctaagtctcactttcccttttggtgccagctgaagtcatgttagtgtgatggagaggcacttcagccagctttcatgagtttcctggcatggtttagctaaagtgacctttatggttctattagtatctttgtccttttcagatgactggggcctccagtctgcatgtagtctccatttgatttccaaggcagagaataccccctggctaactttggaaatgaaggcagctccattgtcactctggatcaatcaaggtaagccacacttcaagaggatgtctttaagtaaagctctggcatcatttgccttttctgtgtgacaaggtaaggcttctatccagccagtaaaggtgtccacacaaaccagctggtacatgaggtttccaggtgcctggagcatcactgtaaagtctatttgccattcttctcctggtatgcccgcctccgccccttagttgaggcacagagagcctggtctgagcattattctgtacatatttgtggcacttgttagagatttagtctatttgaccacttggatcgggtacctttattacactcatcaaccaattgtgtaaggttttgatatggttaggctttgcgtccccacccaaatctcatcttgaattgtaatcctcgtaatccccacgtgcctagggagagacctgtgtagatgattgaatcatgggggaggtttctcccatactgttctcgtgatagtgaattctcacaagatctgatggatttatgaggggctctttccccttcgctcctcactcttctctctcctgccgctgccgtgtgagaaagcctaagcttgcctcccggttgccttctgccatgattgtaagtttcctgaggcctccccagccatgcggaactgtgagtccattaaacctctttcctttataaattacccagtctcaagtatttctttacagcagtgtgagaacagataccaaaatgtgatgattcatggacatatttaattacagcccagcctaggttttctggaatctggagtcttcctttgtcattgatagctcatccttccaaatccaaatgtgggagatacctttcccatttggatttttctaatttctgagtagtagggccaaaacttgtggagtgacaaatctggggatcagggtcatttgcaaactttgaactgttcatgctgccttcttagcagctgtgtctgctaggttatttccttttataacctcagaattcccctctggtgtccccagcagtggaccgccactaaccttttaggtaactgtactacctgtaacagctgtaatatttcttatgcacgtcttatctccttattgtccacagtcatggttccaagggggataatcccagaggcatacttgtcatctctctaggaatggggatggattttcattagggtcttgttctgtttcctggagttttccccaattgattggcttacttccctcatgcctctgagtagcatattgctacaatgatccctgttatcactggagtcccagtttgggtcggctgttgggactgacacctcagcagccaagtagatttggtagcccatgttatcagcctacattttgtctgcctcttccttagctttgcccgtgatggtagatttcttttccaccacgagcagagttgccattaaggtctgcatgtctgaccaggtgaggttatgtgtgaagaatattccccttctgagagttctgaactctcatgggctcactggtaagcctttaatattggatttctcattgtacaaatcagtagttgtaagaggtacatagacccaaacaaaacctccctctccatcacacacctgcctgggtgggaaccatcccactctggggttccctctcagggaacttgttatgctggtaacttgagctaccaaatctattgactactgaggtgtcagtcctaacacaacccaaagtgtgaccccagtgataatggggatcaacaacagccagatcattatgggaatatgctgctcagaggcatgagggaagtaagccagccaccagtcagaaggggagtggtgagtggtgctgcctggcaaagagggatacatctgcaagcctcataaaatgagttgggatgaggtttttcttttttattctctagaagaatttaatgtagtttattgcttaaatgattaggagaattcaccagtgaaacccatctgggcctgaactttcttttgtggaaatcatttttttcagtagctattcagatttcagttttccttttatgccaaggtttggcaagttttgtttttcaaggaatttgtccatttcatagttacaaattgattgatccaatgttataatatccttttgttaatgtctggaggttctaggatctgtaatgatgttccatttttattcctgatattatttttgcctcctgtcatttttacctgatcactctttccaaggggtgtatacatttcactggtattgtcaaataacccactttgggttttattgatttttctctatcatatattggtcttatattgattttttgttgtttattttggggcctgctgttgccatagcaggagccacagccagctccacagaattcggaaggcctggcaagtatggaggaagacccttgctttcccctggaggtgctgagagtttaattccagaggaagtaggggagttatttccctgtattggcaaaggttctagtttttgagtaggactaaaggacctcacctctcttgaaggagaagtagagaggcttcttctcattcccttccctacaagtccccacatgactggttcttcctctccaggggcttctagaattagcaacgttgttccctttggtcctttgaccaattacatatcctgcacttcttctgtaaggctgggtgttgatagagggccataagacattatacataaggtattttatcccatttaccttgtttcttataaaataagtcccagttggagaattgtattactaatgtatgtaagtaactcatgttcagaccatctctcctgattccctagggaacaatggggccacatggcattacggtaatatatcatttgctttttggtcatggatatgggcatccaaatagttttcagtgccggaggagccactgtaacgggctctcctccagtattgagacctggttccccatattgagacctggttccccatattctagggtctttgcccagaaggctgattccactctccaaggagcttccactggggattggtgatgacacaaatcctgtaactcttagcctgtaggatatttctggtcctttcagcttgccactacacccaggccaccatggagtggaggtactggggagctaggagaggataataggggttgcctctccctggatcatgttcagtctgggtagcttcgctggagatctcatggagattccagagtagttccggatccagcttgagtggtgggaggtatgtaaatcaatcaagtaagcaaggtgttctttcgggagagggtgcatgctctgctcatgtaaactctgcatcactgtattttggttccaggaattataatcccacccaaactgcaccattctaaattaggcctcttcaaatcaataacagttcttctgtgactgctggaaaatggaagcccactattttagggattaccacagactaaggggaagggaatccagacttcacatgcattcaggtcacaaagatgcataagtattgccaaaagtgacaagcattcagcctacagatataccagacagggacaaagtcttgaagatgagactcctcgtctatattagggcttccccttgttaaaatggatgaagatgtctctcaactcctagacctgaaggggagtcctgcccgttcccaacaatcctggatcccttgagctaggtcctaaacctgacaacccagagtcctaataatcaaaaccaaaaccactcttttagtcagttcacagaaccaccaccacttactgcctcaaagttgcaccaaatgaaaggtccaagcagccacttctgctctcctggtgggggcggaagggggtccctgagccccttcaccaatctccctctcggcaacttaggcaacttaacccactcatgcttcctcagactgctgcttcgcctgtgagcaagcctataagagagatcgagtcagggctcagtccatagtcccatctggatcaaccagatttgtttcccaggccctcccaccccaccacctccaaaaaaaaagcaaggtttgtttgcctggtgagtaacaaaagttgctgagaacacaggttttgatcaataggagttttattacttgtcgcaagtaggaagagcactaagaatatttgccaaagcagtgtctcttaagaaaaaatgacaggaaggctttatggagtgatcagtgatcgagaggggagaagatgcatcatcacatgaagaggaggggtcccagtgacacagatgtagggaatcatcgtgccaccacataggacgcatgctatggtaatgaaactatagctctcccaaggtgcaggatttagcattgtaatgaggaaagttcactgtaagtgagttcatctataagttgctggggtctgtcaggagcaggttccaactgactaggtgaccacatttcacacaggatttgagacaaaaccgtctgcaaggcagaaggctgtaaaacgggctaattactcaaactcattaaattccttcactccctgagggcccgccctgtcttgtctatacagccagtccttagaaagtgag

SEQ ID NO: 683 - DNA, 11895 bp, Homo sapiens
cttgtccacagtgcacctctctaccttaaaaagaaatacctgagcttgtccagaataatcccatggttcaaattctgcgatgatcataaggagcaaacttctgagtaacagaacacttctaagcatactatctataatattttatctagacagatttctaagccctcaggatgatttagtcttctagagttgacccaataaaatatgacctatatatgaattcagaaggtttgagattatgatcttaagtaactagtataacttcttagtgttcctctttgtaaaaatgaaggattatttttagcagatgaggtttgaaattaatatcttattttcttcatttcttcgtaggtgggtcattctaatctgggcattaatgagtctttttcatttttattgccttcatttgttccacataagccaacaagagagtcggaatatcactcttcagatctcagaatgttgaggatgtctcctgacactgtgccaaaggctcctaaacatttaaaagcaggagacacttctaaaggaggcatagctaaagttactcaatccaacttgaagtcaggcatcactaccactcctgttgattcagacattggatctcatttatccttgtcccttgaggacctgtctcagttggctgtaagttctctagaaactactactggtcaacacactgatactctcaaccaaaagacattagcagatactcatctaactgaagagactctgaaagtcacagctattcctgaaccagctgaccagaagactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttaccaacaagagttaccagagagtaacttaaccgaagagcctttggaagtttcagctgctcctggcccagtggagcagaagacgggaatacctacagtatcctctacatcccactcacatggagaggacctcctctttttctatcgacagaccttgccagatggtcatctaactgatcaggctctgaaagtctcagctgtgtctggaccagctgaccagaagactgggacagcaacagtactctctactccccactcacatagagagaagcctggtattttttaccaacaagagtttgcagacagtcatcaaactgaagagactcttactaaagtttcagccactcctggaccagctgaccagaagactgagataccagcagtacagtctagttcttactcacaaagagaaaagcctagtattttgtacccacaggacttagcagacagtcatctacctgaagagggtctgaaagtttcagctgttgctggaccagctgaccagaagactggcctaccaacagtaccctctagtgcatactcacacagagagaagctccttgttttctaccaacaggccttgctggacagccatctacccgaagaggctctgaaagtttcagctgtttctggaccagctgacggaaagactgggacaccagctgtaacctctacttcctctgcgtcctcttcacttggagaaaagcccagtgctttctatcagcagaccttacccaatagtcatctaactgaagaggctctgaaagtatcaattgttcctggaccaggtgatcagaagactgggataccctcagcaccatctagtttctactcacacagagagaagcccattattttttcccagcagaccctgccagactttcttttccctgaagaagctctgaaggtttcagctgtttctgtattggctgcccagaagactgggacaccaacagtgtcctctaattctcactcacatagcgagaaatctagtgttttctaccagcaagagttgccagacagtgatctacctagagaatctctgaaaatgtctgctattcctggactgactgaccagaagactgtcccaacaccaacagtaccttcaggttccttctcacatagagagaagcccagtattttctatcaacaggagtggccagatagttatgcaactgaaaaggctctgaaagtttcaactggccctggaccagctgaccagaagactgagataccagcagtacagtctagttcttacccacagagggagaagcctagtgttttgtacccacaggtgttatcagacagtcatctacctgaagagagtctgaaagtttcagccttccctggaccagctgaccagatgactgacacaccagcagtaccgtctactttctactcacaaagagagaagcctggtattttctaccaacagaccttgccagagagtcatctgcctaaagaggctctgaaaatttcagtagctcctggactagcagaccagaagactggcacaccaactgtaacctcaacttcctactcacaacatagagaaaagcccagcattttccaccagcaggccttgccaggtactcatatacctgaagaggctcagaaagtttcagctgttactggaccaggtaaccagaagacttggataccaagagtactttctaccttctactcacaaagagagaaacctggtattttctatcaacagaccttgccaggtagtcacatacctgaagaggcacagaaagtttcacctgttcttggaccagctgaccagaagactgggacaccaactccaacctctgcttcttactcacacacagagaagcctggtattttctaccaacaggtcttgccagataatcatccaactgaagaggctctgaaaatttcagttgcctctgaaccagttgaccagacaactggcacaccagctgtaacctctacttcctactcacaatatagagagaagcccagcattttctaccaacagtcgttgccaagtagtcatctaactgaagaggctaagaatgtttcagcggttcctggaccagctgaccagaagactgtgataccaattttaccctctactttctactcacacacagagaagcctggtgttttctaccaacaggtcttgccacatagtcatccaactgaagaggctctgaaaatttcagttgcctctgaaccagttgaccagacaactggcacaccaactgtaacctctacttcttactcacaacatacagagaagccgagtattttctaccaacagtcgttgccaggtagtcatctaactgaagaggctaagaacgtttcagcggttcctggaccaggtgaccggaagactgggataccaactttaccctctactttctactcacacacagagaagcctggtagtttctaccaacaggtcttgccacatagtcatctacctgaagaggctttggaagtttcagttgctcctggaccagttgaccagacgattggcacaccaactgtaacctccccttccagctcatttggagagaagcccattgttatctacaaacaggcctttccagagggtcatctacctgaagagtctctgaaagtttcagttgctcctggaccagttggccagacaactggcgcaccaactataacctctccttcctactcacaacatagagcaaagtctggcagtttctaccaactggcattgctaggtagtcaaatacctgaagaggctctcagagtttcttctgctcctggaccagctgaccagacaactggcataccaaccataacctctacttcctactcatttggagagaagccgattgttaactacaaacaggcctttccagatggtcatctacctgaagaggctctgaaagtttccattgtttctggacctactgaaaaaaagactgacataccagcaggacctttaggttccagtgcacttggagagaagcccattactttctaccggcaggctctgctagacagtcctctaaataaagaggttgtgaaagtttcagctgctcctggaccagctgaccagaagactgagacattaccagtacattctactagctactcaaatagggggaagcctgtcattttctaccagcagaccctatcagacagtcatttacctgaagaagctctgaaagttccacctgttcctggaccagatgcccagaagactgagacaccatcagtatcctctagtttatactcatatagagagaagcccattgtcttctaccaacaggccctgccagacagtgagctaactcaagaagctctgaaagtttcagctgttcctcaaccagctgaccagaagactgggttatctactgtaacttcctctttctattcacatacagagaagcctaatatttcttaccagcaagagttgccagatagtcatctaactgaagaggctctgaaagtttcaaatgttcctggaccagctgaccagaagactggggtatcaacagtaacctctacttcctactcacacagagagaagcccattgtttcctaccagcgagagttgccgcattttactgaagcaggtttgaaaattttaagagttcctggaccagctgaccagaagactggaataaacatcctgccctctaattcctacccacagagagagcactctgtcatttcttatgagcaggagttgccagatcttactgaagtaactttgaaagcaataggggttcctgggcctgctgaccagaagactgggatacaaatagcatcctctagttcctactcaaatagagagaaggccagtatttttcatcagcaggagttgccagatgttactgaagaagctttaaatgtttttgttgttcctggacaaggtgaccggaagactgagataccaacagtacctttaagttactactcacgtagagagaagcccagtgttatctctcaacaggagttgccagacagtcatctcacagaagaggctctgaaagtttcacctgtttctataccagcagagcagaagactgggataccaataggactgtctagttcctactcacattcacataaagagaaactcaagatttcaactgtgcatataccagatgaccagaaaactgagtttccagcagctacccttagttcctactcacaaatagagaagcccaagatttcaactgtgattggaccaaatgaccagaagactccatcccagacagcttttcatagttcctattctcaaacagtaaagcccaatattttatttcaacagcagttgccagatagagatcaaagtaaaggtattctaaagatttcagctgtccctgaactaactgatgtgaatactggaaaaccagtatctctctctagttcttattttcacagagagaaatcgaatattttcagtccacaggaattgccaggtagtcatgtaactgaagatgtgctgaaggtttcaacaattcctggaccagctggccagaaaacagtattaccaacagctcttcctagttccttttcacatcgagagaaaccagatattttctatcaaaaggatttgccagatagacatctaactgaagatgctctaaagatctcaagtgctcttgggcaagctgatcaaattaccggattacaaacagttccctctggtacttactcacatggtgagaatcacaagcttgtttcagaacatgtccaaaggctaatagataatttgaattcttctgactccagtgttagctcaaataatgtgcttttaaattctcaggctgatgacagagttgtaataaataaaccagaatctgcaggttttagagatgttggctctgaagaaatccaggatgcagaaaatagtgctaaaactcttaaggaaattcggacacttttgatggaggcagaaaatatggcactgaaacgatgcaattttcctgctccccttgcccgtttcagagatattagtgatatttcatttatacaatctaagaaggtggtttgcttcaaagaaccctcttccacgggtgtatctaatggtgatttgcttcacagacagccattcacagaggaaagcccaagcagcaggtgcatacagaaggatattggcacacagacgaatttgaaatgccggagaggcattgaaaattgggagtttattagttcaactacagttagaagtcctctacaggaagcagagagcaaagtcagtatggcattagaagaaactcttaggcaatatcaagcagccaaatctgtaatgaggtctgaacctgaagggtgtagtggaaccattgggaataaaattattatccctatgatgactgtcataaaaagtgattcaagtagtgatgccagtgatggaaatggttcctgctcgtgggacagtaatttaccagagtctttggaatcagtttctgatgttcttctaaacttctttccatatgtttcacccaagacaagtataacagatagcagggaggaagagggtgtgtcagagagtgaggatggtggtggtagcagtgtagattcactggctgcacatgtgaaaaaccttctgcaatgtgaatcctcactgaatcatgctaaagaaatactcagaaatgcagaggaagaggaaagccgggtacgagcacatgcctggaatatgaagttcaatttagcacatgattgtggatactccatttcagaattaaatgaagatgacaggaggaaagtagaagagatcaaggcagagttatttggtcatggaagaacaactgacttgtccaagggtttacagagtccacggggaatgggatgcaagccagaagctgtatgtagtcacattattattgagagccatgaaaagggatgtttccggactctaacttctgaacatccacaactagatagacacccttgtgctttcagatctgctggaccctcagaaatgaccagaggacggcagaacccatcatcatgcagagccaagcatgtcaacctttctgcatccttagaccagaacaactcccatttcaaagtttggaattccttgcagttaaaaagtcattccccatttcagaactttatacctgatgaattcaaaatcagcaaaggtcttcgaatgccattcgatgaaaagatggacccttggctgtcagaattagtagaacctgcttttgtgccacctaaagaagtggattttcattcttcatcacaaatgccgtccccagaacccatgaaaaagtttactacctccatcactttttcatctcaccgacattctaaatgcatttccaattcctctgttgttaaggttggtgttactgaaggtagccagtgtactggagcatctgtgggggtatttaattctcatttcactgaagaacaaaatcctcccagagatcttaaacagaaaacctcttccccttcatcatttaaaatgcatagtaattcacaagataaagaagtgactattttagcagaaggtagaaggcaaagccaaaaattacctgttgattttgagcgttcttttcaagaagaaaaacccttagaaagatcagattttacaggcagtcattctgagcccagtaccagggcaaattgtagcaatttcaaggaaattcagatttctgataaccatacccttattagcatgggcagaccaagttccaccctaggagtaaacagatcgagttccagactaggagtaaaagagaagaatgtaactataactccagatcttccttcttgcatttttcttgaacaacgagagctctttgaacaaagcaaagccccacgtgcagatgaccatgtgaggaaacaccattctccctctcctcaacatcaggattatgtagctccagaccttccttcttgcatttttcttgaacaacgagaactctttgaacagtgcaaagccccatatgtagatcatcaaatgagagaaaaccattctccccttcctcaaggtcaggattctatagcttcagaccttccgtctcccatttctcttgaacaatgccaaagcaaagcgccaggtgtagatgaccaaatgaataaacaccattttccccttcctcaaggtcaggattgtgtagtggaaaagaataatcaacataagcctaaatcacacatttctaatataaatgttgaagccaagttcaatactgtggtctcccagtcagccccaaatcactgtacattagcagcatctgcatctactcctccttcaaatagaaaagcactttcttgtgttcatataactctttgtcccaagacttcttccaagttggatagtggaactttagatgaaagattccattcattggatgctgcttctaaagcgaggatgaatagtgagtttaactttgacttacatactgtatcttcgagatcactggaaccaacctccaaattattgaccagtaaacctgtagcacaggatcaagaatctttaggttttctaggacctaaatcttcactggatttccaagtcgtacagccttctcttccagacagtaacactattactcaggacttgaaaaccataccttctcagaatagccagatagtaacctccaggcaaatacaagtgaacatttcagatttcgaaggacattccaatccagaggggaccccagtatttgcagatcgattaccagagaagatgaagaccccactttctgctttctctgaaaaattgtcatctgatgcagtcactcagataacaacagaaagtccagaaaagaccctattttcatctgagatttttattaatgctgaagatcgtggacatgaaattatagagcctggtaaccagaagctacgcaaagctcctgtcaagtttgcctcatcatcttcagtccaacaggttactttttctcgcggcacagatggccagcctttattattgccatataagccttctggtagtaccaagatgtattatgttccacaattaagacaaattcctccatctccggattccaaatcagataccaccgttgaaagctcccattcaggatccaatgatgccattgctccagacttcccagctcaggtgctaggcacaagagatgatgacctctcagccactgttaacattaaacataaagaaggaatctacagtaagagggtagtgactaaggcatccttgccagtgggagaaaaacccttgcagaatgaaaatgcagatgcctcagttcaagtgctaatcactggggatgagaacctctcagacaaaaaacagcaagagattcacagtacaagggcagtgactgaggctgcccaggctaaagaaaaagaatctttgcagaaagatactgcagattccagtgctgctgctgctgcagagcactcagctcaagtaggagacccagaaatgaagaacttgccagacactaaagccattacacagaaagaggagatccataggaagaagacagttcccgaggaagcctggccaaacaataaagaatccctacagatcaatattgaagagtccgaatgtcattcagaatttgaaaatactacccgttctgtcttcaggtcagcaaagttttacattcatcatcccgtacacctaccaagtgatcaagatatttgccatgaatctttgggaaagagtgttttcatgagacattcttggaaagatttctttcagcatcatccagacaaacatagagaacacatgtgtcttcctcttccttatcaaaacatggacaagactaagacagattataccagaataaagagcctcagcatcaatgtgaatttgggaaacaaagaagtgatggatactactaaaagtcaagttagagattatccaaaacataatggacaaattagtgatccacaaagggatcagaaggtcaccccagagcaaacaactcagcacactgtgagtttgaatgaactgtggaacaagtatcgggagcgacagaggcaacagagacagcctgagttgggtgacaggaaagaactgtccttggtggaccgacttgatcgtttggctaaaattcttcagaatccaatcacacattctctccaggtctcagaaagtacacatgatgatagcagaggggaacgaagtgtgaaggaatggagtggtagacaacagcagagaaataagcttcagaaaaagaagcggtttaaaagcctagagaaaagccataaaaatacaggcgagcttaaaaaaagcaaggtgctttctcatcatcgagctgggaggtctaatcaaattaaaattgaacagattaaatttgataaatatattctgagtaaacagccaggttttaattatataagcaacacttcttcggattgtcggccctcagaggagagtgagctgctcacagatactaccaccaacatcctttccggcaccacttctactgtcgaatcagatatattgacccaaacagatagagaggtggctctgcacgaaaggagtagctctgtttccactattgacactgcccggctgattcaagcttttggccatgaaagagtatgcttgtcacccagacgaattaaattatatagcagcatcaccaaccaacagaggagataccttgagaagcggagcaaacacagcaagaaagtgctgaatacaggtcatcccctagtgacttctgagcacaccagaaggagacacatccaggtagcaaaccatgtgatttcttctgactctatttcctcttctgccagtagtttcctgagctcaaactctactttttgcaacaagcagaatgtacacatgttaaacaagggcatacaagcaggtaacttggagattgtgaacggtgccaaaaaacacactcgagatgttgggataactttcccaactccaagttccagcgaggctaaattggaagagaacagtgatgtgacttcttggtcagaagaaaaacgtgaagagaaaatgctctttaccggttatcctgaggacagaaagttaaaaaagaacaagaagaattcccatgaaggagtttcctggtttgttcctgtggaaaatgtggagtctagatcaaagaaggaaaacgtgcctaacacttgtggccctggcatctcctggtttgaaccaataaccaagaccagaccctggagggagccactgcgggagcagaactgtcaggggcagcacctggacggtcggggctacctggcaggcccaggcagagaggctggcagagacctactgaagccatttgtgagagcaacccttcaggaatcgcttcagtttcacagacctgacttcatctcccgctctggggagcggataaagcgcctgaagttaatagtccaggagaggaagctgcagagcatgttacagaccgagcgggatgcactattcaacattgacagggaacggcagggccaccagaatcgcatgtgcccgctgcccaagagagtcttcctggctatccagaagaacaagcctatcagcaagaaggaaatgattcagaggtccaaacggatttatgagcagcttccagaagtacagaaaaagagagaagaagagaagagaaaatcagaatataagtcataccggctgcgagcccagctatataaaaagagagtgaccaatcaacttctggggagaaaagttccctgggactgacacaagtttattttcctcagagccttggaattctattttatgaacctagagaagcagaatccttacttttgtgagtctggttgaataaagcttattctttgtccatgtgtattttagaaatagtaacttctaaagagtctggaacaaagtggtgattaaaattcctaatggtttgggagcaatactttctgcatagtggccttgtccaatggcctgtgtgttacaatgatatgatcatttctcaagaataagtccctttttgtatgtgtttttatacttttagaaaataaaaactttagattaactcat

SEQ ID NO: 684 - protein, 3708 aa, Homo sapiens
MLRMSPDTVPKAPKHLKAGDTSKGGIAKVTQSNLKSGITTTPVDSDIGSHLSLSLEDLSQLAVSSLETTTGQHTDTLNQKTLADTHLTEETLKVTAIPEPADQKTATPTVLSSSHSHRGKPSIFYQQGLPDSHLTEEALKVSAAPGLADQTTGMSTLTSTSYSHREKPGTFYQQELPESNLTEEPLEVSAAPGPVEQKTGIPTVSSTSHSHGEDLLFFYRQTLPDGHLTDQALKVSAVSGPADQKTGTATVLSTPHSHREKPGIFYQQEFADSHQTEETLTKVSATPGPADQKTEIPAVQSSSYSQREKPSILYPQDLADSHLPEEGLKVSAVAGPADQKTGLPTVPSSAYSHREKLLVFYQQALLDSHLPEEALKVSAVSGPADGKTGTPAVTSTSSASSSLGEKPSAFYQQTLPNSHLTEEALKVSIVPGPGDQKTGIPSAPSSFYSHREKPIIFSQQTLPDFLFPEEALKVSAVSVLAAQKTGTPTVSSNSHSHSEKSSVFYQQELPDSDLPRESLKMSAIPGLTDQKTVPTPTVPSGSFSHREKPSIFYQQEWPDSYATEKALKVSTGPGPADQKTEIPAVQSSSYPQREKPSVLYPQVLSDSHLPEESLKVSAFPGPADQMTDTPAVPSTFYSQREKPGIFYQQTLPESHLPKEALKISVAPGLADQKTGTPTVTSTSYSQHREKPSIFHQQALPGTHIPEEAQKVSAVTGPGNQKTWIPRVLSTFYSQREKPGIFYQQTLPGSHIPEEAQKVSPVLGPADQKTGTPTPTSASYSHTEKPGIFYQQVLPDNHPTEEALKISVASEPVDQTTGTPAVTSTSYSQYREKPSIFYQQSLPSSHLTEEAKNVSAVPGPADQKTVIPILPSTFYSHTEKPGVFYQQVLPHSHPTEEALKISVASEPVDQTTGTPTVTSTSYSQHTEKPSIFYQQSLPGSHLTEEAKNVSAVPGPGDRKTGIPTLPSTFYSHTEKPGSFYQQVLPHSHLPEEALEVSVAPGPVDQTIGTPTVTSPSSSFGEKPIVIYKQAFPEGHLPEESLKVSVAPGPVGQTTGAPTITSPSYSQHRAKSGSFYQLALLGSQIPEEALRVSSAPGPADQTTGIPTITSTSYSFGEKPIVNYKQAFPDGHLPEEALKVSIVSGPTEKKTDIPAGPLGSSALGEKPITFYRQALLDSPLNKEVVKVSAAPGPADQKTETLPVHSTSYSNRGKPVIFYQQTLSDSHLPEEALKVPPVPGPDAQKTETPSVSSSLYSYREKPIVFYQQALPDSELTQEALKVSAVPQPADQKTGLSTVTSSFYSHTEKPNISYQQELPDSHLTEEALKVSNVPGPADQKTGVSTVTSTSYSHREKPIVSYQRELPHFTEAGLKILRVPGPADQKTGINILPSNSYPQREHSVISYEQELPDLTEVTLKAIGVPGPADQKTGIQIASSSSYSNREKASIFHQQELPDVTEEALNVFVVPGQGDRKTEIPTVPLSYYSRREKPSVISQQELPDSHLTEEALKVSPVSIPAEQKTGIPIGLSSSYSHSHKEKLKISTVHIPDDQKTEFPAATLSSYSQIEKPKISTVIGPNDQKTPSQTAFHSSYSQTVKPNILFQQQLPDRDQSKGILKISAVPELTDVNTGKPVSLSSSYFHREKSNIFSPQELPGSHVTEDVLKVSTIPGPAGQKTVLPTALPSSFSHREKPDIFYQKDLPDRHLTEDALKISSALGQADQITGLQTVPSGTYSHGENHKLVSEHVQRLIDNLNSSDSSVSSNNVLLNSQADDRVVINKPESAGFRDVGSEEIQDAENSAKTLKEIRTLLMEAENMALKRCNFPAPLARFRDISDISFIQSKKVVCFKEPSSTGVSNGDLLHRQPFTEESPSSRCIQKDIGTQTNLKCRRGIENWEFISSTTVRSPLQEAESKVSMALEETLRQYQAAKSVMRSEPEGCSGTIGNKIIIPMMTVIKSDSSSDASDGNGSCSWDSNLPESLESVSDVLLNFFPYVSPKTSITDSREEEGVSESEDGGGSSVDSLAAHVKNLLQCESSLNHAKEILRNAEEEESRVRAHAWNMKFNLAHDCGYSISELNEDDRRKVEEIKAELFGHGRTTDLSKGLQSPRGMGCKPEAVCSHIIIESHEKGCFRTLTSEHPQLDRHPCAFRSAGPSEMTRGRQNPSSCRAKHVNLSASLDQNNSHFKVWNSLQLKSHSPFQNFIPDEFKISKGLRMPFDEKMDPWLSELVEPAFVPPKEVDFHSSSQMPSPEPMKKFTTSITFSSHRHSKCISNSSVVKVGVTEGSQCTGASVGVFNSHFTEEQNPPRDLKQKTSSPSSFKMHSNSQDKEVTILAEGRRQSQKLPVDFERSFQEEKPLERSDFTGSHSEPSTRANCSNFKEIQISDNHTLISMGRPSSTLGVNRSSSRLGVKEKNVTITPDLPSCIFLEQRELFEQSKAPRADDHVRKHHSPSPQHQDYVAPDLPSCIFLEQRELFEQCKAPYVDHQMRENHSPLPQGQDSIASDLPSPISLEQCQSKAPGVDDQMNKHHFPLPQGQDCVVEKNNQHKPKSHISNINVEAKFNTVVSQSAPNHCTLAASASTPPSNRKALSCVHITLCPKTSSKLDSGTLDERFHSLDAASKARMNSEFNFDLHTVSSRSLEPTSKLLTSKPVAQDQESLGFLGPKSSLDFQVVQPSLPDSNTITQDLKTIPSQNSQIVTSRQIQVNISDFEGHSNPEGTPVFADRLPEKMKTPLSAFSEKLSSDAVTQITTESPEKTLFSSEIFINAEDRGHEIIEPGNQKLRKAPVKFASSSSVQQVTFSRGTDGQPLLLPYKPSGSTKMYYVPQLRQIPPSPDSKSDTTVESSHSGSNDAIAPDFPAQVLGTRDDDLSATVNIKHKEGIYSKRVVTKASLPVGEKPLQNENADASVQVLITGDENLSDKKQQEIHSTRAVTEAAQAKEKESLQKDTADSSAAAAAEHSAQVGDPEMKNLPDTKAITQKEEIHRKKTVPEEAWPNNKESLQINIEESECHSEFENTTRSVFRSAKFYIHHPVHLPSDQDICHESLGKSVFMRHSWKDFFQHHPDKHREHMCLPLPYQNMDKTKTDYTRIKSLSINVNLGNKEVMDTTKSQVRDYPKHNGQISDPQRDQKVTPEQTTQHTVSLNELWNKYRERQRQQRQPELGDRKELSLVDRLDRLAKILQNPITHSLQVSESTHDDSRGERSVKEWSGRQQQRNKLQKKKRFKSLEKSHKNTGELKKSKVLSHHRAGRSNQIKIEQIKFDKYILSKQPGFNYISNTSSDCRPSEESELLTDTTTNILSGTTSTVESDILTQTDREVALHERSSSVSTIDTARLIQAFGHERVCLSPRRIKLYSSITNQQRRYLEKRSKHSKKVLNTGHPLVTSEHTRRRHIQVANHVISSDSISSSASSFLSSNSTFCNKQNVHMLNKGIQAGNLEIVNGAKKHTRDVGITFPTPSSSEAKLEENSDVTSWSEEKREEKMLFTGYPEDRKLKKNKKNSHEGVSWFVPVENVESRSKKENVPNTCGPGISWFEPITKTRPWREPLREQNCQGQHLDGRGYLAGPGREAGRDLLKPFVRATLQESLQFHRPDFISRSGERIKRLKLIVQERKLQSMLQTERDALFNIDRERQGHQNRMCPLPKRVFLAIQKNKPISKKEMIQRSKRIYEQLPEVQKKREEEKRKSEYKSYRLRAQLYKKRVTNQLLGRKVPWD
